United States Patent 7,745,391 (HUMAN THROMBOSPONDIN POLYPEPTIDE) - sequence listing, part 229

SEQ ID NO: 605619 - DNA, 396 bp, Homo sapiens
gagtgcgcggaggctgcggggtggagctgctcggccgggagcccggcgcgagacggagaggcggcggaggtgcccgcgcgcaggtctggtgggcggccgggaaggcttggagaggcgaaccggagcgcgggcccgcggtcgcccccgaccagaagccgggagacccgaaggcaccccgagcccgcccggaagcgcgccgaatgacaggcgcgcagggaaataacccgcccggctgggtgccccacaaggccccggggcggggacatatcccggtccgagacctattattggggcgatcccactcagaaagtaattttgataggcaacgaagatcacccacgtagtgtagatggccaccatataacgataataaaatcgttctttttgatcggcact

SEQ ID NO: 605620 - DNA, 291 bp, Homo sapiens
taaggtgctgacagaatataaaaagtatgtaattgtaacatcaacttgacctgaaatgtgagggacgggagaagtacaagtgtacgagttatgctcatgtctctgaagttgttggcttacaataggatggtatagctataaaatattttatgtaagcctcatagtaaccactaagtagaaacctgtagtagatcagattcagagacaggaatcaaagtatatcatttcaaaagtgatccaatcacaaaggaaggcaacgagaaaacaagaaagatacaaagtactacaaag

SEQ ID NO: 605621 - DNA, 89 bp, Homo sapiens
  misc_feature (58)..(58): n is a, c, g, or t
  misc_feature (86)..(86): n is a, c, g, or t
cgcatcttcgaggagtccccattctcatcatcttcctcttcttcatcctcgttcttgntcatcctcatcctcttcatcatcctccntcg

SEQ ID NO: 605622 - DNA, 100 bp, Homo sapiens
  misc_feature (36)..(36): n is a, c, g, or t
ccggaccagtgttccctagttgtgggagcagatgcntgggcgcatcgcggggcgggcagggcctgaagtgcaggtgcgggccgtggaccctggcgggggc

SEQ ID NO: 605623 - DNA, 592 bp, Homo sapiens
ctgaagtgggagagataaagtgtttcttcgcttcctcttttcaatagctgattgtgcatcagctattgcccatttatcaattggatgagggaaacttttttgaacacgttcctctacatctgaagcacttcggggctgagcttggcatagcatatttaataattgcaaaattaattcttcaacatactgaagagcatcatcattagactcgagagtaggatgaacttgcccctggacctttttcagcgcaggcaccagtagtcccctccacttgggcgcgttctcttcgctgaaaaactcgtagggcagctctcgcctgcatggtgccccggggccctctgggcggggagagggagcgcggtggccgggccagggagccgcgagagggcgttctccagcgcggaatctagccgcggcccctaccggtgatctgtcccctccgggcgccgcgcagtcggctagccctggcgagggggctgggggcgagccccgcctggccacccacccgacacaggtaccagccgtggagaacggacgcggcccggaggcggggcatcccgcaccaccgactctccgccagcctccccgcccc

SEQ ID NO: 605624 - DNA, 344 bp, Homo sapiens
gctgagtttcagcattgcccagcgcttccggcatggtgctggaagcgctgggcaatgctgaaaattcagaatgctgtgaaagagtcagcacacacctagagaaggcgcgtcgtgggttggaagatacaacaagtggagatgacaggtccttccagattgatggacaggtttaatgcaatccagttactcgaaaaacactgtttaaatgaagaagttcttgtactccctccccttggggtggcgtgcccccagcccacactctgatgctggggcagcgggtgaccgaggcgggagcttgatggagaggtgaatgggtggtgctttgctggctagttctagatcgc

SEQ ID NO: 605625 - DNA, 461 bp, Homo sapiens
ggatcctttcggcgtgggaggtggtgcgctagctaactggactgctgtcgttggatgcactgcgcagttcaggtgtgggctctgggaggcggaggcggaggaggccgctagagatggtgctgaggacgaggaggccggtaggttggtcatgctcactaggccactgaccaagctgaagaggggctcgggccacaagggtgttgccacttgttgggtgcaggctccagggaaaagcggccagtataggtgatggggggcagtcgaggtggtttggctggggtaactggtctccaccagcaccttctcgttgttcagagaggatgtcaggaaacgactctggcaggagagagagaagcgggagggctggttactggaaaacaatcactggaggacggaggacagacccgagcttgccaggcaatgaagaccgggccggcttaccattgactgggtaccgagct

SEQ ID NO: 605626 - DNA, 210 bp, Homo sapiens
cggggggctcgcgttcttgttgtgttttttttgtgggcccccccccccccgcccccattggttttccgctttaagtgaaactcctcgtgaaaaggggggggcccctttttttggggtccccctaaacatgtactgtaattctttgtctttggaaaaaaaatttttttttaggtaagggttagcttttctcttcaaaaaaaaaaaacaata

SEQ ID NO: 605627 - DNA, 913 bp, Homo sapiens
  misc_feature (80)..(80): n is a, c, g, or t
gagagagctgcttgccctcttccaccatagtaggacacagtgagaaggcaccatctaccaaccagagagtgggtcctcancatgacactgaatctaccagtgccttgatcttggacttcctagcctccagaaccgtgagaagtaaatttctgtttatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttgggtagcctggatggtttattggcatggatctgtgtccttaatgaagactcctaattctaaagaggatccagcctaacctgaaagccaaccagtcctcaataagttggccatgatcccaccagctcctccttgttggactaacttgtgtgatattgggaaggtgaaattcgttaaccaccttgcaggacaaaaagaacgaaagaatgacaggagtaatcttaaccccattagaatgttttccctttgtgtatctgcaatatgggattggtatgtgtttaatgagtctagaaattcactggcagtttatttggttccgtgtaatgtaatcctattaagtattggagtgatgatttttttacaggttactgggctttggggctaactaaaacttcactcatcggtggaggatataatggaatggcggtgagaatggagggcttttataaaattgtgggtaaggtttcacaatataatggggggggtggaacaaccgagtttactgtgttgggggtagggacgggtgatcaacagatgtgttgggaagaaaatagg

SEQ ID NO: 605628 - DNA, 240 bp, Homo sapiens
actctttctgtgcctcagtatcctccctgtaaaactagaaagataacaatccctagcacctggcttttctagctgcatagcgggcagagctttataaaggggctagaatatgtccagcatgagtaaaaacaaatggccagtacacatgagctataattgtctcattatttgtttaatctggtgtctggatgactttcctttcccggtatgcccatctgcagatggggacacattatggag

SEQ ID NO: 605629 - DNA, 742 bp, Homo sapiens
tatgccactagcaatgattgcttaaagagtagcgaagcactctatatttaagatggttaaacataactagctgttgcttggattatatataacttgtatatggcatgtagaggaaaattacacattaatatttgctgagagctgagcctttgtcgagtcatttgcttcgtaattttattccacttttcacgaaacacttttagttcctactagtagatttattggacaataactttcaggttttgtaataggatgccggggttctcagtattcttccatagacaggcactaagtaagcaagagggagcacatgggttgacgtttcacggtacgtaaaatactctcaacctatggtactaactgggttgactgggtttctcatgtatatgtactggcatggtacggagatgttgcgacgaagtatgtctcatcagactccgtgtgcaactttcccaagtgtggcctaacaaaagtgcaagcttctttttatgtttcttttgtagaatgtttaggttgtttttgtatagttacaagtgattaaattctcctgggaaattcacaagagaacgcaaagggcaaaacaagcacatccaggagcaacaagaccacgggaaacaaccctaggggccgtcgaggggacccaccaaaggcaccccggagaaggacgccacacgcccaggggccctcccccagggtctcgggacccacaagggggcccccaaaaggagagggggaaaacaac

SEQ ID NO: 605630 - DNA, 875 bp, Homo sapiens
  misc_feature (97)..(97): n is a, c, g, or t
ggcagaaacggcaggtggagcagcgtccggagcagcgcagcttctgaagctccaggcggtctttctgccgagcctcggtcccggcccatcctcccgnccatcgttgtgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctactgcacagacacagagtgtcttcaggaattaccgggaccctctggtgataatggcatcagtgttacaatgatcttgggtagcctggatggtttattggcatggatctgtgtccttaatgaagactcctaattctaaagaggatccagcctaacctgaaagccaaccagtcctcaataagttggccatgatcccaccagctcctccttgttggactaacttgtgtgatattgggaaggtgaaattcgttaaccaccttgcaggacaaaaagaacgaaagaatgacaggagtaatcttaaccccattagaatgttttccctttgtgtatctgcaatatgggattggtatgtgtttaatgagtctagaaattcactggcagtttatttggttccgtgtaatgtaatcctattaagtattggagtgatgatttttttacaggttactgggctttggggctaactaaaacttcactcatcggtggaggatataatggaatggcggtgagaatggagggcttttataaaattgtgggtaaggtttcacaatataatggggggggtggaacaaccgagtttactgtgttgggggtagggacgggtgatcaacagatgtgttgggaagaaaatagg

SEQ ID NO: 605631 - DNA, 285 bp, Homo sapiens
tttgaatttttactaaataaatttcccccggattaattttttttttttcatctggggatttggaatctcgggggttactggtaccccaatttggccaaagggttgaaatccctttaatgccagaacatgggaaatttgcagccctttcaagcaggggagggtctttttttataacatcggtaacgggggcccttaaatattttgagaggggaatggaaaaaataaaagggatagggttttttttttttttaaagaaaacaataaactttcaaagaggaaacccga

SEQ ID NO: 605632 - DNA, 369 bp, Homo sapiens
cgcaaacaacaaagacagtggatacctgtgcactctgagccgatccatactggaccatgctggaggttcgatatacgaccacttcacagtaagtaataactcagagtcataaagtcgaaacagcaaagacatctgaaatcatcagacttgttctgcaaataagcttacctaggcatgcataccactttcgccttaatcagaatttcccctttccaactatttaacagtggcaactataaaaactctggtcgttaaaatacacagcagtcacttcatattactgcctccctcaacccactcaccttctgaagaacagggctttttcaagttttgttcccctttaagttttaatagaagccagtagtgggt

SEQ ID NO: 605633 - DNA, 84 bp, Homo sapiens
gccgtgatgggcccggggcttctccaaaaacataattccctgcttctactggccgctcccaaggttgtggccaaggtcttcctt

SEQ ID NO: 605634 - DNA, 230 bp, Homo sapiens
catcggctaatgaagcggtgatgtgcatgaaggcagggctgggtgcacatgtccagacactcactctcagagaacgagactccacttgaaattcatgtctggtgaaacgggaccaggtttatattcttctatttcacacatgatacgcatcatcacacgcatatacaagttacaatgccatttgtccactgctgcatctctgattctatttcctgagatacctgctgggg

SEQ ID NO: 605635 - DNA, 886 bp, Homo sapiens
ggcaatggtcgtgctgggcagtggcgatgcaaaagtgagccagggaagctacgtgtggggaacaagtaccgcctggggacggaaagatcgggagcgggtccttcggatatatctaactggggtgccaacattcgcctctggatgatggaaagtcagccatcaatgctggagatgtgtgaagaccaaaggcatctcccagttgtatcatcgagagcatagttcgtacaagatgactgtcacggtctgtgcgtggtggatcgccgatgcactcaagggtggctgcaggagacgtgacgaggcagaacgtacaaacgtgtgcatggatcactggatccctgtgtgaggtgccatatccttgcgaggaccgtgattacaactttgctggtggcccgcgaatcttccagtcatcaatgaacgggtgctcgttcattgagtacgacccaaggattgaatgcaggcgcggtgactctgtacgatatgattcccatggtccaaacgtacacatgtccaatcactacccgcgggaccgttccacagtcctcaggacttagctatccctcaatgtgcggcttcgtggggaaagaaagggggaactcgtggtcctacattcattcgtagctttagggccctggcacatagaaagtaatgcgggggagcgtcccggcaatcccaaacaggtcatagtacctcttagtcgggcgaaaaaaggacattattgccgtagacctggacaacagggcacccagctaacgtccttaccattctaacgacggcagtccttaggagggggtatggaagcaataggccgctctgaggactgaaccatgcgcaagaacgccctggggttagagtatgcgtccattggtagtaatcatggccgtgggga

SEQ ID NO: 605636 - DNA, 298 bp, Homo sapiens
ctggctgagaaactaaaagagtgagaactcactcactaatgcaaggaggatgcaatgcatgtatgcagatatctagcccccatgacccaatatgcctccaatcaggctccatctccaacattgcggatcagatttcaacttgaggtttggaggggacgtatatccgaaccatatcacatagctatctgtgccctcccaactgtacccttgaatcctctctgctccggagtgtgccttttacgacaggatcgagacacctagaccaaggccgaggagagaaagctggtcatgccactac

SEQ ID NO: 605637 - DNA, 343 bp, Homo sapiens
agacactccactaaatactacacgcagacatgggaagtctgaaagtctctgtggggtaagtcagccgatggcagcttctcttagcactggtgcatcttccaggctctcagctgatgacgagatccaacacctcactgtggcagcccctgtgagtcagtggcctcgcaacttttcttttggctagaaaatgcataaaggaaaagttgacagtagcttaacagttcgggcagtgtgtatacactgcactgcagaatagacaactgttcagaaagcgtcttggctttcttatctttcctgttttctcccccgcttccttttctttccttccccagaggaaggaggg

SEQ ID NO: 605638 - DNA, 176 bp, Homo sapiens
cagacgatccctagatatcagcagagaaggaggaggaaggaataatatcaaatttaatatgaggaaactaaagtagggacagattaaataaaggggcagagcttagactctcacccaagcattgacatccaaaggtcacgcttataacacactacaccgagagtgttagattttga

SEQ ID NO: 605639 - DNA, 348 bp, Homo sapiens
tgagtatcgcccaacactaggctcaggcaatcctcccatcttggctcccaaagtgtgggattacacgcgtgagcaccgtgcctggcctggtttggaacattagaaagcacacacaggctttccacgttttatgcacctctataaaaatatttcgtacataaaatttgaaatgagaaggatgagactaaaaaatgagtagcagctcccaccgcaccctcagcaggcacagccaggctcaaaggcacatccaggttcaggtgtacggtccccatttgggaaccaggactgcggctggtgggaggaggctgtgtgagtggtgtgaatgggatgtgtgtgtgtgggggataa

SEQ ID NO: 605640 - DNA, 121 bp, Homo sapiens
agcggccgcccatttttggcgtctccctttctttaattaacatttcaaaagtaataaattctgactggacgactggtaaaacaaacaaaaaaaaaaaggggggggggggggaccggagctc

SEQ ID NO: 605641 - DNA, 238 bp, Homo sapiens
ccaatgtcacggatccttttaacaggctgatgctgacgcgtacagggaagggggtgggaatacttgcctgaggggcagagccaggagttgagccagtcctgactctcagtgttgtcctctatcctatagcccttggggcaagccagggactcttctagaagcagaaaactaacgtggaccaacccagcacccacgctctccagcatcttgggacggatgggcggtggggatgtacaca

SEQ ID NO: 605642 - DNA, 104 bp, Homo sapiens
tatagagaatcttgctttaacagtgaactggaataatgagtggcttcactggtaaaatgcttctgaattgacttgtggaaatccatttgggggtgcttggggaa

SEQ ID NO: 605643 - DNA, 991 bp, Homo sapiens
gctgcggtgaggctggtctccggctgccagaccatgctgagtggagcacgctgtaggctcgcctcatcgctgcggggaacgcgcgcgccgccgtccgcgattcgcccgtaggtgcctgcacgcgtcggggtcgcggcctttgtgccgatcggggcaacgaggactgaggagccgcccgacgatttcgatccggcgctgctggagttcctggtgtgcccgctctccaggaagccgctcagatatgaagcatcaatcgaacgagttgattaatgaagatgtcgggaaatagcttatccagactcattgatgggatccctagatatgataccacgagggcaggtaggatgacacggtcaactgtacgaagcgagaagaagtggagcagcgcctgggttcatactttacacaagttataaaaacgcaacgagccagattattcgttaagaccatataccttttaaaacacaggtggccaggtaataggtggccagacgactgcaatgtctctgtctcttcctacgttgactgtctgaataccactgggattcttgagcaggacgtgtctactcaagctctgtggaagaaaacttcccacagggtgcactagcgacagcaggctttgtttacagcctgtcttgcctatgaccataccagggtatgtattcttccaccttgtggacttgggatgggattaaagctcttgcaggcagtactgatgcacctaaacgtcaaagcgcataaataggaagcctgggctcgacacggaagcccaatgaggcactacgtgcgggaagagcgtgcgcgcaaaccgcaggccgggaggcgacctgcgcaccctaattgtgcctggcgccgtgtgaagcgcgcccacgccggcgaaaacctgacacgtggtgggagcacccaaagaggacatccccacgccaagggtgggcctcccgcaccaggcacacgcgccgcagcgcgggcacccgctccatctagacaatac

SEQ ID NO: 605644 - DNA, 721 bp, Homo sapiens
gaagcatggagcacacctggcgctgctgctgagaaatcataacagaagaccggctgtgctgtcccatgactgtatatgtacactaccaaacactcaggacacatgctgtgctccagtgctgtgagggaggaagacctctcttctgacctaatggcgtataggctacaggggtgatcctggactaatgacatcctacgacatagagctagtcacctctgaatacaacgatctaacgggagatcatctgtgtctatgactgctgacatgcgcacccaccacgtgtaaatgtctggtgttatttctaaagacacaggtcatgagatgcgtgcgtgataatatacacacagtacaactatcactcctttctatgagaatcgagagccttatatctgaagtgtgccacgaccctacatatcactatatctccccacaagctatgacccccaatagctctgtgtgctaaacatgaattacaagagtctcatgtattgccaaatcacagctgtgcaagatatcgcgcaataatcagactggcgtgctgggggtgctgatcactatagtaatgtgccttacatatctttcatcacagagttatgcttggactgccccactcctatgaagacccatttgtacctgtaagtgctgaagtggaagaatgtacatgcgccccggtgctgatactcacctctccagaagaggtgccctttcgcatgatttgttg

SEQ ID NO: 605645 - DNA, 294 bp, Homo sapiens
aaaatcatgatatacacaagcttactggctgcagcactgtgtgcaatgacaatacggtatccatctctgagggactgagtggttagactatggtgcgttctcgtagtctacggtaacagggagaaagaagctctttatgtgtggatacaaagggagctccagttagatgctgttaaatggtttgaaactagtgcagaatggtatgtacagtagattgccttgtatgtatgctagaataagaagttgtgtctagatgcatgtggaaacaatgaaggatgaggcaagaaaaaaaaa

SEQ ID NO: 605646 - DNA, 133 bp, Homo sapiens
tctagaggatcctcttgcaggtctctaccttggtttattatgctccttgctctctctagactcagcggttctggctgcagcctgggcagctgggaaggctgggaggacggtggttgccaggctgtcgtgaggc

SEQ ID NO: 605647 - DNA, 443 bp, Homo sapiens
tccagaagtccaaatgagaatttctctggcttaccctctttaacagaaaacttaattgctttagatggtagtggtcttcctgcataagtgtctgcattactttccatttttttccccccctaagccccttttcctccatgttgaccaatatgcgccctaccctctccctttccacctgaagcatgtcaaataactttgagctcaaccaggagtttctttgaccctccatggcttgttcctggaagcttttgcattgcttccccttttttattcagtatttcaattcttaacgcaccaataggggttccagcaggcctaatctcattaggcaataattcatctccttcaggcctagttactgacgatctatcagggagccttgccatttcatcttaaacatattttttgtaccctccccccccccgccgtttccccgcgcgcgg

SEQ ID NO: 605648 - DNA, 387 bp, Homo sapiens
  misc_feature (38)..(38): n is a, c, g, or t
gcaatgctgactggttcaggcacagtcttccccgccgnggcctatgttcagtcttacccctcctacctgagccagatggcgtgcccgtccatccactctaccaccccgctgtcttccacacggggcactgggcttcctgccatcaccgatgtgcctaggcgcatttcaggtgcttcagaactgggccctttttcagaccccaggcagttcccaagcatttcatccctcactgagagccgcttctccaacccacgaatgcactatccagccacctttacttacaccccgccagtcacctcaggcatgtccctcggtatgtccgccaccactcactaccacacctacctgccaccaccataccccggctcttcccaaagccagagtgga

SEQ ID NO: 605649 - DNA, 585 bp, Homo sapiens
ccacccccggttcttgtagtggttttagtatacaagcctgttcagcccgtgttccccctgacctcttctattgaccgtcctgacgttttctcggggaacccacagcattcttcacccggttcaaagtagacttcacaattattcatgcccttgtaaccaatccctttacgcttggcgcgtaatcaattaccgactataccacacgtggcctcactttggtatgccatctcagggtaaagaattctccgacttgaagtagctctcttttatgtaacgcacgcgctggtctagtgaattgcgagcaccccttgcgttttccgatcggctcccgctggtaccccacacgtcttatttgacccgtcccctcgatgttttcgcacgtaatattccggtgtgagtagaagatcccctcttaaggcgtttgtatttaaaagggatatatgggatagatgggtggaacacacacaccgcaccgaatgatattttggtgttagccccaatgtggcatcccctcctctctagatatagtccctatagtgggatcgcctgccaatgctttaggaaaaaaaccaccatagacgagaa

SEQ ID NO: 605650 - DNA, 304 bp, Homo sapiens
  misc_feature (31)..(31): n is a, c, g, or t
  misc_feature (101)..(101): n is a, c, g, or t
  misc_feature (110)..(110): n is a, c, g, or t
  misc_feature (142)..(142): n is a, c, g, or t
  misc_feature (144)..(144): n is a, c, g, or t
  misc_feature (193)..(193): n is a, c, g, or t
  misc_feature (208)..(208): n is a, c, g, or t
  misc_feature (278)..(278): n is a, c, g, or t
catcatgtcttcataaaggactcatatcatnatagtaagccaaggcccaaagggaaaagaaagagaaagaagagggaatccaaatgaatgctcctagacgnctcactcgnacgggcttttccggacatcttccactccttgncncgaagtttggtctgttgaatttccctgtgacagctttggcaggttcaanacaaactctatcttntttgggacttgtatgggctgcactgacttcacatgctgctgcagctccttggtgagctgttctgggtcangggataggaactgcgaggccaggatc

SEQ ID NO: 605651 - DNA, 936 bp, Homo sapiens
gttagccgtcagaacacaggtgtcgtgaaaactacccctagaagccaaaatgggaaaggagaagagactcatatcaaacattgtcgatcatgtggacgacgtagattcggtgcaagtccacacactacgtggccatgctgatcatataaagtgcagttgggcatcgaccgaaaatgaagccagtagagaaaatgtttgagtaatggacggctgctgagatgggaacagggctccttcaagctatgcctgggctctatggataaacggtaaggctgatgcgttgatacgctggttatcagccacttgagtatcatcctgttgtggtaaatattatgaagagccaggcaagatacttaatggtgacttatcagtagattgccccatggagcacaggagacctgtattcaataagagcatgatttaccagggacagtctcaggtctgacctgtgcgtgatcctgatttgattgcttgtcatgcgtgctaggatgacacttatgacatgcttgagctagtcgtccatagaactgggcatagatccgagatgaagcatgcccattcatggcattacagcagctgcggtggtgaaaacaaactaacttgtcgggtgtaaacaaaagtggattccaactgagccagcctacaggcagaacgcagatactgaggaaatcgttaacggaagtcagcagcttacattaagaaaaattgggtacaagcgccgaacacgagtagccattgtgtagccaatgtctggattggaactggtgacgaacatgcgtggagccaagtgctaacatgccttgggattcaaggggatggcacaagtcacaccgtaaaggatggcaatgccagtggaagcacggctgcttgaggctctggactggaattcctagccaacaagttcgtccgagtgacaatgccttgggactgctctca

SEQ ID NO: 605652 - DNA, 167 bp, Homo sapiens
ttcaatcagaaagctaccgtaaatactgtactcctacgtgacttctggaggtcttcagtgaattacaaatccttttgcatatagcatctaaactgaatgtggtacagcaaattcacaatagtgccctgggttaattttttaaaggaaacacagcaaatagtcaactg

SEQ ID NO: 605653 - DNA, 690 bp, Homo sapiens
  misc_feature (177)..(177): n is a, c, g, or t
  misc_feature (690)..(690): n is a, c, g, or t
tgggtccatgtggctataatcatctttcaaaattacccaattgccccagaaaaagtgatgttcccccacttaaaaattattttctccaagaagaggcttcacttgtaacagaaaagagcatgaggtaatcatattttttctcccaagaaagtaagaaatggatggtgcttgaagtgntccaacactcgtggaacacgtgtctcacagtagtgtgggtccttataggcgtggtatatattttaatattacagaggtgaaattttatttctcgtctctcttcaattcatgtgccaaatagggtggcagacttttgtgggttgtggtggaggtataagtgtgcacgagaagtataaatatagtgaaaataaagtggtgaaatatgtgtctcaaaaagtatgaccatgtggcgaggacattccgtgaggcccgtgggtaattacacagtggtcaccgtggtgtatacacgcagagcggccctatttgtgaaatgtgggagacattcaaaagagcgctgtgtctcacacgcagaccctgtgacttgtgactgtggggagggattgggttggggagagacaatttattggcccggagaagagttcccgtggatgaatgtggagggattttcagacagagttttctcacgttgaaaagtgttttcccccccacttagttggaagcacaataaagtgn

SEQ ID NO: 605654 - DNA, 111 bp, Homo sapiens
agtaagagagtggtactgatctgttgctctggtccatgacacatggggcacgaaccatggcctggtggcagacgggctgtcggagccaactccatgagaggaactacccct

SEQ ID NO: 605655 - DNA, 507 bp, Homo sapiens
acaccactgcacgccagcctgggcaacgagagcaaaactccgtctcaaaaaacaaaaaacaaaaagaatcaagtaagtcaaagtcacgctgatgacagccaattttggtgaagcaaggaagtgtcaattcaatcattaacatatatttgacgtttgctgtctcctatgtgccaagcacgatataggctctggggaatcagaaaacaaagagactcacttgttcctcttacagtactcagtccttactgagagaaggacaaaacaaaatgtcctgtctggaatgcagggaaagcagaacttcaggtcaggggatatttccgttgaattgtgtggagttgaagctgaaaatcttaaggaatatatctaaaattcattttgcctttactttatgcatccgtcacctagagatcacgcagcgggcacccacgatcagcttaatcatcactcacttccatcggatcaactggaaatcaagtcagatgagagtggtgagtctcagaggatggc

SEQ ID NO: 605656 - DNA, 367 bp, Homo sapiens
tttttttgagatggagttctgctcttattgctcaggatggagtgcagtggcgcaatctcggctcaccgcaacctccgcctcccaggctcaagcgattctcctgcctcagcctccctagtagctgggattacaggcatgcaccaccatgcccggctaattttttttgtatttttagtagatacagggtttctccatattggtcaggctggtctcgaactcccgacctcaggtgatccgcccacctcggcctcccaaagtgctggcattacaggcgtgacgaccacagcctggctcgatttagtatcctgtaaacgtgtccctaaaactgctcagagagggcatcctaggaagttgctggtgtgcgcag

SEQ ID NO: 605657 - DNA, 742 bp, Homo sapiens
gcgccttcagaaataatcagaatgattcaagggtcaaaccactttcatcccttaaaatatagggactaatatttctttttcttttttttaaaaaaaacatttcttctgtggcttagaaatgtgccagtgtgtcaaaacatttacaccaatttcaccagatttaggacctattaaaaattcaaacaagtttctttttttatttttttttccttggggtaccacgggattttataaaatacacgggcactatttggctttctttggtgtattctcacacttcagttaaaggtggataacaatgtgtaaccggtgatcattatcagactggactggaatgctttctggattcccagggagtgatctagtcctacgtattacacgggtgtaatatctggtgagtgtaaataccgggaactggtcccctggtttaacatgacagttcctcttcggtggtcctaatctgaacggataatagtaggggggtataaatatctccaagtatacccccattttgtcactggtatcccactatggtacccggaaacgaaagatctatgtttgccctttttaaatcccgcaactggtatcggtcgtattcaacaaaagcaacaactctgtcaataacgtgataacaatcaggggatactttgcggtgacaaatcccagtgcctaagaacattggtacgttcccaagtatatttaactgctttactttttacatgcgcacacgttccccaataaa

SEQ ID NO: 605658 - DNA, 369 bp, Homo sapiens
ccccggttcgtcttacgacagcaaagtaaaacaactcaacaatgtgttatcacctgaaaaagagaagcagatgtcagagccactagatcaaaaaaaattaggtcagatcataatgtaagaagattagaaggcctgtgtgctacaagtagtctgcaatggactccaagaattgaacaatgccatctaatataccataaatgtagaatttctccatcttgggaaagtctggattccagattacctgaggaagagactacatatcgaaatgcatgccgtactcaggataactccagtgaaagttacccctaaaattccaagatctctaaagttgactacctagagagaatttaccgtaagacataaccgcgg

SEQ ID NO: 605659 - DNA, 348 bp, Homo sapiens
  misc_feature (315)..(315): n is a, c, g, or t
actcgcggccgcgtcgacgtggcccacgcctgtaatcccaccgctttgggagggtgaggcagtaggatcgcttgagcttgggagtttgagaccagcaacataggaagaccccatctctacaaaaaataaaaaaaattagctgggcatggtggtgcatgcctgtggtcccaggtactcaggaggccgaggtgggagatttgcttgagcccagaaggttgagactacggtgtgctgtgatcgtgcactccatcctgggggacagagtcaggccctgtctcagaataaaaaaaaaatatattactttaagttctctancatgtcggcgcggccgcgaatttattagtagta

SEQ ID NO: 605660 - DNA, 124 bp, Homo sapiens
attttgggtggtgattagtcggttgttgatgacgatatttggaggtggggatctaatagcagggggaaatatcaatgatcacgtactgcggcggtgtaggcctagagattgtgagcggcagggc

SEQ ID NO: 605661 - DNA, 210 bp, Homo sapiens
  misc_feature (129)..(129): n is a, c, g, or t
  misc_feature (142)..(142): n is a, c, g, or t
  misc_feature (151)..(151): n is a, c, g, or t
tgggaaggactttatcgggtgctcctgccccccgagatgacggtcggaaagggccccatccctggagggattttggaccttcactccaggatcaacgccttccaaattaacattcaaaaaggtttaatntgttttttccttntccctgtanccgcccaaggacgttttattatcaatataaggtgatccccctttccccaaaaaaaaaaa

SEQ ID NO: 605662 - DNA, 582 bp, Homo sapiens
  misc_feature (221)..(221): n is a, c, g, or t
  misc_feature (253)..(253): n is a, c, g, or t
  misc_feature (261)..(261): n is a, c, g, or t
  misc_feature (272)..(272): n is a, c, g, or t
  misc_feature (291)..(291): n is a, c, g, or t
  misc_feature (310)..(310): n is a, c, g, or t
  misc_feature (357)..(357): n is a, c, g, or t
  misc_feature (406)..(406): n is a, c, g, or t
gtcagggggaggtcttgttacaacacagatctgtggatctccggggtttgattgtggcaaggatgctgctgatgtcaaaaccacaacgtgggaaccacagaaccactagttggttttcagtgtttcagtgcatacaattcctaatatatctggccaagaaaacttggaagttcttagattgccccaaaggtggcgcatgaaatcaaagcaggagaacagtntcctacgaggtgtagcctgggaaagttggggntgactganggaaaggaggngtgaactccgccctttccnctgctagtgcgcccgaggntatttaaacccaccctggctggcctgtactcagatcttccggagcgnatcagcggccggagcgtttggcggactctgcgtggacttggagctcacngcgtcttgcgacttgaaagcggattcagaggacaggacagaacacttgggcaaaggtgaatctctgtctgtctgtctgtctgtctgtcccattggttggttgatttccatttccttaaggggcccatacctcagaccgcacaacacacaagcacacacaacacacacacaggtaac

SEQ ID NO: 605663 - DNA, 210 bp, Homo sapiens
gactgtaccattctctatttttaaagcatttggattgggagaaaaaacactacccagcggggaaaagaaagatatcagacaaaaacaaaagagctgacaagttgtgctaacgtggcgaggaaaacctgctttctcttgtcacagtccgaagcattataatttcaccacagacttgaggccatctagaccaagtcatacactgaattaaca

SEQ ID NO: 605664 - DNA, 1600 bp, Homo sapiens
gcaagtggaacccaaggcttgtaggtttcagtagactagggggcctgacgtgagcttgagtcgtcccccttgtagccttcctctcttcagagtgcctctgacagaccctgggctgcagcgttgagcgacagagggccctagagatctgctgggatcccctagactcgcatgctgacgaaggtgttaccgtagtcgcgagctgactccccatcccaagggaatttcgaacatcgaggtccacgccgcaagatacatccggcacccgcttctgcaggagaatgagggaacatcgcaagggctgtagaggacagcagctccccgcagggcgcccgagctacccagcggcgccacgacacacactgctcgcgcgtggcttccgcgtggtcagggtctatgctagcgtaggacacagccaccagttcctccctgggcgtacgccacgggcccttgcgcattccatacgtagcgagtgctactccagaagcgcttcgcgcaagataacgaagtgacgcctcatttgcccatccggtgccccagccatggggccccttctgcaaaggtttcatcactgatgctggcccataccggttgcgttacctcaataggcagcgttgattcgcgggcgaagtcgcgcaccatcgggggggcgcagagggcataagaggggcctcaggcataattctccggcggcagatctgggggttctcgttccaccttagtgggttagtcctgggagaacaggaacccagttcgtctggccttcgtggtcgccatccatcggcttgaagggccgccacaccattaccggggaccccacggaggacaccatttccccaaccttccacctttgggtacccatccttggccagagggcctgtggggacaacttcggcgcgtcaggataagagcgcttaaggaaacacagttccggacccagaaccacaaatcccattcacattcaaatctatggttggatagccaacccccctgagggcacggaaggggacccccggggggtggccttagagttaggataggggcacaccacctagtggcgaaagatcggaggctccccccatgtgcggccatttcggacaagacaccaacccggacgcgtcttaaccacagaggacgcgccaccacagggtttgaccataggagggggccccaaagcaagcatgaatgtgagagagaagacggagtcagtcgcatcatgggaaaagatcaccggacaatgtccaacctaaagcgaacactcgggataccctaaaattaggccgctaggtagagcatatggccacagggagaacgcgagatatactcccaggccaaggggagagcacgaaccactataaatgcgcagaatagacagcgaatacaacaacggcaacaattgtcccctctatataccacatggtgcgacgccccaaataatcaaccgtcttctggggaaacccccacaaagagagaaagagcaagacacatttgaagcacactcacctccacagtcgccactagcagttggatacgcgctagacaccaactatacacgagtaacaccatagcgaaaaaagagacgacaacgacatcacgaacagcc

SEQ ID NO: 605665 - DNA, 580 bp, Homo sapiens
agcggccgccttttttggggaaactccatgctgacatacaaagaaaacccagcaggtaggtggtcaggcgcagtggctcacgcctgtaatcccaacacttggggaggctgaggtgggtggatcacttgaggtcaggagttcaggaccagccgggccaacatggtgaaaccccatctctactaagaatacaaaaatgggccgggcatgggggcgggtgccggtagtcccagctactcgggaggcttaggcaggagaatggcttgaacccgggaggcagaggtggcactgagtcaagatcacaccacggctctccagcctgagcaatacagcgagacttagtctcaaaaaaaaagagagttacagttttattgggaaacctggaggtgtccggtttcatggtgctatccaaagacctacaaacctccagagagagcagttagtggctaataagggctctcataatttccatcaagcagtagtttcacagatgggcatccaccttgctcccttcctggagatcaaagtacatactttattattttatattatggtccttaaaataatatggacccttcttcat

SEQ ID NO: 605666 - DNA, 248 bp, Homo sapiens
  misc_feature (44)..(44): n is a, c, g, or t
gatctacagggcttagaaaatagcgacgtggtgctgtagtatancctgtactggatatgccatgatgtatttatttcaccattctcttcttgtggacaatttaatgtttccagttttttttttttttttgtggacaggcgggattaaagtggtcctggttccaagtgctaaccattgttacaactgtgggacaaagcgtttctcttaaagaaataaagttccagtgagtgcaataatttagtggagag

SEQ ID NO: 605667 - DNA, 925 bp, Homo sapiens
agggactattctactataaggcaagggacgcatggtgggcgaatgctacaagaatattttcttcttgatgtgtagcaccttttctcaagaggtttaaattcattagagtacatgaatttaaatatacattaaatgccacgctcatttgtgtacagtgtataagccaacagatgcagttttgagcaagatgtcatgatgctctagagactagcgtgcagtcccataagtgtaatataaaatcatccttcgagcatcccattatgacctctcaagcacatgaagttctaggcctcaagtaatcatgatgcgtacctgtcacgtgcgttcgttggcctgattcggaaattctcatattgtgggatcatgaaaatattgttcatatgcagtctgtgattctttgactcaggatgatattttagagattaattcaggtttgatagtgtttacagtagtatctttttaatgggtaagacagttaacatgtagtatagaaaataacgattggtcttaacttcagtggggtaagtaactggtctgcatctggtcggaaggcgaggccttaagtaagattagcctttctttttatcccaacaagcaagaagactcatccttcaaagttccttccattcctcatggaagagtaatagttcaatgaccagagcgaaaggtcacctacggaagagcagccacatcttcggcactatttatctttagttggatactccccagaatatctagtaaggctacatcaggctaaggggtgtctttccaacattatcagggcatcctagactccagggttacaacactctacaccactctaatggcctagacagctgcagttggctcaagaccacggcccgcccgcacagatcatcggccccggggaacaacccaactcgcggcgggccctcacaacggcagc

SEQ ID NO: 605668 - DNA, 891 bp, Homo sapiens
ctaatcggcccaacgattatattactaccacgtgacatgactttccaaagaaacacataatttgaatcacacaaacacccacagcctaattattagcatcatccctctactatttttttaaccaaatcaagaactaacctatttaggctgttcgccgcaatccttttccttccggatcccctacacaaccccctctcctaatagctaactatccatgactcctacccctcacaatcatggggtaagccaaactgccatctgatctcatgggaaccattatgaatgaagaaaagaattctagcctctctatatctatatctaccctagtcagaatctcctgtgaagttataacattgaaatcatgtcacctagaactaactcatattgtatatcttcgttctgaaatcacgaacttatgccccaccttgggtatcatacgacccgatgagggtcataccagtccagaacgacgcatggaacgtcaggctagatactgctctagtttctatcggaccactgagtaggactctcctatcacctactcatcgtcatctgatttacactcacaataccctagagctcactaaacattctagtattcagtctcactgtccaagaactatcaatactcctgagccaaactacttcaatatagactagcttacgcgagacgctttcataagtagaagatacctcttatacaggagtccacttatgactccctaaagaccgaagtcgaagtccccagcgctgggtcagaacgtacttggcgggaatcactcttaccaacgaggcggtatggtatcaatgcgcctcacacttcgttctgaagtcccctgaaaaggaattagactaaccctttcttggtctattccctattgagggcaagta

SEQ ID NO: 605669 - DNA, 1828 bp, Homo sapiens
  misc_feature (1411)..(1411): n is a, c, g, or t
  misc_feature (1580)..(1580): n is a, c, g, or t
tgtccccggtcgcgtctgccttggagcaagaagacaaagagcaaggggccctagcatctgcgctctgtgtcgcctagggacttcagggacacgtgcctaccatgtctcctggatgcgcacgtatacgctcgactcctaccacgttgatgccacacggcccgtgccggtggtcaccctcagggctgcttactgacatggatgtccgaaccattggttgcctcctggagccgtcctggacgcgtgcgcccagatctcgtatgcgcgcatgccagcgcagggagcgaagcgagtgcgaggtacggccgtgcgcttgcctgcgccgcgcggcgtctgccatgccccagccaattgtcgcggccggcactgcgcttgagccgtttcgtggtcggacccctacccgaacctccgccactcccgaggcggcgtagatgcccgtcgctccccctgtgggcacgaacacccagagtcgcccttggtagcctggtcagtcagttcggtttgttgggccatagcgggacccatttcccgagcgtgagcgcgattcgtaacgcagaccctttgtatcaccccgagcaactcactagacaggctttatgatctcgcaaatcggttcggcgggatctttaagggaagaggggccggccctttaaacccagaggcttagtcccccggtgtgattttggtttgccccatagtgaccaggggacagggcgtactctaaaacgggctggcctagaccgcggcgaaccgccgggccactttgcgaggacttcaacgcagagcgctagccctgaacttcccatcgaaatgtgcaatcgggcggcgcgggaccttgcttggctaaccttaaactttcgcccccttaattctaacaaggccttggcccttgtccccccccaagcgttggtgcttggggccccaagagagttgaagcccccatttttccggtttcggccgccggagggctcgccgcagcggagaaatcttccgaaacgcccgtggtcgaaggaggcctaagtgtgctcaccgaggcgcggcgtctgcacaggtgaaagcgccaagaatgggcttggcccacagagcctttctctggaagacgcgggaggggaaagagccgggggcgcctcccgtttttccggcacgactttgtttttgcaacgcgccccatacgttagttttgcaggggggcccgacgtccgctttttccggccccgagcggcaagatgccgcctttcgcggcctttgccgcgcggtcttgacaccccaccagtggttactccggagccaaccggcatggcgcacggccacaaggtttgcgccacatgggtttcaaccggattgtatgttttccggcgcacctagacatttggccgattggtagagtccgtccggcggcctttaagtttgtacnttcggagaaggcggccccccttttgtaaacatgtgtttgccgactcaaagggccctcacgggggggtttcccctcccctagccgcagtttggttcgtttgcttagaaggccgttctctgttccgcgagagccacaaagggggtacccgtggtgctgcacaggcgttttntgatcgtccccaacctgtgtgtgtggcgtccgcgccaacgacggactgaggcagcgccgtggctcgcacaacgtgtgctcccgtccacgcctgtggcgctcgactgtgtaatcgctcactggcccgctttctcccacacgagctcttgagtgggggagcgcccaccctcaatcacacacgagcgaccagcagtggagtgggattccaccccagtgtgtgagagcactccacaacgaagcagttacatc

SEQ ID NO: 605670 - DNA, 413 bp, Homo sapiens
ggggggggccccccacagggccccccccccccaaacacccccttaggggggggggggggggaacacccccttttgggggggaaaaacccggggcccccccccctttttggggggggaagccttttttttgggaaaaccaaaaaaaagggggggggggggggggggggggggtttttcccggtttttttccccccggggggaaaaagggcaattcccccccccccccttttaaaacgggggtccaaaaaaaattttttggggtcccgggggggggtggggaaaaacccttttttttcccccccgggttgggggggtttttttattttccggggggttccccccttttcttttttttggttttttttaaaaacccaaaaaaattggttttttcaaaaaaaaaggggcccccccga

SEQ ID NO: 605671 - DNA, 547 bp, Homo sapiens
cccggatacggaagagtgtatctactgggaataagtgataccatatatcctccaaattatagaggaagggaaagtaaaagtgagggagggaatagccagaagctttgggtgaaggcaacattgggtcagactgccatggttaagaattaagggaagctggccccagaacagtcctgtggcgattctgttctaattcctgcattccagcagacttgacactgggctcccagacgatccaatgacacaattggctcactggtatggaaccgttttccagctgctctgggtagaggttgacaagggttttgctttaaatggaaaggggaatgataatattgggaccttccctcacatatagttagggctgttgcccacccagaatcagacatttccttggtcctggcatttccttgaaaacagattgtgagttaccctgcatttaacaacaggcattacaaattgatcctgtaaaaggtgagaattttaactaggcacaagctagaagaagatgccagaacagctttcatagtaattaacagtgtgggaa

SEQ ID NO: 605672 - DNA, 1188 bp, Homo sapiens
  misc_feature (556)..(556): n is a, c, g, or t
  misc_feature (559)..(559): n is a, c, g, or t
  misc_feature (844)..(844): n is a, c, g, or t
tgtggtttgttttttccaactttttttaaaccaaacccagtattttctacaaggccttcaaaaaggggtcccccaaaaaaatgaaccttcatttctgggcgggggaaagaaaccagggcttcaaggatcatgactgaagttgcgccatgtcccatcattaatggtcccaacatcaccgggacacaaagctcagacatagagggcttctacccaaatctccctacagaaggtacttcttcaagctcttccacccaccttcttgaggctcagggaaattggagttgggcgtggggggccccctttcttaaatccccagtccagaagactccgcaatctgtctggccgtccgggcgacagcaggctgtccactctcgaaagtttgcccctcccggggactctcgcacgggttccacccttttatctggagaaagtctctggggggccctcccaggggcgagacagggctctggggctcacaggggcgccgcagagtatgttatgccgcccataaagagcgcctgtaccagtctaatgtcgacaatggctcctgaatacncanaggggtgcgctctactctcatatatcctctcccccagcactgtttccgccacgttattcttctacgactacctcgcgggataacggggggacccacccggggggcctccagctctataagggtcttaccttcccgcgggggaacccctaggggcgcctaaaaagcccggccgaaaatatgccagcgggaactcggttggcccaaaggatatacgcagaagtttttttccgcacccatatgttttgcaaggccacccctcagagttgtggcccaaagaccacaggngccccccaaggattaaaggccccccccaagagaaaagaacacaaccacggagtgtggttctctcggttgttctcccccgggggaatcgacaacgacgctcattagtaggggtcttcggatcgccgaggagtgcttttgtgggaacccccctgttattgttgccccacgcgtggtgctgtttgatatggggccccccgatattatccgtactacgcctctaatgttgagaaccgccttgtactcgctaggggggccgccacatggtgttgttcacccaggcgggtcctctccccggaagacgcccttgaggctttcttcttctttacccccggggggcttcccgg

SEQ ID NO: 605673 - DNA, 142 bp, Homo sapiens
ctctgcaggaccccggactgcacgcgctacaatctcagaaggactgtgcgagttccgtgagtcgctcgtgaattctcatctggaaacgatcccgcgtcttagaacccttcaccacgcggagtttttctcgtctgtgattctc

SEQ ID NO: 605674 - DNA, 808 bp, Homo sapiens
  misc_feature (238)..(238): n is a, c, g, or t
  misc_feature (245)..(245): n is a, c, g, or t
  misc_feature (309)..(309): n is a, c, g, or t
ggtcgcagagaaggggcgtggacagaagcgggagcacaggaagcattcgtgcgagatgcgtgggacgtgccggaagaccccagtatgagcaccggagggtgagggcatacgtcatcacatctcatggggaggctacaggtactaccggtcccatcctcgaatcaacaacttcctatttgagaagtcgcaggagtggttgcgaacgcttcctgcacatgcgtcacatgcagagaatcgntgctagngaagatgtgccagaatgtgcaaggcatgctggtgatagtggcgtgggcttatgcgctacctctnatatccgtaagtgctgcggagtcccgcgaacactctcgtagtggcatcatctcatgcatgacctgcgaagggcagatcgccggcgtggctggacacagcgccgtactacgatcgtggttcagtacagcgtgccgctgtatgctggtgcaaggaaggcaatctggtcaagtagcgacaagaagacgggacaaacttccaggtgacagagacctggggccgttatagccgagccactacttacatcaccaagtgatacaagtgcggacttacaagccagctgcgtgaaggccagcctgaggtgagattgagcttatccagggtcttctcagtttgtcctctgagttcaagaacagtcacagtgagagaggaggagaagctggagctggagaagttgttggaggaggtgctatcctgtaagggagagcttgaggaacccggtgctagatccacggtctctgcagccttaattccgagtgaatgggggttggatgtggcgaat

SEQ ID NO: 605675 - DNA, 145 bp, Homo sapiens
agcaggatccccaaggctgaaaggggggaaaggaaggaaagacagacagactagtacaagtcctctagttttatagattaagaaactgaggctcacaaaatagcagtgtgctagcccctatgggctctgggtactagctcactcc

SEQ ID NO: 605676 - DNA, 332 bp, Homo sapiens
  misc_feature (109)..(109): n is a, c, g, or t
tcgagagaaataggagggccgaagtcaggaatgttttcacattgccagacataaaaactttaaggctataagctagcaaatcctgttaccactaagtcttaagaagatntacattatgaatgaggaatgagttaacagagtaaatcaagcttttgtaaatgtacaaaaggaacttgcacatttcgcaaaaagcatttcacttgaacctctgcagaaagaactgattcctcagcagcgtcatgaaagcaaaccagttaatgttgatgaagctacaagattaatggctctgttgttatatactggtgatgcatctaatttctctcggaccaatg

SEQ ID NO: 605677 - DNA, 467 bp, Homo sapiens
aagctccgacccctcataatgtgtgcccaggaggcagaggctgcagtgagcctagatcgtgccaacaaactccagcctgggcaacagagcgagaatccgtctcaaaaaaaaaagaatacaaaaatacaaaaattagtcgggtgttgtgacacatgctggtaattgcagcttcttgagagtctgaggcaggagaatcgctggaacccaggaggtggaggatgcagtgagctgagaccgcaccactggactccagcccgggcaacagagcgagaccctatctcaaaaagtaaattaaaaaaataaactctaaaacaaaaaaataaaaagtacaaagtcctatcttctccatgatgggctcacaatcctgaagtccaaaaaactctgaaatccaagttttttcaaaacctagtgataaaacttgacacggacccattttagtcttaattaccctaatttccatgaataat

SEQ ID NO: 605678 - DNA, 952 bp, Homo sapiens
ggtactcggtggtggccactgtgcagaccagatttcgctcgtactcgtgcgcctcgcttccgtgagcccctcgctccctgggctcagttgctcctgccgtcgctgctcttacgatactccggccgctttatcattccctctcgctgttacctggatgaaagtgcgatgcgtcctaaattccgatgccctgagctagggttctcctcgcggtgataggcctacttctgggaggtagcatggtgcgagcgattagcttaaaacaccctcgtaagatacctggtattaaatggagggtgaggcgaatactcgactgagttaaaagaacaaaaagcggtggatcattgcgtagtctctggccggtgctccgcctctgagaggtgcggcccactctattgtagaagtttttcgattagaatgtttttggcctcggcgataggtggttgtcggtgctgatcgttctgtggccgaggcctcgacgagatattgggaggagattggactcaggtcactttggatatccctagaaggggtttcattcgtttcgctgatgcccccttgggccgttcttccgcagttcgttcgtgaacgtgcctggggctgcgtggttgtcgttctgttgcatgcacttgagtctggactgagtcgcgtgggcttagtagctttattcgactatttcttttaccccgatccttgtcttgggcttgatggaacttttgttgtcgcccccgtttggatgctcagatattttgctcgtggtaggatgcctggcttatgaaactgggcttgtcgtggcgcgggctgcgcgctggtcctgctttgtgtcgtggcgtgggggcttgccttggttgactctcggggcagtgtagggccggtttggggcgggtggggtgccgaagctacctaggttcggtggcccgccggcctttgtgaggggcctatattgccgggatcc

SEQ ID NO: 605679 - DNA, 283 bp, Homo sapiens
tctattgtaattctgttcctttacagattactttcatctaaaaaataaaaaaaatcccaaactgcacaaagtaagttagagtggttaggctggcttgcatactcaaaggaggaagccagaattgcccgtgtccaagcagtgtccaactcagacaatccagaaaagagtctttgggtctacaggagtggtctaccaaccttttcggtatcagggactggttacgtggaacataactttaccatgtttaccaagggatgctgggaggatggaggggatggtttca

SEQ ID NO: 605680 - DNA, 308 bp, Homo sapiens
gttctgactgcgtactaatgaactgatctgtgagcctacttcctaatccgcgcccctccccactaatgtaaatgtctgatgagagataatggatgagtatttgtatgatgaaatcaaacgatttaggaatttggttcctccctccggtttaccaccaggtttggaattggcccttggaaaaggaattggttgggggggaagggaaccttccaacaccctaattgtattttttaagtttcttttgtgaaagattttttaatgcatttttactgtaaaaatacatggaaatgtatgcattccacaaccac

SEQ ID NO: 605681 - DNA, 857 bp, Homo sapiens
cccaggctggtctccaataccgggctcaagcaatccacccgcctggcttaccaagagtgctaggattacaggcatgagcgtaccggcgcccagcccttcttatttcttttcattgctgtattatgctggctacgattccagaacatagaattgatgagaatggacatccctgctctgttctcaaccttagggagaaagcatacaatgttttttctctctctcatacacctacacacaaatatattcaaatgaagacaaactaaagataatttcagacatacctgagacaaacctgagagaatgccttatcagcagacctatactataaaaaatcctaaaagaagtttgaaaatgtaaaaccatttctttttattcctttacttcatatggagatagagtctcactctgacgcccaggctggagtgcaatggcagcagatctccggatcaagggaacctactgactcccaggctcaaggagtactacatgactcagggccatccatatagctgggactacaggatacacagcacaacatgcacggcataataaggcatcacaagaagacacggggattcaccatgaggcaggcagacaagaacacaccgaaaacaaggtgaacacacacgcctaggccccaccaagagcgggatacacagagaaagccaacaaaccggctgaataaaactgaagaaagaaaaagcagacaggacacacaaaaacacagacaaagaaagaaaaacaaaccaaacgaaggacacacgaaacaaactacaaaaagaaaggacagcgcgaaaagggaaacgaaacagaaaagagaagcaaacaagagaagaaggaaaaaaagaaaatgaacg

SEQ ID NO: 605682 - DNA, 142 bp, Homo sapiens
tgatattctgtctcaaaacaacaacaaaaaaaaaaaccacaaagggaaacagaattttccaaaagaagatatttagatggccagtaggcttatgaaaagatgttaaaaatcagtcatcaggaaaatgaaaatttaaccgtaa

SEQ ID NO: 605683 - DNA, 208 bp, Homo sapiens
agaggatcccctcctacgagcgcagcataaagttagccgtatagaggggaactaggttcgtgtaggtcctgaaggtgatgatggggaatttgtttttctgtacaataggcaaacatttgccggtatcctattcacatgtgtagaacaccttgaagacttgtaagcaagtgcgaatcatgaataggccctggttctctttaaaaaatgt

SEQ ID NO: 605684 - DNA, 131 bp, Homo sapiens
tggggttaaaaatttgcttcaaattaacaaaccccaaaaatgaccctcaaaaatgaaatgtattctgttttactcacgcaaaagagaattatatcctcattttttttttgctcttcttaaaagaaatgtgt

SEQ ID NO: 605685 - DNA, 683 bp, Homo sapiens
  misc_feature (470)..(470): n is a, c, g, or t
  misc_feature (538)..(538): n is a, c, g, or t
  misc_feature (669)..(669): n is a, c, g, or t
gtgatgttcaggtgttgattttaggtctttccagctttctgatatgggcagttagtgctataaatttccctcttaacactgctttagctgtgtcccacagattctggtacatagtgtctttgttctcattggtttcaaagaatttatttatttctgctttaattttgttatttacccagtagtcattcaggatcaggttgttcagtttccacatagctgtgcggtttgagtgaattacttaatcctgagttctaatttgattacactgtgggctgagaatgtttgttataatttctgttattttgcatttgctgaggagtgttttacttccaattttgcggttgattttagaataagtgctatgtggtactaagaagaatgtatattctgttgattttaggtggagatttttgtagatatctattaggtctgcttggtccagagctgagttcaagtcctgaatatccctngttaatttctgtcttggtgatctgtctaatattgacagtggggtgttaaagtcttccactattattgngtgggagtctgcttttgtcattctctaagaacttgctttatgaatcttggtgctattgcatcgcgggatatatattaaggattggtagcttttctcggtgctgatcccttacctttattgccctttctggncttttgtctttgtg

SEQ ID NO: 605686 - DNA, 444 bp, Homo sapiens
  misc_feature (11)..(11): n is a, c, g, or t
aatttttccanattcctaacaccatgaaatgaaatctgtctttgattttctagcagcatacctgggaaattgggaaccagaatgaacttgccccttcgcacaagggcaacctggtccctgagtcccagacaagcattccatggcacagcgctcccctgctgtctttacccagttgtgatgtgacagctctgtcctcctggggagactgattgggactgatgtcctggtgggagggtgtcctggtgggactgatgtcctggtgggactgatgtcctggtgggagggtgtcctggtgggactgatgtcctggtgggactgatgtcctggtgggagggtgtcctttgggagcacctttctttttactctaactcttcccccaagctccaagctgctgtcagtccaagctgtcagtatcaaaatctctcccttttttgaaattaaaac

SEQ ID NO: 605687 - DNA, 212 bp, Homo sapiens
ttgaactcatcgggctagggggatcacggcatgtctaatatcaaaagaactttgagaggcagtcccttattggcaaggtacttccttagggaacaaagcattgatggaaccaatcaagatgaagggttctcatagtccgagatttacttttagtaagaagtgaaaagactgtgcagctgctgtttatctctttccttccaatggctcatggg

SEQ ID NO: 605688 - DNA, 539 bp, Homo sapiens
  misc_feature (67)..(67): n is a, c, g, or t
  misc_feature (102)..(102): n is a, c, g, or t
  misc_feature (142)..(142): n is a, c, g, or t
  misc_feature (154)..(154): n is a, c, g, or t
  misc_feature (166)..(166): n is a, c, g, or t
  misc_feature (168)..(168): n is a, c, g, or t
  misc_feature (173)..(173): n is a, c, g, or t
  misc_feature (179)..(179): n is a, c, g, or t
  misc_feature (186)..(186): n is a, c, g, or t
  misc_feature (194)..(194): n is a, c, g, or t
  misc_feature (208)..(208): n is a, c, g, or t
  misc_feature (233)..(233): n is a, c, g, or t
  misc_feature (245)..(247): n is a, c, g, or t
  misc_feature (259)..(259): n is a, c, g, or t
  misc_feature (269)..(269): n is a, c, g, or t
  misc_feature (271)..(271): n is a, c, g, or t
  misc_feature (284)..(284): n is a, c, g, or t
  misc_feature (306)..(306): n is a, c, g, or t
  misc_feature (317)..(317): n is a, c, g, or t
  misc_feature (330)..(330): n is a, c, g, or t
  misc_feature (335)..(335): n is a, c, g, or t
  misc_feature (459)..(459): n is a, c, g, or t
  misc_feature (464)..(464): n is a, c, g, or t
  misc_feature (510)..(510): n is a, c, g, or t
ttcccactagagtacacgaagtttgtcggcccttgccttgtgctagagctgagtaagaaaaatcacnaagaatattatttttggaatttagaattgaatttnccagaaatgcaagcactgctacctaactaaagaccttggntttggaaacatnttaccccttggnanctctncacgantttaganttggcagnatcaaagacccaangcaagcaatatgaaacagagaaaanaagttggttggnnngctgtcctccangcagtgattnangatccaggctgtnatcatcttcatcactcatgttnagagttacccnagaggtcatctcnatttnatccagataaatgagtatgcaaggaacgtttttataggtcattttggagatcaaagatgggtaggaaaagatgctgctactataaaactatcctgtttatcagtacagaaaaatcaaattggtntacangattataaaaaaacttaaacctattttacgagctaccaaattaaangcagaagcaaagaaaacagcaataggcat

SEQ ID NO: 605689 - DNA, 254 bp, Homo sapiens
  misc_feature (78)..(78): n is a, c, g, or t
  misc_feature (149)..(149): n is a, c, g, or t
agtcgctagatgctagctggcagttgtatgtcactgaaaagtctagcgagattttggattccacccaaagcctctcancactcaatggctatctttccagtctacaagtacatgttccacccagcatttacagtcttggacatgttatntctccacttactgctttaagttggttttagtcactggataagtattataatagagctacttagctgtggttttaatacccttctgtaaggtttaggcctcccggg

SEQ ID NO: 605690 - DNA, 1224 bp, Homo sapiens
  misc_feature (296)..(296): n is a, c, g, or t
cttgtggtcgtatctcccagttcgaccgtctagaccatcccagaagatctatagaagagtattacatactggagagatcagtacgcagattctgtgtggaagggaacagaaggcaagcattcgttgggataggaagtaacaagacgggattgacctggagttccagaagaggccgggtgctcaaactcggtgagcacaggaatctgcatacagaaggagaacgttcggacacatagaccgagagctaccaagcatggatgcagaacggacagtacaacactgaggaggggcctccntccgtgtagaagaagtacagacttggtcacgaagagcctaggaacacaattcttgtagaatcgctaggtctcccagggaagatgtggcggtaggtcggcatcgggccagaggaagcccacccattcgagggatccgggtgaagtgacagaccgaggataaggaacaaagcaggagagactccgtggcaaacgggatgatgggctggaatgtatcgcagctgaacgcgaccgtcatgccccacgtcgcgcataggaagaaggggccgtggtgcaacgaccaccaactgatgtgaatcctgtgagtgaggcgttgggcatcgaatagacatggcaggtatcaaacgctgcacagactatccctggcaatgcaaagtgtaagaagcgcatgtgcgtaggtttgcagggactggggcatctgtaggttgaccatggggcagcatagccaggctgctgtgtcacactgccctgtccaaggtcacaacctggttggcattgcacaatttcgtgagaagggcaagtcagttgcgaacacttttggcgacccgtaagaattccggccagggggcatacactggcgttgcagctaactgtaaaccgggaaccttagttgcccgagttcaaagtcggaacacgtctggtgggggacctggggcaaattaacacctaggacacctcattttgctcccacttggttgggactcgctcacgcgcgcggccacttgcgacaaccctcttgcctccctaccaaccaaaaatcgttggatgcgaagcggcaccccccgggggaacttgagcactgcacacagatcccctgtactatggggtctaccaccctcgcgtggaattagctacgcacagatagtttagccgcgctgggtcgtgtatactgccgcactgaccccaactaatttccttgggaaaacatcag

SEQ ID NO: 605691 - DNA, 121 bp, Homo sapiens
cacgaggcctgcctcaatctctcaaatatttggggattacaggcacctgccaccatgcccaggtaattttctattttctaagtagagacagggttttaccatgtggtcgaggctggcctca

SEQ ID NO: 605692 - DNA, 540 bp, Homo sapiens
gacagggacctgtgcgccagccaatgacttcaacctgacgcagatccaaagcgctgcggaaagcatgaagggactcgggactgacgaagacacaatcatactgatatcatcacgcaccagagcaatgtccagctggaagaagatccggcagaccttcaagtctacactttggccgggacttaatgactgacctgaagtctgagatctctggagaccctgacaaggctgattctggggctcatgatgccaacggcccattacaatgccaagcagttgaagaaggccatggagggagccggcacagaatgacaaaggctcttattgaaatcctggccctcgaaccaatgctgaaatccgggccatcaatgaggccctataaggaggactatcacaagtccctggaggatagctctgaagctcagacacatctggccacttcaggaggatcctcatttctctggccacggggcatcgtgcacggagggaaggaaacaactggaccagtgcacgggaagatgcccaggtggttgctgagctcat

SEQ ID NO: 605693 - DNA, 111 bp, Homo sapiens
gcagcattttcccatggaaaggcaggtgctactgtagctggcctgggccccgtggaccccgagaggcagatgtggatgctcctggagccaacttctgtaaaaggctcctcg

SEQ ID NO: 605694 - DNA, 783 bp, Homo sapiens
  misc_feature (3)..(3): n is a, c, g, or t
  misc_feature (92)..(92): n is a, c, g, or t
  misc_feature (94)..(94): n is a, c, g, or t
  misc_feature (172)..(172): n is a, c, g, or t
  misc_feature (184)..(184): n is a, c, g, or t
  misc_feature (186)..(186): n is a, c, g, or t
  misc_feature (202)..(202): n is a, c, g, or t
  misc_feature (303)..(304): n is a, c, g, or t
  misc_feature (315)..(315): n is a, c, g, or t
  misc_feature (338)..(338): n is a, c, g, or t
  misc_feature (375)..(375): n is a, c, g, or t
  misc_feature (382)..(382): n is a, c, g, or t
  misc_feature (388)..(388): n is a, c, g, or t
  misc_feature (393)..(394): n is a, c, g, or t
  misc_feature (401)..(401): n is a, c, g, or t
  misc_feature (404)..(404): n is a, c, g, or t
  misc_feature (414)..(414): n is a, c, g, or t
  misc_feature (432)..(432): n is a, c, g, or t
  misc_feature (436)..(436): n is a, c, g, or t
  misc_feature (450)..(450): n is a, c, g, or t
  misc_feature (460)..(460): n is a, c, g, or t
  misc_feature (469)..(469): n is a, c, g, or t
  misc_feature (485)..(485): n is a, c, g, or t
  misc_feature (501)..(501): n is a, c, g, or t
  misc_feature (507)..(508): n is a, c, g, or t
  misc_feature (518)..(518): n is a, c, g, or t
  misc_feature (534)..(534): n is a, c, g, or t
  misc_feature (552)..(552): n is a, c, g, or t
  misc_feature (658)..(658): n is a, c, g, or t
  misc_feature (668)..(669): n is a, c, g, or t
  misc_feature (677)..(677): n is a, c, g, or t
  misc_feature (694)..(694): n is a, c, g, or t
  misc_feature (705)..(706): n is a, c, g, or t
  misc_feature (780)..(780): n is a, c, g, or t
tanggtagtatataaagtgctcaagtatctgaatgtaaccgatgagtgatgagaagtgcgcgtgcgcgtgaaggagagagagagggggggantnctgccgtgggtggttgaagaaaaatgcttgcgcgttggggagatgaacgtggcctgagcgggggctgacgaggcaccngggttgtggtgntnagagaggggggtgtgnttgggtgctcccccagattctctgcaggcactgtcttgattgaaataccaccggctggggggtgccatgccctgggtctcttcccagagttggtggtttgnnaagggtgggtntttgcttgcctctgcggagagtnccagcacctgggcaaagctccttcggagctgaaggtngtttttnggggtnacgtnnttgagtncgntcagtaagtncagcacctgcaaattttnttgngaattaccaacatnaagttgtggnaggaggggntgagtggtcaccagtnaatgctgcagggggtntaaganntgctgccatncaccctggagggagangggggtgagggggaggtngtgcgtggtagtgttcagggcgtggggaatgttctgtattgctccttgaagcgtgtggccactgcctcgaaggggctgagcatctcgatctgggcatccaggacanctgccagccnngggttccnctgagagaggagaagcntgcgctttagnncgtgggcctctttctgtagcttctccttgtggttagagattattaataaattgttttgtggggttgttggaaantga

SEQ ID NO: 605695 - DNA, 674 bp, Homo sapiens
aagagctcggagggctcggggctcacatggttctcaggcgtcaacaaggtgcatgtgtggtctcggtcactctgtatgtccgaaggggtgtgtaccagtcaagtgactgcacgtcgtgagatacggtaccacagcccacaaagaatctctagaaccaagtttagataatattattctccctagtagctctctctctctataccaagcactcaaggtcaagaatatgataaatatataggtccacccctctctctcaagacattggagggtgaacatctgggcacgcatctgacatttcttcctccattcctataacaataaaagcaagcacaaatctgcttcatatgagtaaccaagtctcatacactacaaaataacccatgcacactgtttctgggaagggatatggccagcccaggagagttgggccacatgatgggggactttcactctgccacttacagcacccctgtactgggaagggttggccagtgccacagtgcactctgagatgaaagggtgtttcttccagtggcctttggcctgtcaccagcctcttccgcggtggcagccagtacaagagtaatgacaatgtgactggcacagagatagtttctcccaggcacacgagagctcctgtaagccccgtagttccattgtgcaaagggcctcag

SEQ ID NO: 605696 - DNA, 314 bp, Homo sapiens
  misc_feature (159)..(159): n is a, c, g, or t
  misc_feature (172)..(172): n is a, c, g, or t
  misc_feature (190)..(190): n is a, c, g, or t
  misc_feature (202)..(202): n is a, c, g, or t
  misc_feature (232)..(232): n is a, c, g, or t
  misc_feature (246)..(246): n is a, c, g, or t
  misc_feature (290)..(290): n is a, c, g, or t
  misc_feature (304)..(304): n is a, c, g, or t
atactcgctgtatccttgaactcctgagctcaggtgatcctcctgcctcagcctcccaagtagctaggaccataggcatgtgccacaatgcctggctaattttgaatttttttttttcataaacagggtcttgctatgttggccatgctgggttcaaantcctgggcctcangctatatttcctcctcancctaccaaagtnttgggggttacagggtgtgaggccaccatngccctgggcacttngggagttgttttaagttttatctttgattgattggggtttttcntttggggaaaaagnatttaacttg

SEQ ID NO: 605697 - DNA, 747 bp, Homo sapiens
tatatctatatatatatgtatgtatgtatgtattttagtatttatgtctttgcactaaaatcacaatgcaagccattgctttgggaggtcaaacagttattttacaaagatagtgaaaatcggatggagatgttcttaagcgtggattaattaagatgagtttatccaaattttagaagctgtaattgtctcttaggttttatttctcagtgtttaagcgggaactgaaagaggattagcatctagggtactggctcaaagggacatgccctatgtttgcacatttatataaataaatatctgtaagccccaactctcaaggtgactatatttggagatacagcctttatggaagtaattaaggttaaatgaggtactgaggatggggccctgatttaacatacgtgtcattcataagacaggacatcttgctgtctgaaagccagaagcaagccctcaccagaacccaacatattggcaccgctgatctcaaacttccagtctcccgagaactgtgagaaacaaaaatggctttgttggcacccattatggtagcccaagcttgactaatacagactggagaggagatcaccgtttcatatgatccagtttaaggtgcttgggatcagccagtagcagacagtcagcctcatcttccctcccttaagtttgccagcacaaacaaaactgttattagtctgaaatgtctggaccataaaccggttaaattttagtcccgcaacactt

SEQ ID NO: 605698 - DNA, 354 bp, Homo sapiens
tctcacagcacatgctggccacctggggcctggcagagaggtcaggccctgaaactctatctgggcctggggctaggggacatcagaggttctttgagggactgcctctgccacactctgacgtaaaacccctttccttttctattccttctggcctttcctctctcctttttcccttcccttccacttcctcttcctttgggggaccccccgcttaggaggcttcttaaaaccattttgccttgcctgcccttccctgaggaaggaggggaagctgcagcttgggaaggaccctggggcctagactctgtaacatcactttccatgccccaaacttattaaactttgcgggtt

SEQ ID NO: 605699 - DNA, 511 bp, Homo sapiens
aaattcttaaagttgggggaagcggccatggttaaaagggttccgggcaagccaaggtgtgtggagagttttccaaccaaccccccttggggtggctttctggttcgtaatataaaacaaacagttggggggggggtcataaaaacagtggccaaaaaggtgggtggagtgggcaaggtccccaagtttgcccaaaaaggtcagaggggtaaatgaatattatccctaaacccggcccccccctttttaataagggggggaagaggggtttaaaaacggtttgtttcaatgggccctttaagtttgggggtaaaagccgggttaataaaaccaaggcttggtaaacccttcaaaaggaaaggagaatgttttggggcccccttgggttttttttttggggggggggggttttaagttataggtttttaaaaacgggattttttaagggaaacaacttgcccaaaaatttgtcccaaaattttgggcccccttaaaaaagttaaatgggata

SEQ ID NO: 605700 - DNA, 912 bp, Homo sapiens
tcccgagtagctggaattacaggcatgcactaccacacctggctaattttgtatttttagtagagacggggtttcatcatgtgcccaggctggtctcgaactcctgacttcaggtgatctgcctgcctcggctcccaaagtgctgggattacaggcatgagccaccgcgctggccatagatctcctaatttttattttattttattttatttatttatttattttattgagacagagtcttgctctgtcacccaggctgagtacagggtgcgatctcggatcactgcaagctcagcctccgtggttcaagtgattctcttgcctctgcctcccgagtagctgggattacaggcacgcgccaccacgcccagctaatttgttctgatttttagtagagacaggttatcaccgatattggccaggctggtctggaactcctgacctcaggagatccaacccacttggctcccaaagtgctggaattacaggcatgagccaccgtgcccagccttcctacatttctttttcaaatagcatatattaaggtccactcttgtgtgtacattctatgggtttgacaaatgtgtaatgtcatgtatctactattaccgtattattcaggaaataggtcgaccaaccccttaaaaagttgcgcaatacttccatatgactaaccctacctaaccaccccatccggaaacgcaaggctgggggggggcctacggaagggcactggtcacacccttcgagtagaacccaaaggcactatgccccgaaagcgctacagacgccggaggcgggcacaacagacgctcccgggtaagaccacaaggcccgcacagagggcacccaagggatacaatatatgagacgcacggagcccaatagcacgccgggggggaacccaaaatg

SEQ ID NO: 605701 - DNA, 130 bp, Homo sapiens
ggtttgtaagtcaacgattaaatgacctacgtgatctgagtacagagcggagtaatccaggtcggatctatctacttcaaattcctcccatgtacgaaaggacaatgagaaataaggcctactatcacaa

SEQ ID NO: 605702 - DNA, 1368 bp, Homo sapiens
aaaggaattaggaattgacatatcataattctgacgagaaagccagacatttaaagcacactgttgatgaactccagaaacgagtgaaccagtctgagaatacagtacctccaccagcatcctccctccacgagacacattcacccgtccaccgtcacgaggtccatagtccgagtcccataagatgatgcagtgactaccggaaacagatcgccatccccgaggggtaaagatggtgcataagagaagagaaaggagagaaaaaaaagacaagaaaacaaaacagaaacgaaacgtacagaagaacactacaagacgggcaaacgaccaagcagcaacaggacaagactgcggcacatcgcacctacaaagaccggcgcacgctacccggcaacgaacacccgagagcaagccagcacaaggacagcccacgagaaaccacaaaggccagggaacaacacgcaacaagcggacagagaaacaggaagaaagcaggaaatgcaacgccacaccaggactacacaagcgcggacaccacaaatacaacaaccccaacaatataaaacagaaagacaaaaaacataacaccaggcaaccatagaaacaacaaagacgacacccgtgaagcatggaagaacaacgcaccggaaggcgcactcagccgcacaaaggcgaacatgcggcaaagcagactcaggcatgaggctccaaccaaactggggaagcaagaagaacgacggcaaaacgaacccaagaagccaggacgagaagaacgcgaacacagaacaacgcaaggcggaaaacaaaaacacaacggacaatgcaaaaaggaaacaccatactgaacggaagacaaaaacaagacccacaggacaaccccacggaaaccacgagcacagggacaaaggagaccaacacagaaacgaaaaggggaaacccacgcactcaacagacaacaaaacgaagaccaccaaagaacgacaccgacaggaagagaaaagaaaacggaaaaagggggacaacgagaagcaaaaacgacacgaggcagaaaaggcagaagcagacaaggccacagaagcccaagaagagagacaagaaaaaagcatgacagaccaaaaggacaacaaccgagagaacaaaaaacgaaagacacaaaagaaaagacgagaacacaaggacaggcaacggaagaagcaaagagggcagagaggagacgaagcggggaaagcaacaaacgagaacaagaggcaggagagagagaggcacggagggaagagaaagaaagcacaggcgacagagagcagccgccggacgccaagcgcggcaggccacacaacaccacacggggagaagcaagaaagggcgacg

SEQ ID NO: 605703 - DNA, 405 bp, Homo sapiens
aagcagtggtatcaacgcagagtggccattacgccgggggggggttaaaaaaaaaaaaattaaaaaaaaaaaaaaaaaaaaaaaaaaaaaattttggggccccccggcccccaaaaattttaaaacacatgtcgtgggggcgccgaggggccccagagaggtagaggggcacatggctgtccacagagtcggttccccagggaaaatccgcggggcaggacactaggggtggtggtttcctccacccaataaaagaaaacggcgggggcggaacacaaccggaggtcgtctcggaacaaaaatcacaggatagggagctccggagaggcgcatcagcgaggattcctactacaccgaggggagcccaaggagaaggcgaaataaaaaatagcccgccgggggaac

SEQ ID NO: 605704 - DNA, 702 bp, Homo sapiens
tcttttccacatctcattgtcactgacatttaatggtactgtatattacttaatttattgaagattattatttatgtcttattaggacactatggttataaactgtgtttaagcctacaatcattgattttttttggttatgtcacaatcagtatattttcttgggggttacctctctgaatattatgtaaacaatccaaagaaatgatggtattaagatttgtgaataaatttttagaaatctgatgggcatatggagatatttaaggttgaatgttggccctaggtaggctatgtgtacaaaagaattgttctagctgaatgtgcaaagatgactttaaaatgttgagggatctgggatgctcgtaattgtcagccaaattatgagaaaatatcggtcagcacgtggtttaatatttaaatcaaagctgatacgataatagtttatatatactgacaaaattctttggagagggaaatgaataatatcataagatatcagaatctcttacattacgttaatgttaagtagagaatagtcatagtgttaaacacgtcacgttttaaaaaaatgttgttaactgtcgtgcaacctgattgtggttgaagttcaggtcgaaatgtttattgaagaaggtgaacagtgtttgcttcacaaaaaaaaattggggggcgaattaaatggggcaaaaaagtgaaacc

SEQ ID NO: 605705 - DNA, 182 bp, Homo sapiens
actgacgggtccccgtgcagcagtgtccaatcctattggacgatggcgtcgttatctgtgctctcgcgtccgtatagaaccacgcggtgtgtgggcagatgcagaacgagagcgtgcacagcaatgttaagtggaggcgcatcctttcctgagaaagaaaataaataattcatcatagatga

SEQ ID NO: 605706 - DNA, 196 bp, Homo sapiens
cagaagaactggctccctaaatgtagcagagaatgtttttacaactgggtctcctatttcacctcggtggggatggtaggtcacttcaaaagaagagctccatgcctgaggtaatatagccttcttctgagctaatggagaaatgaggctcaaatattttgatgtcccatttaaaccttgcacccacatcgcctgt

SEQ ID NO: 605707 - DNA, 356 bp, Homo sapiens
tgtatgtgtctgatatccttcatgaccttggtatcagccttatcacttttcacgtttctccgggacatcgtgactagacttgtaccttcttgagcatcaagtcttagtatgcaatctcagtcatagacaacccactagtgttaggtggtgccctctgatggttacaaagaattgcaacagctcgattggcacggttataagaaaggatcttcgctgggatgttctcatccggggctgtgagttcttctagctgctgctgtagcgtgatggaggcattgtatgtatggaataccttggctgtcaagctctccatgagatcctggagatgcttattcagaataccagtattgagtcta

SEQ ID NO: 605708 - DNA, 850 bp, Homo sapiens
tttcattccctcccagcacctgcctaccttgtcggcacgccccactggtgaatgttactgcggcgccctccacaatgtaatacgtctcgctccctccctgtcagtggaggtgcctacgcccccctatgtctattctgcaccagcgatcgctcacgcctgttcattactgctgtttgtcatcccccctcgcgggtttcctcgttagaagattgttattagcacccaaataagaagctttgctgcgccaggtcatctatgcctagttctgtcttccctgttcgccccttatctgcaagctgggtttcattatctcatgcacattgctctgtctggtatctaaaagagagcaaagcaccagtaccacagacttacaagaggacctacaagcaggacctagtaataatgaatgtactcacttcagccctggccaagcagatacctctcaataatacttaatgttataataacacagctcactgtcaagctatttctacagttctatactagtccttttcaatatgatatcctagcacatagtaaagataatgtactaccgagcgtaaacgagtggaaccttctccagcaaagccagatgacaagttttcctctccagtgagaaatgggctccaagttcttatcttctctgccatcagcatggctgaaggcgggagagcggtgtgctgttagggtaaaatccagggacccttccacacaggaggtactctggggttccacttcaggagggtgccagataattcagatcactctagcccacggctttttggcaaaaaacaaccctcaccctccgtaactagtcatcttccttgtccattatcccacgtcccttcca

SEQ ID NO: 605709 - DNA, 204 bp, Homo sapiens
ctgctcggctacttgcgggcctttcacggtcagtgcgcgtgttgccgccttccacgtacggccagccgtcgcgccattcaatgcggcgatgccgtctcgccccagcggcagtagcccgtcccggaggccagcagcgcacccggcaggcgcagcgggcggctggtgaggtaggccatgtaccattcacccgtatgcgtctgcagc

SEQ ID NO: 605710 - DNA, 183 bp, Homo sapiens
ttcgtgctactatgatgtgaatacaacctgcagctgttcggcgatgctctacagctacgaaaccgtcaagtacaacaccggtgccggctacaactactggggcacggatatcagcatgggtccgttcttcgatcagtccagcggtcgctatctgggcctgcagcgcgtgttcgcccccgaaga

SEQ ID NO: 605711 - DNA, 926 bp, Homo sapiens
atcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagtttttggtatttaaaccattgcattgcagtagcatcattttaaaaaatgcacctttttatttatttattttggctagggagtttatccctttttcgaattatttttaagaagatgccaatataattttgtaagaaggcagtaacctttcatcatgatcataggcagttgaaaatttttacaccttttttttcacatttacataaatatatgcttgccacagtactgtagccacaattgcacaatatattttcttaaaaatacagcagttacctcattggactattttctgggtttataaacctggcttctcgcagacatttctctggccagtaaatgttaccctgggaatgacctgttcccttatatgatcctacagcggaagggtcacttactgggagcctcttatttagatgttttcagcgtgggttggaatctagcaaacatggttaatgtcgcaaaacactctggatatgcgtataacacgcctacacacgacgccacaggactagaagacc

SEQ ID NO: 605712 - DNA, 275 bp, Homo sapiens
gtcccctttacgtcgggtgcagcgcgatcggcgcgcgtctcgatcagcagcgccagcccgggcgacgccgacggcgcccacaggcgaaagcgcgtgcggccgtcgggcagcggcagggcgccgaaggtgaagggttcgggccaggcggtcatggcgtttgtccggcgatgtgggtggcgctgagcagcaccaggctgtggccctggaccgccgcctcgttcgcgccgaccggcgccgccgcgaccggcgcggaggtgtccagctcgcggatccag

SEQ ID NO: 605713 - DNA, 109 bp, Homo sapiens
cttcgatagcttcactatcctcatctaggacgtgagtctccaggaagtcacagacattggggtccgtgcgggcagaacctcaggccatgcaagatcccccaagggcctg

SEQ ID NO: 605714 - DNA, 370 bp, Homo sapiens
  misc_feature (221)..(221): n is a, c, g, or t
ggtaaaatagcgagggtggttatcccaggctctccttggttctaggcagctgtcttctccttctgtcttcacagggcctttccgggtgaatcctcatcctaatcccctcttcttacagtcttactggttagggcccaccccccgggacctcatttaaccttaacttcctctttaaagaccatgtctccaaatacagtcacatttggaggtatttggggtgnggacttgcacataagaattttgaagggttgtaattcagcccaaagaagtgggtaaccacctactttgcctgaggttaaaactggtgccttggacatcagtcctgtaaactctgtatctcccttgaacttgaattcagatggaggcagtg

SEQ ID NO: 605715 - DNA, 95 bp, Homo sapiens
acggccgtgtattactgtgcgagactatcaattactatggttcggggagttatcaacccatactggttcgacccctggggccagggaaccctggt

SEQ ID NO: 605716 - DNA, 158 bp, Homo sapiens
gctctagaggatcctgaggtctcttcctcaacccagagcaaattgagcagaaggttctcaagagatgtcccatatacccactacccctacacactcacagcctcccccatgatcaacaccatccaccagagtgacacatttgctattgaggaagagga

SEQ ID NO: 605717 - DNA, 213 bp, Homo sapiens
cacgagggtgaccttatacatgttggggtttgctcgtaaatacgagatcaggaaaaaaggttggtttcacaaaccaagagggtcagcagtggacgcctagattttgtcacggactccacatagctgagcttttgcgcagactctgagaattagcactgcatgtcttcacagaacataacacgatttaagtttcactttaaaaattgcacatga

SEQ ID NO: 605718 - DNA, 274 bp, Homo sapiens
ccatgacgggcctacatgggtagctctgttgcaaagaagcaagctttgggattcattgattgtatctagttttgtttggtataggcatggaagatccccagtgaattggctcaggtgagagggcagggctaagggtggggcgggggatcagggattagcctaagagagtcttcctaaaggcacctccgtagaaccggcataaagctccgtcaggtctaggtcgtagttcagtatcgtccagtggctcatggtacacgttctcaaccactcaggg

SEQ ID NO: 605719 - DNA, 374 bp, Homo sapiens
gggggcccctagcacgaattgaggcctctctgtcagtgcagatgtcccgtagggtccgggccctgtttggagccatgaacttttgggccatcatcatggacaaccttgtgagcctgaacagcctcaaattcacagaggtggttgcccggggcctgttactcacagggttcccccagaccacgctgtccatcctgtttgtcccctactggggggtccagctggtaaaggggggggagcgacccttggccctggggggggggcagaagcggggcaaagagaagccggggtagggggggggggggagggggatgggctctggtcagctatttttgggccagaggggggctggccgatagaataaaaggcttttttcc

SEQ ID NO: 605720 - DNA, 258 bp, Homo sapiens
gaatgtctcgaccttgttcatgtccttcctgaagcagtagagcagccctgtagttcttgagcagtgtgtcatggttatgcgagttagtagtcaaacgtgctgtaggtctgctataggatctgcccagtccggcgtatgcgatataccagcctccccatcagggttggcattccttcctctaggtcctttaggatgtgcatagtcatcgcttgtcgaggagtcctacaccagtgttgtaggagaaaaatactcctaagg

SEQ ID NO: 605721 - DNA, 534 bp, Homo sapiens
  misc_feature (335)..(335): n is a, c, g, or t
gaggcaagcaagtgctgtgaaataacatcatcttagtccctggtgtgtggggtttgtttttttttttaatatttgtggagaaataaaacttcatataaaattgccaaaaaaaaaaaaaaaaaaaaaaaaaaaaaattttgtgggcgcggcccggcggccccggaaaaactttttaaaaccctcgcggtgtggggcgcggcggggccccatagtggagtataagggacgactgctgcgcaatacgacgtgtctcaccaagaggagaagaccccggggcgacagatagacgaaacaagcggcgcgtggtgattctctctcccccacaaaatataaanaaaaaaagcgcgccccggggcgaggagaaaccacccagcagccggcgtgttctcgtgagaaacacaacaactctcgccaggagatagaggggacgctctagaaagcgagcgcgcaaatacagcgggggggtcctcaataacaacaccgggagcggctccaaagcgaagaggcgcccaatattacaaaaaataacgcccg

SEQ ID NO: 605722 - DNA, 1307 bp, Homo sapiens
  misc_feature (238)..(238): n is a, c, g, or t
  misc_feature (242)..(242): n is a, c, g, or t
gtctctctctcctcccggcgcgcaagatgccgaagggaagagaaggtgagagggtaagagtagatggtcggtcatcgcggatccctaggctgttcgatgtaaagaggtcaggagtgctacagacaagttaggtgaaatgccccgtgtgtgtgagacgaaaggggtctatggaaatttagtatgcgcaatatgggacgagggcacgatcgcgtacgctccaaatagaggatcatcatcnaacncagcggtagtgcgcagaacatgaggcccccggatctatatatcataggttgcgccacgcggggccgaggagaagccccaatccctcgtagtagaggccgggccttgcaaaaggtggcccagtcccgtgacggaagtgtaaagcgcacgatatgcaacgcacaaaggacacccatgggaacccggcccaaaagaccaggcgttacgtccaaggcgtggcgcttacacggcctgggaccgcgaacagaggctaccacgaagcccaaggacgcacccaaaaagtcaacgaacgtaaagacaagccaggaaggaacctgtggttacggggcacccgggagcccgacagacacggaacacgcggcctggccctgggcggccaacaacaccgcggagcggcaccgatccacccaatagcgcacaacggaacggaagcccaagcactttgtatcccgtagtccggaacgccaatggggacggctctaaagccatcacgggttcagcgcgagcgccataggcgcctggccgcacgcaacagccaaaacagtagaaaaagcgccttccaaggacatcggcggatgggcgtcggaactaccggcacccaaaccggaaaccgggatggcgaacttccccccaaatcccggacagacctggagcccgggcccccagccactcagcgccccttgggcccccctgggacgggatcaggtcaaacacaccctcgcgggccggcttcccaccctgcgcacccagccgacaccgactccaaaactgcggaaacaaaacggccaacacgacacctcgcgccaaacacgggtcccccaagagctcaccccaacaacaggcggacaacgggaaacccccggaggccaccaacagcagggggggactccggcgcccctctcccacacccaccaccggcggcggagcaaacaccccgcccgcacaaagcgcaccaccacaagcaggcacgccccccatgggaggcccaaaaaacgaccctggcggcggatggcaaccacccgcgccatatccaccgccgccaccacaccagcatcacccaacggcaa

SEQ ID NO: 605723 - DNA, 571 bp, Homo sapiens
ggtttgttacttttgatttccgcccccagcttttgccagggttaacccggcctcctcctgtgggccgccgcgaaaccccctggtttttatatcgagggggccccatctgcccgaaccatattggctgttggggaccataaacaccgcggggttgccccgtctcctatgccccatgaaccatttgggcgccgcgcttttgccctggacgcggtgtccccagccgtccttgtgagtacgccacctattcaatactctctccccttgggttgccatgtcggccctgttaccccacccggcaggcacacccatggtggttgatatttaatgctccacgagcacccgtcggctttggtgaagcgttccggctccataggccccgctgttgtgccgtggcctctggaggcccccctccccccgtgcgcgtgctctttttaacccacgattagggcaagcaggggtccctcaatagtcatcacccctttgctgtgcccgcctcccgtgaaggcccctttttcacctggggggggggaagggattcttttttcccaaaaaaaaatccaccccgtccaca

SEQ ID NO: 605724 - DNA, 445 bp, Homo sapiens
  misc_feature (4)..(4): n is a, c, g, or t
  misc_feature (31)..(31): n is a, c, g, or t
  misc_feature (109)..(109): n is a, c, g, or t
  misc_feature (135)..(135): n is a, c, g, or t
  misc_feature (428)..(428): n is a, c, g, or t
  misc_feature (431)..(432): n is a, c, g, or t
  misc_feature (435)..(436): n is a, c, g, or t
tctnccctccccaataggcccccccggaaangggaagggaaaataccccccgggtttctccccctgggaattcccgtggttaaggtcccaagatgccaccaggaaaagnccctccctgagggccccttttccccngggaatttttatccatcccaagtcaggaaagatattggacagatccctcttggccccagcctttggagggggagtctgttgggggggtgtttttctgcctgggattccttcccaccttgggaaggtttgtaggtttctggttaacagcagagttttcacttccagtggctggagcctgtgattcaaagaagtcacaagtcacagagacaaacttttcccagtgtgttcgagtcagagaacctttgcaaagaccaacaggcacagagtcggaggactgaagtgaacagctgctntcnnaanntttagtaca

SEQ ID NO: 605725 - DNA, 546 bp, Homo sapiens
  misc_feature (53)..(53): n is a, c, g, or t
  misc_feature (161)..(161): n is a, c, g, or t
  misc_feature (170)..(170): n is a, c, g, or t
  misc_feature (172)..(172): n is a, c, g, or t
  misc_feature (176)..(176): n is a, c, g, or t
  misc_feature (223)..(223): n is a, c, g, or t
  misc_feature (225)..(225): n is a, c, g, or t
  misc_feature (227)..(227): n is a, c, g, or t
  misc_feature (233)..(233): n is a, c, g, or t
  misc_feature (250)..(250): n is a, c, g, or t
  misc_feature (260)..(260): n is a, c, g, or t
  misc_feature (264)..(264): n is a, c, g, or t
  misc_feature (276)..(277): n is a, c, g, or t
  misc_feature (286)..(287): n is a, c, g, or t
  misc_feature (289)..(290): n is a, c, g, or t
  misc_feature (299)..(299): n is a, c, g, or t
  misc_feature (318)..(318): n is a, c, g, or t
  misc_feature (324)..(324): n is a, c, g, or t
  misc_feature (332)..(334): n is a, c, g, or t
  misc_feature (338)..(338): n is a, c, g, or t
  misc_feature (340)..(340): n is a, c, g, or t
  misc_feature (351)..(351): n is a, c, g, or t
  misc_feature (358)..(358): n is a, c, g, or t
  misc_feature (360)..(360): n is a, c, g, or t
  misc_feature (367)..(367): n is a, c, g, or t
  misc_feature (371)..(372): n is a, c, g, or t
  misc_feature (374)..(377): n is a, c, g, or t
  misc_feature (391)..(392): n is a, c, g, or t
  misc_feature (454)..(454): n is a, c, g, or t
  misc_feature (466)..(466): n is a, c, g, or t
  misc_feature (473)..(473): n is a, c, g, or t
  misc_feature (484)..(484): n is a, c, g, or t
  misc_feature (528)..(528): n is a, c, g, or t
cactggggagctctgggttcttgcccagaacaaggggctgagaacatccagtnaggatgcaaggccaccacaggctgaggggactggcactggggatatggcagggtttcgccttcaagcacagccaagacaccctcctttgcccttggagtctcctcctnaagagcatngntgtnttccccatggagaaaatgaggtctccagaggtttcctgccttgcccnananccaccnaccccctcagaatctanaccccccctntctnttcctcacctcnnccaggatcnngnnacacccccnttttgcagagtcagccccncccccncctcagcnnncccnancacactcctanaacctantnactaaantctnnannnnataaattctatcannttctccaactgctcctccaggcgctgttcaactccatggttttcgatgacccagttaaagtncccgaagttgtncaggccncattctgactnagcatcgtccacccctggcgtgaacacccagccccgctgctgtnggctctgctccaacgcta

SEQ ID NO: 605726 - DNA, 214 bp, Homo sapiens
acttttttttaaaaacttagttttagactatgtggtaaaaatgggaagggtgtaaactatgttgtaaaaataggaaatggggcttaaaaaaaaacccttaaattgtttccgggttttgtcagggtttaaaaaacccatgttcttctttggttttaaaaacatgatttaaattttgtttaaaattttaaaaaaaacccccggggtttttccttta

SEQ ID NO: 605727 - DNA, 224 bp, Homo sapiens
agtgagcgagatcgtgcactgtacccagctgggggacaagagcgagacttcatctcaaaaaaaaaaaaaaatcagttggggcttgttgttgcacttctattagtcccagctatgttgggaggctgaaacaggaagatggttttaccccaggatttcaaatttacaggaagttaggatcacacaattgcactccagcctgggttgacagcatgagacagtgtctc

SEQ ID NO: 605728 - DNA, 1243 bp, Homo sapiens
tatcttcttctacttcaaatggcacagactaccacccaaacatctggttggcaagtatgatactcagtgttcactggcaggcagtcgcgaattgcagcatgggcgcattggccaggaagctctggcgccatgcagcaacacggcgcatcgttcttcattcattggcaatacaccacaacacacatcgacacgtgactatggcgacgttaccccacatatcttgccacacaggtacagcggattcacagcatctaccacgccccagttctagtgcccaggtgctcgaacacctcacgctctcccgttgcgctacaatcacacgcacaccactactttctacacggcacgcaaaaccgcaatattcatgatactctcccagcctaccgtcaaacacgctgcgaccccagctcccatcaggcccaacagcctgacagaaacgcttccacaaagcgtcacagcgtcaaccatgccacagggcacactacccacgagtccttcttccttcctcacattcagctcgacaggcgacagcgcagcacagcaaaaagtgcgaggtagggccccagcttatctggcaattgccctcatgccttccctttatacaaatcggaccgtggccagcgcgccaaattcaccacaaccccgaaccgcaccagacacccccagcccgccaatcgcgcccgccaacggcacaacgacgttcaacccccccgcccaacacggcaggagcacgcacccaagcacaccccccagcaccagcctccacccaccggaacactaccacaaagctatacacaacaccacgactaacgatccccaccacgccaaacctacactccaaactaccctaccacctaaccccacccccccgccacaccacctttacattcgctctacgggagcacaaacaacattaattatagcataataaatcccactactacatcacacgcagcgaaagacgcgacatcccctccactgcggaccaaccgcgacgtgcctcctgggatacagcacaaaaactaacaatgggaaacacgaacacaccggatatgaccaacgacaacacgacaacacgccagcgaggccacaccaacaacggcaactaccgcccgcaatacggaaaacgccattggacagcaatgccaaccaggccctgtcgacgcagacgaacacacagcgacaactcacaaccacaaagagccgcacgacacacgaatcatgcgacgcccacaacgccaca

SEQ ID NO: 605729 - DNA, 891 bp, Homo sapiens
gcggctgcctccttgtgtccgctgcatccaggacttcctcacgcggtggctggaggctgcgcatctggggctttaaacatacaaagggattggcaggactgcggcggcggcggcgggggggggctggggcgccgggggccggaccatgagccgctgagccgggaaaccccaggccacgagccagcggaccctcggagcgcaccctgcgccgcggacacgctccaaccaggcgggaggcggcaacgcaccgagccaggacccccgtggcgacgcgcggggccaggagcgctaagatggaggcgctaatggcccggggcgcgctcacgggtccctgagggcgctctgtctcctgggtgcctgctgagcacgccgcgcgcgccgtcgccattatcaagttccccggcgatgtcgccccaaaatggacaagagttgggagtgcaataactgaacaccttctatggctgcaccaggaagagctgcaactgtttgtggtgtcaggacacatttaaagaagatgcaccaagttcttggtgactgccccagacaggtgatcttgaccagaataccatcgataactatgcggaacgctacgctgtgtgagacccagatgtggccaattacaattcttccctcgcaaggcccccggttggacaagacacagatttacttacaggatcatggctaccacaacctgatctggaccagagacagtggctgatgctttgtcgtgctatccaagtctgaaggatgtgacccccaatgcggtttatcgacttcctgatgcgcacggcacacttcatgatcacttggcgccgggagcttggctgctggatccccttgaggtagcaggatctggtaggcttcgcccgcgagggtcgggagatcccatta

SEQ ID NO: 605730 - DNA, 1116 bp, Homo sapiens
gatccagtgtcctgctatcacgcgtgcggggcctgggcgtggcgatcgcgaagaacatcatccttgtgggggtcgagggtgttaccctacgtgaccaggctgctgttcgcagctggagctgatctttcctcgcagcttctacctgcgggaggaggacatcggggaaaacaccgtggccggagagttatcacaggcactccgtgctacgccttgggtctcgaaacagtctcatgatgcctgtcgattgcactcagcaatgcgaccctggtcgtatgagggatctatagcgtataatggtttatccaaggtggtgtgtagcctaccaccaactggcgcaactctgggaggaccatactgtcgaggtggggtcgagtgtctgttcatcaaaacgtgggaattaattgctggtgtgtggcaggacaacgctgggggctgtttatggagccacgtgtctttctggttggatctttcgcgagatggacaattagaatccatccaacagagtttcccagattggtgcgaaggcaagacctacttctacgttggcataatagaggttctcttactggggtataacgcgaaaggtaccacaattgcacactggttgattggtttacccgtgactcgtgggattgaaggcaccggatgactggagttggagggaggctagtgcgcacttgtgctctcgctttattgcaaggaatacgttacaaggtcccttggtttgaaacctcccaggcgggagaaatcgaggtccattggcagatcgcaaagtcgcgtggggtccattagtacgcgtaaaagcgatcttgtgacactcttccaattatcgtcgcagactaacagtgcgtggcagtgcattttgtcgcgatcacgtgcaaaaagataccctgaacgaagattcatcgttcaccagtcctttggatggccgtctgcatggagagtaaacctgaacgtttgtgggatgaacggcacgttcgaccaaagttgtcataggccctggcctagcatgctagaattgtttttccagggtccctgtagccagtttctggtggctcagtaattggccggttcacctcggtcccgtgaatggtgaggatgcaggaataaactggt

SEQ ID NO: 605731 - DNA, 990 bp, Homo sapiens
gagcactgcctggctcccacgtgcctcctggatctcagtagtggcgctgtcctgtggttcgttacagtcctgagcctcctacctctgctggaagtccgcagatcgcccattgtgtgtccaatcctattagccgggtgcccaatcaggcaagcgaccacccgtggacctcaagagttcacgtgagacaacgctggttctggagtagtcgtcactcggacctttcgtacacaccgaggagatacacactaaggtcggctgtcaggagagtcctaaggcaatccttcttttaccttctagcctccacaagcaaacgatcacgtaggacgaccgtatctttctcagaagaagctaccaagatcaccagactagggaacacagggtgacagttcttattcatcagtccatcctatccctgatatgttcgctatgcggcgaatacaaatggagaatcctaatcctctccaggaattaccgggtcgtgagcaaggggccaatacgtatgccagtattttccgacgtgcaaactttaggcatggcaattcactttccacggtggtatccaactccaaatggaacacgtaaccaatagcatttcgaccttttctatggaatcggttcggaagagcaggcattctggatgggcaaaacgagaacatccgtgggggacgggcgaccttcggttacctggagtcctttaactttggttcataggtaaccttaattggcccctaaaggaaagtagctgggaagcccaagaatcgcgatacgcctacacatttgggggagtccaggcaaggttgtcccttaacggggcaatatggcttccttcctgtggaaccttgggcattcttggcccagccccagtttacccacttggatggaaggttccaaaaggcaagtgggcttcccgattgggttaaacgcaactctgggcagtttgcggcggtcgcgtctagagacacgcggtcaagtcaacaggattgggttcga

SEQ ID NO: 605732 - DNA, 170 bp, Homo sapiens
gtgtgattcactccattccatacgtcctatataggcctactaaccaccacaccactgtccaaaaggcctctggtacggggttattcctatttattacctgcagaggttttttctccgcaggattttcctgagccgttaccacttcagcctagcccaacgcccaaataagg

SEQ ID NO: 605733 - DNA, 129 bp, Homo sapiens
ctccagtcaaattctcttctttaaggacacggtcaattagattagggctcactctgaacacctcattttaacataatcgccggtcatctcgtgaccggcgatatagctagtgactgacggatggactac

SEQ ID NO: 605734 - DNA, 274 bp, Homo sapiens
gcgccaacccctcgcacccccgcgcccccagtccctcgcgtcccggcgccgtcggcccggagcgtgcccggaagtctcggttccgccgccggcgctcgccatgtggtgaagcccaggggccgccctgggacctcggcccgttcctccggacccgagatggcctgcctgcacgggctgccgcgtccaagatgctgctgctgcccagcccgcaggcacaccacacaaccactcggatccatcctctaccgggagtgccagtggagccgcaaaccga

SEQ ID NO: 605735 - DNA, 459 bp, Homo sapiens
  misc_feature (12)..(12): n is a, c, g, or t
taaaaagcttanatctgaaaaatatttagaagatatatacaagtgtctatttgttagatagtgaaaactagtaaggttttggagtgaaaaagtttagagatggttacaccttttttttctaaagttgcttaaggtttttggaattgcttccctttccccacaagaacaaagcactggccgggtaaggtggctcatgcctgtaatcccagcactttgggaagctgaggcaggtggatcacgaggtcaggagatcgagaccatcctggccaacatggtgaaaccccatctcaactaaaaaaatacaaaaattagctgggcgtggtggtgtgctcccgtagtcccaagctacttgggaggctgaggcaaaagaatcacttgaacccgggaggtggaggcggcagtgagccaatatcacgccactgcatacaagcctgggggacagagtgagactctgtctca

SEQ ID NO: 605736 - DNA, 339 bp, Homo sapiens
tatttccacagggggatccttctcaaaataatgttcatggaggcataaaatacataaaacaaattatttttaagtaattatcaaagtattaaaaacaaatttataatacaaatgcctataaattacatctattggtaactctaacaactgccataattttgaagtaatgctgaatttagatggattttaagatatttcaatatttgtaatataatttttactaggacagtcccaggtattttatactgttgtgttttgttgcctacattcataattgaaggaaattctaaatttcagctagggggtaatgtttttcccatccaagttcacaaattttaa

SEQ ID NO: 605737 - DNA, 492 bp, Homo sapiens
tcccccacactgggttcgagttcgggagacacctagtttatagtttttttggtatagctcttccccaaactcaactgcggtcgttaagctaatgagagaccacccggcgaggaggatgagaagagcctgaattctgctgagatgtagactaaacgattaccagccattattccagaggtcacaagatttgcaaccccccaataactcctacagataacatcactattacagaaactaagattggccttttgagataaggtttgaggtttgtgcatttctgacaaccaacggctccacctggacccgccaaactccctctggccccacccagaagtgaactcggcagacaaggaccatttttcacacccctatgattgcatccccaaccagttagcagcacccctaccctagccccctgcccaccaaattatcattacctctgaattctcagggagatcaagttgagtaataataaaactccagtctctcatt

SEQ ID NO: 605738 - DNA, 263 bp, Homo sapiens
gtcgacgcaggcatagggagatattgcctgtgaagaaacggctgatgaatcagcatttccacttgttgagcttaacggataactgtgcctattaacggagtccaaaatcaaggctttttgagtcctagatttagatgcctttgaattttttcttcttaaactctgaaagcattcttctactgttgagtattctgattcagaagcagtgtctatcaaaaaattgtttttgtcctctcgaggtatccaaatatcttccaccttgt

SEQ ID NO: 605739 - DNA, 422 bp, Homo sapiens
cctccctccctcccttcctcttaaagggacaaagcaaatgtgcctctgaaaccagggtttgtttcccccacgggaatcctgcaagctggaggcagggggggtaggacagggcagaactaggagaccagcctggcctgttagacagcagggccagcggagtgggggcagagaggtgctaagtgtccccagagctaatgggcagctgcagggctgtgacagagccactcactagctgtcaaccttgggccagtgacttctctctaagcctcagtgtcctcatctttaagatgagggtaagggtagttagttctttccccccaggatatcattatcagaatgaaataagataacagatgtgaagtgcctggcacagcactcaaaagcagcagaggcttaatgaatgttcccacccacttcccctg

SEQ ID NO: 605740 - DNA, 161 bp, Homo sapiens
gtcgacgggcgatctggctgcgacatctgtcaccccattgatcgccagggttgattcggctgatctggctggctaggcgggtgtccccttcctccctcaccgctccatgtgcgtccctcccgaagctgcgcgctcggtcgaagaggacgaccatccccgat

SEQ ID NO: 605741 - DNA, 275 bp, Homo sapiens
gtcgactcttgacgcgactccccgtagagacttcgagctggagaacggtcctgctgtttggtgctgtctagttcacgctgcttggcagccactcctcgaaaaggatcttgtacagagtagaacgccacagtcattgaaaagcacagactcatggccacgaatcattataagattcaggaaaaggaaaaacttcaagaagaacaagaatcgtcacgaccccagaaagttcgctaagtaaccacgttctccctgatcaaatatcactctcctactta

SEQ ID NO: 605742 - DNA, 89 bp, Homo sapiens
catggatttgctggtgcagtacaactaggcttaatagggacatgccactgcactccagcctgggcaacaaaacgagacttcgtctcaaa

SEQ ID NO: 605743 - DNA, 130 bp, Homo sapiens
acccgtgtccatcccccttcctgtgtgagtgtgtgtgtgtgtgtgcgtgtgtgtgtgagacagggactcactctgtcacccaggttggagtgcagtggcgccatcaccactcagtgcaacctctacctcc

SEQ ID NO: 605744 - DNA, 1034 bp, Homo sapiens
agaaatgaggaaactatttgagaaatatggaataggccgggcgaagttcttattcatcaggatacaaaggatctggcgtttatccgctttggaaatcccgaggaccctagcggagattgccaaagtggagctggacaatgatgccactccgtgggagaaagcaggctggcgtgtgcgcttcgccgtgcgcatacgtgcatcccttacagttcgaaaccttcctcagtatgtgtccagagcgaactgctggacagagagcctttgcatgtgtgtggcccaggtagagagggctgtcagtctatctgtggatgatcgaggcaaggtcctctaggaagaaaggcattgttgagttcctcagggaagccagcatgctcggaaagctctggactgatgccgtgagaggcttgccttcccatggcgtaaccgacatttccctcgtcctgtgactgtggagccctatggaccaggttatatgatgaagagggacttccagataagcgggttctaaatagccagcaatgtcacatggaacgatgagcacgccgacccagatttgcacagtctgggctcctttgagtatgactatgccatgcgctggaaggcactcatttgagatggagaagcagcagcaggatcaagtgggccgcaaggatcgaggaggctcgtgagaagctggagatggagatggaagctgcgcgatgagcaccaggtcatggtaaatgagacaggacctgatggaggggcccagaagaaacttcggacgatgcagagcggcaatccagagggtgcacaaaggaaggccactgggagccagggaggcggaaactgacagcgcccgaaaagaatgcggtggacgagacatgctggggccgcgcacggtccggacctccgcccgaaaacgggcacctgggcacgctggcgggcggcgtaacaagaacccctccgtgcggccacctcgagcacaaaggcgaagtgaccacacgctgcgccgcggagcggccaccgacgaccaaaatgtaacaccaatcccggac

SEQ ID NO: 605745 - DNA, 396 bp, Homo sapiens
gaaataagtagtaatatataccttagattgttatttaaatttttgttcctctgtgaactaatagaacacgaagtaattgttcacaattactgttgtttaactgccatatatgggtaaattagggaaaattgtgcttaatatttagaccttttgagatggatcgaatatttgaattttggtgtacgtgtatactgggtagtcacaagtcttataaacactttagaggaaagatggatttcagtctgtatttttaaacatcatttattttaaatctggtgctgtttagaaagaaatttaactgcattctgctgctcttctttagaagcatttctgcgttactggtgttatactgtcatgcatagagtcttctttcttgacgttcctttttgtggcggg

SEQ ID NO: 605746 - DNA, 183 bp, Homo sapiens
tgaacgtttgcaaaggtttattaactgtcattgactgatacatgggaatcggatgaggggagtccatgctgaacaggaaacagagtgaggggggcttgaccagttcgcatggcaatggataaaagcagatgggagatgcttatactggttcttggtgtgagtgtgtgcgtgtgtggtgagtgt

SEQ ID NO: 605747 - DNA, 164 bp, Homo sapiens
aatcagattttgaatttctttttaaaaaaaagtatagattatattttttatgcagtcaattgccttttaaatgtaacgttggttttttttggcctaaaaaaatgcctcattgatttgtattaaattcaacccccattcaaaagggaattaaacattttcatgta

SEQ ID NO: 605748 - DNA, 853 bp, Homo sapiens
tggtccgcagcaagatggggacgagaaggacagggaagggcctgggatacaacagtgatgagataaggcctcggacttaactgatcgaacatctaatggaacggtggcaagacagagaccatcacacaatgacgggtgtaatgggcgaccaccaggagataatcgtagcagaatttcacaaaaaattcaaaagaggcattctgaagtctttgaccatgagtcgacataatacaagtggctgtgagacagtctcactctattgcccaggacaggagccgcagtgggcagtgatctcggcttcagtgaaagcctacaacctcctgggttcaacgcggattctcatgcctacagcctcccaagtaccaggacatactgagataccagaggacggattgcaaaaatctatcacggtcattaggatgctgtcctaacgagaagggagagctgcatgatctgatggcagagatacagaccaatttccagaagatgtcttcttcgacgctttggcggtaagatcagctaaactgtgggttcttaactaaggaccgagctggatcaagtatatgcatggacgaagaaggagttcgctcagatcgcccagggttgactttgcagtggcgtgatactggctcggtgaaacctccacctcccggttcacgagattctcctggcttagcttctgagacagctgggattcacgcgctcaaccaccccggcatggggtaattctggcatttagaaacacagggttcacatgttctgtggctctgtatcgaaatcggacacaagtgactatcgctaagctccaagttggataaagataacaacgacacgtgtctaactagaccccggt

SEQ ID NO: 605749 - DNA, 1399 bp, Homo sapiens
  misc_feature (48)..(48): n is a, c, g, or t
  misc_feature (545)..(545): n is a, c, g, or t
cacgaggaatttacccaccaaaatgaagattttttccaaaatcagtangcttcacaagttcatttggccttagactgtgtattggtccttaaatgtttcttaatgcctgcctcctcctacccttttctacctcctttttaaaaaaataaataaataaataaatgttaggagagaaacattaggatttgtctgtgatagacatgctgcagcttccactagacatgaattcccaacacaagcatagaaagaggtattctcgttctaaagagacatgtaaatgttttctgggttgaatatttgattttcaatcacattggcactgtccaagttcttggcatattatagttcagttatgattttcatggtagagttacaatacttgtttttgccctaaagaagtcattcacatggtttacaaatgttaaggcaatgagataggacagtgagtaggaaatccagggatagcagattctagtccttaattctcagctaacattttgggtaatactcacagaaaagttacttttctgtgaagtgtgtgcatntgtgcatgtatgtgtgcgtttgcatgcatgtgtgtgtgtgtgtgtgttggttagagttggaggcagggatgggaaggaagaaggggaaaggtatgagtgttcaattaggtcagtttctggttttggaagaacaactcaaatgtatgacctactgatgacatacagtgagtgtagtcatccttgggtaggaacaccagtacattttccagaagtagctagtacaaatgattgtataataatattgattgtaaattgccatactcttggttgctaaaggtagattaaaattcaatttgtgtatatgtaaaataatcttatatataattcttaaatagaaagtaattgattttacatagttcttcctgaactttttggaactgaaattctgccaaacattatcaaaataagcttccttagcttaccaagtattcacaaggaaattctcttgtacctctttttggttggctaggggaagcatgctgtgaagcagctattcctacttatagttgtctttggcttggctttgacttctgccatggtttggacaggatgccatggtaggtgtgggaagtatcagggcctcccatcttcccatactcaccttccagagctgttgatggaaatgagctcttgggggagcctagagattcttttttcagtggtcctgtaagcattcaaggttgagcttcagaaagatgagggaggagtcatagctacagtaaagaaaagaatagattttatctgttgcctgtatacagtctcatagaattctttatttttcataattgtgcattttaattgatagtcatatggtattcttgttaataacaggcaaagcattaatcagtaccatt

SEQ ID NO: 605750 - DNA, 388 bp, Homo sapiens
  misc_feature (210)..(210): n is a, c, g, or t
  misc_feature (295)..(295): n is a, c, g, or t
gattgcaggcatgaaccactgcgcccagtcgagtggtaatattttgaaaggaaacctttttctgagcaggtctcaaaagagaggttaaaatactgagtagaccatgctgtaaacagatgtgctgttattcgggctttgatattccatttataaagcacaggcagagctcagagtagatttaatgtaactctgaagggcactaggattttnagaatggtaaataagcattggcttcaacttaaattcaaatctgcattggcttgtaataagagactagcttgttactgaagctttnaagccagttgttttctcctatctagctaggaaagtcctagatggtatctacttccaataaaaggctgttctggccaggcgcggtggctcacgc

SEQ ID NO: 605751 - DNA, 291 bp, Homo sapiens
ttacagtgactggtggttacgtgtcccttccccattcagtgacttgtcctctcggcttggtgtaaaccattcttgggaggacactttggccattgaactctttctccagctgattagtgtctaaggattgatccattattgttgcccttttccttgattattacactgcctggaggatagcagagaagcctgtctgtacttcatttcaaaaagccaaaattagagagttatcagtcctagagaattcctctattggttcagattcctctagagttcgaccgggttaccgag

SEQ ID NO: 605752 - DNA, 214 bp, Homo sapiens
  misc_feature (70)..(71): n is a, c, g, or t
  misc_feature (214)..(214): n is a, c, g, or t
gcccaaacccactccaccttactaccagacaaccttagccaaaccatttacccaaataaagtataggccnnagaaattgaaaccctgcgcaatagatatagtaccccaacggctaaagatgaaaaattattaacctagcataatatagctaggacttaccccatatacctactgcataatgaattaactggaatacctccgcaaggagaccaan

SEQ ID NO: 605753 - DNA, 957 bp, Homo sapiens
  misc_feature (376)..(376): n is a, c, g, or t
gatgcgagatcgcccgagtgttatgatgaggcgggtgacagtcatggcgtctctgctaaggcctctctcgcatcaatcatcctgtggccatgacagacgagggaacaccccttgtctctggtagataggagtggcagatgcgaccatgcaggcagcgagcacgcagcagtgtagcacgctcattcctagtgtccatgaatgcggaatcctggaccctagaggactcctgccgctgaacagaccatgaggagcctctgtgcatggctgtacggaactctactcgccgtttcgttgcacccaatgtaaccctactcaggcttaaagaacttgaattttgattgtgggcgttgaatcatatatccttgttagcctttgnaatgggaaccattccatttttgataacagcacactaggtccccaaggaaggatcagacgggcagagcatgtgacctttgaatctgaatttcaccacggggacaacgcagccggtgtgtggacagtattaaaaggacttggtgcgtggaccacaataactggtccagagagaacaacagttgacatgctttcgcgagggctttagcgatggcgtaaattgctcattcaagggggccgccctaaaatcagctaccctggtagagacaaggtaccatccgttgcttttttggagagacacatctgatcgcaaaaacgttatcaatttggtccttggtcgtggacttctacatttaattcatggcagcgaggcaccatatcgggtggcacgaggactgcaagataagcaccagacccccttgtagcgactttttcccttgggacagccatcccgatttcctccaacttatcgcccgagacgtcctccaccggcttcttgaattattgcgatcaagttcaacttggaaattccctccgggtgaaatttgggtaataacaaggaccattgctggacactcaaacatt

SEQ ID NO: 605754 - DNA, 236 bp, Homo sapiens
tcggtatactgcactgacacaatacccaaacatcagaattcagaagggcatcaaaccaggggctttatcaggctgaaaaatatcctagacttcagcacagaataccaatcaaatcattgcacattcctttgttcaaaacacaaagatgttttgtctttacatgggagtttttttacagcttttcttcttttttaaaaacaacaaacacaagacaagttaagggccaaacgggcaaa

SEQ ID NO: 605755 - DNA, 411 bp, Homo sapiens
tatctcggtgccgttgttgaccgtagttcccgtcgtgtggtctttatggcctccaccgaagcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgaactgttccgcagcctgattctgcgcgaaatgcgtgaccagtcgcaggaaagatccgcgttgatgacaggtt

SEQ ID NO: 605756 - DNA, 106 bp, Homo sapiens
gccggagaagacgcacgcagctgactttgtcttcttccgcacgacttttacagaggtctccagagccttctttttcctgtccaaaatggcaaccttttagggaaaa

SEQ ID NO: 605757 - DNA, 334 bp, Homo sapiens
  misc_feature (51)..(51): n is a, c, g, or t
aggtatccataagaagagtaattttgtaaaccatacagtcacatggaagtnatacagtacgctcctgaatgaatgactagtcttagtatcaatgaagatactaagatggaaattgaaaaatttcatgaaacaaatggtaatgaagacacaatataccaaaacttatgatatgccaaaaacagtacaaaggaagagattcatagctgtaagtgcctaccatccaaacagaagaaaaacttcaaataaaccatacatcttaaagaactagtaaagtaagaacaaactaaacccaaaataagaaaagaaataataaagatcatagcagaaataaaat

SEQ ID NO: 605758 - DNA, 926 bp, Homo sapiens
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaacaaaggacaaaaaaaacaaacacaaaaacaaaaacaaaaaactggttggggcgccgcgctgggcccccaaaaaaagcttcttaaacccacttcgtgtggggcgcgcgcgcgggcgccccagttatggtaatgtgacacacctgtcgctcaaacggcgttggtccccacagagaaaccccccggcgcccactgcggcacagcgggtcggtggtttcttccccccaaaaaaaaaaaaaccgcgccggggcgggaacacccgtgtgtttttgggaacaactccagagaggtggggtggcgagaggcccaagagagggctgctctcatacaccagagggggggtctccaagaggcaagcccccggatctattaagaaaattacgccccgccgcggggggagaaggagacaccacagaatacgacacacgaacaataacacacgagacaaaaacacacgagaaaaccaagaatgaggaaaccacacacacaacgcagcgcgcaccaccaccaagaacaaaagacccacacaaagccagaccgacaggaagagacaacacaccgcgacacgaacccacgaccacccgaaacaacaaccacacacaacagcacagaacacacaaacaccaaacagaaaaaggcgagccacatctcgcaacgagacagaacgaaaaatcgcgacgacccgcgacagcagcggacaggacaaacagcgagaataaaacaacacatagacacatcacagatcacgagacgcagctcaaacacaagacacgacaccaccaaacacatc

SEQ ID NO: 605759 - DNA, 374 bp, Homo sapiens
  misc_feature (26)..(26): n is a, c, g, or t
  misc_feature (63)..(63): n is a, c, g, or t
  misc_feature (112)..(112): n is a, c, g, or t
  misc_feature (137)..(137): n is a, c, g, or t
  misc_feature (219)..(219): n is a, c, g, or t
  misc_feature (228)..(228): n is a, c, g, or t
  misc_feature (335)..(335): n is a, c, g, or t
aacgaaagtgtttctttcaaagaggngggggggattgctcattcaagatgctggattaatggntttataaagtatgtgccgtggatgttttattagccattatcttcatgcnggattctaatattctttttaatggngatctgttcaatgacagaaacttatagagagaaaattccttctcaatttataaacaaaaattttaaaagcagcatttttgangtggtaggnagatatttatgacaaaagcagctactgccctaaactggcaaaaacaacaaaagaacaaattgttatttaacctttaaataacgagtgtctatttgctataatatctnctaatattttaaatatatttcctcctgactgcaattaaa

SEQ ID NO: 605760 - DNA, 1261 bp, Homo sapiens
catcattcttctatcaattttaaacggctgcctaccacctggttgtgcccccgggtggggtccctctttttgcacaccgctgtgagtttgtcgccccccgagggaatgttatgatgctacacagactgcggaaattgtccccaaaaggttgaactgtattcttcggggaaaaagcaccccttggggaaacaaaaggtagtgtcgtagccctagagatatcactggggcttacataggggtttaatctgggtggcacccacgcagaaatgttcaggttaggtaatagccgtgtgagaaacctcgggcaagtatttgcgaaccttctcgggttccccgatgattcctgcgcgtattcgcctccaacggcggttcacaaaaaattttaacctggacctcctccacaacttccaccggggacccaaaaatggaaaaagaatactcggctgccagaagctttctgggagcccctttaggggatatcaataccgtttccgttgtttccacccgcttagagtgggccctcgacatgggccaatggtgaatttacccccaaacgtgctatcccacttgtagggaccatcttgtgactaacaccgagacaacacggtatactaacgcttggttatgctcaactgttcccaccaaaatggggccctcaatccacataagggaagccccgtaaattttgcgcactccactaagggaaggctttcacattccaccgtgaatgttccccctcagattgttccacagggtaacacccccctatggcgccaaacctataccgcccaaaatccacattgtcacctatatcaaaaatgtcacttccggcgcgtaaaatctaaaactgtgttttcgccacacaaacaacacgttgtttcgggcgctaattccgggaatgcccccgcaacgttatactcggagactatccccgaaggcaataacacccaccactggaaacactcctattcaatctgtaagggtcacatgtcaatgtttttctaaacacgcacgtaaataataaataaattttcaatgagtttgagaagccttcgcttccgaagcgagaaagtcctaaatagtagagagaaccctccactaaaacctggaggtgagactaataatggagtgccccccacccctagccacacaacacatttgagagaaacccgtataacataaaatttagaccaaaaaggaaggaatcgaacccccccaagctggtttcaagccaaccccatggcctccatgactttttcca

SEQ ID NO: 605761 - DNA, 479 bp, Homo sapiens
  misc_feature (438)..(438): n is a, c, g, or t
  misc_feature (459)..(459): n is a, c, g, or t
acaaatggcaaaattaaagaatagttcatattgatgttatatagaaacagccccctaaagtataaattactcttggaggagtaagcaagagtattccttgggggaaacccagtagaaaatgggcaaaggacaagggcagttcacagagaaaggaacacaaatggcttttatacatatgaaaaatgtactgtctcactcatgacaagagaaatgcaaatttaaactgcacacctaccatattggctaaaatctaagtcctggacaacacatattggggtaagggcctctaatgtatttgctaacaaaagtacaaaattatgcaactcctatccaaatatgcttccaaattataagtggtatttactcctttaagcctagcagtcccacttctggaaacctaatccctacacatcacctgcacacatattgtcctagtcnggtttggtgctgccataccgnatatctgagactgggtagtt

SEQ ID NO: 605762 - DNA, 589 bp, Homo sapiens
atgaaaaccagcagtctaaggaacatctctataatttagtcgtagcatatgcataacaagtgtccttcatggataaacgtatattctctattcgtatggagctaagtaaaacttgtgtagacctgtagctgcattatattcaggcttttgaacagtattatggtatgtgctgtgaaagcatggaaatctgtagagtctgtggacgattgttaatccgtgcaacaactagaaaggagcaatgaagtctatttcagttgtatttttccctaagcacaatctgcaatagtttatgtatgacagagataattcaaaaaggaaaactatatataaaagtggtatataaagtttgtctctgaaatatttctttgaagtttttaaaaaatttgactcagtgtttaaaaacaagaaagcacatattcagagcatggacttttttaacttgttttcatctgtttatcatgacttttttatttctggtgtagagtccacattatttagttggttgtacttttaaatttcaaagttcaaatctgaaggaagttagcgtttgtgatttcgggataccatgcagtggttttaatcccaggaa

SEQ ID NO: 605763 - DNA, 535 bp, Homo sapiens
gttcaccaagctcccacccttcatgcttggagccttggtccccagtattagcaccagattttcggtcagggcatcatttgggacatccacagctttgtccagtggggagtggagctgggaaaccagctggcttagaaaatagagcctgagcttgatggcagtggtccagtgacctctccccacgcttttaccaatggggtcatcaacttcatccagcagcaggggagggcaaaggcccataaacttggggtcatttgcagcctcctctgggactcccctttttttttttgtccctcctccccggagccggccctggatgtttctgggccccccccagagccccctctggttgtggggttgggccccgagccctttgcagggaagggtggtttcccccagcctaaccccccgcccctccatgtttatggtccctctgggttagaattgggtgaagtggttttgggcagctggcttttttggcccctgttcccgttggtcccctcccctgtagaaaaataaagatgccccgggggga

SEQ ID NO: 605764 - DNA, 708 bp, Homo sapiens
agagcgagtttgatggcctcttcaccacccacaagggtaacttccagctgttgctgtaccagaatgatggctgcctgtggtggagcccctgtcacccccttcacggaggacctcacctgcttccctgagaagtcctctcaagcgctgctgggggacgatgctagtgcgagatggacgccaggtggtacatgatgtatgagggccccctgtctggagtcctagttgggcatgtgagctattgccgcaggtatacgctagtctggattgcttggactaaattggtatgcttgcacccgtgaacaccgagcctatgtgaagtgtactctcgccagcgcgactcgttgagttggccacggtgttagcgagcgagtacggtggtcgcaatgcgtagtagaaaggtcgctcaatggaaacgggcgatattcgcattcgcattgccgtccaatccttggcgtttcctggggcgccttcggtaattgcccgcctaaggtcccccaggaggcgggatcgccttcgttgcttttgtccctaaggctcttgtctgcaggggttatcggaccggtaattcccctttagggaacccccctgggggcgatcccacaatcgctgtccgtttggccggtgtccccaaggtggggagcgccctgtgggtggccccccgttcgaaggaccttggcccccacccgtacccccttgggaagccccggg

SEQ ID NO: 605765 - DNA, 897 bp, Homo sapiens
tgattgattctcaagattttgcacagaaaactctttgggggctagaacagcagtaattgcatcacactggtttcaagacttcaagtttcaaaagcaaatcattaaaaaaaatacacgtcctgatttgagttagatacaggggacaaaaaagtagcacatacttggaggttacgtggtctacaaaagggggtaatatttaccttgggagagtagttctggtggtgtttattttttaaatacctcgagagggtaaacctcacaacattgattatcccaagcgaaacgggtgtcacactttataaagaatattcacaagaaccctttctgtacctaacaggggggaagaagacgatagactcgtccccgcacaaaggaattgttatctacaccaggggcgtgggtagatgtgaggcaccaaaaaagtagccgcgacgcagcacgtaaaccataaatcgagagggggtgctgacacccggggctcctgggcgaagactttcgttaacccctgttgtggagtacggcagtctcgagagcgggagagagagagtagcattgaagggacagagacccgctcacgggctatgctatctcggcaccattactgtagagcgccggaagaagtgttggttatcagtgcgattgcgaactgcgtgagttgccgcggtggccagtaaagcaaagacaacgggaagcgagtgactctcggcacagactgaagtagcccgtgcgaagtagacaattgtaatatgttttcacagtgttagaacggtcggccgccgaccgcgtattgcggagaatcgttgagactgcgcgatcttatgggcagtgagtttgaggagggcgcaagccgaccaatttcgaataagggagatgaaggagtttgcataaagtagatag

SEQ ID NO: 605766 - DNA, 262 bp, Homo sapiens
atgcaatgtgtcacctctaggtcaccaaactgcgatgatctagtagaaatcttgactgatttcccttgcaggcaagggaaaagtagaggaacaggagttattatgtaattcacttatgagtgatacaggggatactgaatgatatatgaatgtcctcaccagtactgggaaattcagaatcagaatttatatacccattgctgtttatgatctccataaaaatcaaagcagatatttccacttgtggctaagatgaatgggg

SEQ ID NO: 605767 - DNA, 696 bp, Homo sapiens
atatctaagttagatgagattaatacatatttatatcctgaatgtagtatatatcctagaggttgaagtgtgattaaggtagccctaggtaagggtgacatctgggatagtaccgagattcgtgttcttgatagctctacatttactatgagattgtcgtagtaaatcaatggtaatggacgtgatggcgactggtgagtatgttgttctatgttattggctgtccgcttactatagtattcgaggtaacgttaaaggacttacatgaggatcatcacacggtcttacgtacatgttatgaacttaatagtcgtaaatgagatcgtagctttgaacagtggtttagctatactgagcacttgtattggtatcacttgacttccatgaatgtaacatgtaagtctatgagagtaactcgatcgtatagtgatctgtaggtgcttgcagagaatccatagtgcatttagagtcagaatggagcgatttagtagtaacagtaccagctgctacgaaaccggtctaagacggcttttgtatgtgactcccctggatcgagtcactgagttgtggcaggtgagctgcatgacgatggaggagagactctgctggcttccgctatggggttctgaatcctgtgcgcaagtctgccattagtgaccagctcaagtccaaagactcaataccaagcaggaaggc

SEQ ID NO: 605768 - DNA, 100 bp, Homo sapiens
gcggcctactactactactactgctcgaattcaagcttctaacgatgtacggggacatgaactatatagcgaatgaaaaatagccgccaggaggaaaaaa

SEQ ID NO: 605769 - DNA, 419 bp, Homo sapiens
agctgtatgctgctggtgactctatgacggatcccccctgttcctgcttcttgaaatgggagaagcgttagtgctgcctacctgagcgaggccgagtccaatcctcacccacactagcatcacccgtctgtctgagcagatagctgttgctgcatgtggtgtctcagaactgtgacgggctccacctgaggagtgtgctgacgcgcacggccatctccgatctccacggtgaacatgttcattgaagtctgtacctcctgcgttccctacagtggaagtacgtgcgggtgttcgatgtgacggatcgcactgccctccacagacaccagtacaggccggatctgtcacaagtgtgggacccagctgtggcactccattgtgctacttggggagagggcgacgttggggcagtctctgaa

SEQ ID NO: 605770 - DNA, 832 bp, Homo sapiens
cagcaagggaggagactgtgctggcaacatgtgccatggctctgcagacagcattcgccagcctgatcccagacaggctgagctgaggatgcatcgtggaggagattgaggaccttgtttgatctgccctggatgagctcgggggtcgtgtatctccagtattgacagaatggactggaaacaagagcgttatatgtggctgccacctacgaagctacatggatcatgtggtgactgagccatccatttagatggagtgatcatgtgtcatccaagcttgatgatagtgctgatcttcagcgaacgaagaactttgagtccctctcctgacagccttcagcgtggcctcatgcaagcttgctgtgctctcgcaattaatctgcgtacacacagtgccagttgtggtatgtgcctagagggctctgcttccgacactcatgaacaggctatcttgcggttgcaagtcacgcaatgttgctggtctcgagcctgcgtgaactcagggctcaattgtgtaagaaactaggaacgatggcgtaggagatcgttgttgcttccgattggagccacttgtgcctccaaggacagacatccgttgcaacccccgtgtaggggatgtccctgtgaactaacacttttcagttgaactgtcaagagttttccaggctggttataaagtgacttccttgtcgaagtttgacggttgacaagccaggtatattgcaacatagcgtatacgctcagaagtcaaggatctccacttgaagtcgggatcgcaaatgtggatctttcccaccggggagtacagggtcagagcgttgcccccaaaaac

SEQ ID NO: 605771 - DNA, 341 bp, Homo sapiens
atgcatgcttgcgcattttttgttaaagcatctttattgagttataatttctataccacataatttaccgatgttaaatatacaattcattttttgtatcacattattgttattattattttgagacagagtttcactcttgttgcccaggatggagtgcagtggtttgatcttggctcactgcgacctccgcctccccagttcaagcaattctcctgcctcagcctcccgagaagctgggactacagccctgcatcaccacgcccagttaacttttgtactttcagtagagacggggtttcaccatgttggccaggctggtaccaaattcctgacctcaa

SEQ ID NO: 605772 - DNA, 211 bp, Homo sapiens
gactgcatccacgcccgctgactgctcacgccgctgagagatgtgcgagcgccggtccgaagggacgggtgatgtgtgccatctctcaggaccgactgacccatgtccaactgctgttcacatggaacctttctccagttcgggctacaaagttctcgttggagtatttgttactaccaccgagatctgcgccagcggcgttggatgcagt

SEQ ID NO: 605773 - DNA, 348 bp, Homo sapiens
gtcggatagtgctttgtcatggcgataacctttattagactgttaatgaagggtaggtcaatcgttacaaagggggcaaattatatcatagaggcctaccccccgaatgactcattaaaaggtgtgaacatttttaaaggctgtggacataatatattgtcaacatgctttccaaaaagtagtagcaattcacactttctccagcaatacagagggttctctgcatctttggaggcattggaaatgcattctataacctgtaagttaaaaatacttccttattttaatttgtgctgaattacttttgatgatagatacacgtaggtaggtaagtaggtagacaaattc

SEQ ID NO: 605774 - DNA, 957 bp, Homo sapiens
  misc_feature (47)..(47): n is a, c, g, or t
  misc_feature (58)..(58): n is a, c, g, or t
  misc_feature (69)..(69): n is a, c, g, or t
  misc_feature (118)..(118): n is a, c, g, or t
  misc_feature (144)..(144): n is a, c, g, or t
  misc_feature (146)..(146): n is a, c, g, or t
  misc_feature (154)..(154): n is a, c, g, or t
  misc_feature (162)..(162): n is a, c, g, or t
  misc_feature (164)..(164): n is a, c, g, or t
  misc_feature (177)..(178): n is a, c, g, or t
  misc_feature (196)..(196): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (220)..(220): n is a, c, g, or t
  misc_feature (223)..(223): n is a, c, g, or t
  misc_feature (235)..(235): n is a, c, g, or t
  misc_feature (239)..(239): n is a, c, g, or t
  misc_feature (263)..(263): n is a, c, g, or t
  misc_feature (292)..(292): n is a, c, g, or t
  misc_feature (296)..(296): n is a, c, g, or t
  misc_feature (306)..(307): n is a, c, g, or t
  misc_feature (321)..(321): n is a, c, g, or t
  misc_feature (324)..(324): n is a, c, g, or t
  misc_feature (350)..(350): n is a, c, g, or t
  misc_feature (352)..(352): n is a, c, g, or t
  misc_feature (358)..(358): n is a, c, g, or t
  misc_feature (397)..(397): n is a, c, g, or t
  misc_feature (413)..(413): n is a, c, g, or t
  misc_feature (418)..(418): n is a, c, g, or t
  misc_feature (460)..(461): n is a, c, g, or t
  misc_feature (608)..(608): n is a, c, g, or t
  misc_feature (621)..(621): n is a, c, g, or t
  misc_feature (633)..(633): n is a, c, g, or t
  misc_feature (640)..(641): n is a, c, g, or t
  misc_feature (662)..(662): n is a, c, g, or t
gtcaccgttgtcctgctgctgctgctgctcctactgctggccactgncctagtactgncctgcgccgcntcagccgtgactcagggggctactaccacccggccctcctaggttccgngctgtggggcttcactcggctccttntnttgccatncccccagntntcttgctacaatnncgagctgaactggggtcnanananaattaccttgaactacangangatgaacagtanacanactatgaccacgtcgcggatggtngcctgcaggctgaccctggggaaggcgancagnaatgtggaanngcgtcagcccagancangtccccgtgcgggctgaggaagccananacagtnacacggagggcgacctggtcctcggctccccaggaccancgagcgcagggggcantgctnaggccctgctgagtgacctgcacgcctttgctggcagcgcannctgggatgacagcgccagggcagctgggggccagggcctccatgtcaccgcactgtagaggccggtcttggtgtccatccctgtcacagccgctcactccccgtgcctctgcttcccaagatgccatggctggactggacccccagnccacatgaccatncctcagactgtnacccctnncagttcccaagtccatgttanccccgttcaccacgggaacggtcctccaccaaccacaggcatcaggcaacccatttgaaagttagaactccttcaggcctgtgaaagcatcaggcacgtaatactgagtacttacggctcctgaagatcatcaaaagtacagatcatcgagaatgctgtatgtgccagaaagcatgccggagcagaaatcgggaagcatctggttcaggccatcaattagtttacacgggtctttcatacatcgatgcaagctgatcatgattaccgacgcctgtcggggtcaaactagcactca

SEQ ID NO: 605775 - DNA, 198 bp, Homo sapiens
  misc_feature (54)..(54): n is a, c, g, or t
tatggttgaaaatgtttattctcttctttgggagtaagctacatgatgcataanactgtgttgtgttagaaatgttcaggaattaaaaactttatgttacagaattgagctgcagaaagtgcaagacatgtcaattttaagacacacggtcttctaagactgaaggataaatttaaatgcatttcagaaactaaaaca

SEQ ID NO: 605776 - DNA, 702 bp, Homo sapiens
  misc_feature (419)..(419): n is a, c, g, or t
taggtttggagggggaatgctggaaatggtaatggggtatggagactattatcatataagtaatgctagggtgagtggtaggaagtttttccataggaggtgttatgagtgggcccgtagcgggaatcagggggttatgctggtccagaattctataaaacacagggaggttaaaaatgtaagggtctagggtggacaaaattattgttggtgtgtagagtctccagggagagatgtggcgtcataattgttggtctcctagagaagtattgtgtagtgggtggatggtgtgtgttttatttatatatcaatggtgttggtgtgttattccggcttatgagaagaattaagggcgagaagggcgcctggcgggcgtaattccgattgttagaacgcctggagaactagtctcggactcncctcttcggcaaggtccacaagggggtgttccaggtatggggtactcctggctaagtggtggggaagatacatatcctatatatttatgggggccacaggtgtcccatgaagtggccaggagaatatactccagaaggggtggtccctgggtgttgggtgaataagcggggtggagcagggcttacaagggagccccccttttattaggtaagtggtgtggactagttaacacatggattggctaaggggtgaacttccttttgcacattgggtggggggcaa

SEQ ID NO: 605777 - DNA, 92 bp, Homo sapiens
aaaaagcaaccaagcccaaagtgtgactttgttgacattttatgtggctttgtcatatgttcctaacccccaataaaaacaatgttgcatca

SEQ ID NO: 605778 - DNA, 901 bp, Homo sapiens
tataacattcacagccacagaactaatcatattattatatcttcttcgaaaacccacttatccccaccttggatatcatcacccgatgtaggcaacagccagaacgcctgtaacgcaggcgacatacttcctattctacaccctagtaggctcccttccccgtactcatcggcactaatttaacactcagcaatcaccctaggctcgactaaactattctactactgcactctcaacggtgccgcaagaatctagtcaaactcctgagccaagcgaagcttaatatgactagcttatcgacaatagcttttatagtgagaagataccctctttacggagctccacttatgactccctaaagcccatgtcgaagcccccatcgctgggtcgatagtacttgccgcagtactcttgaaactaggcggctatggtataatacgcctcacagtcattctcaagcccctgacaaaacacatagccctaccccttccttgtgctatccctatgaggcatagttataagcaaagctccatctgctacagaggaacagacctaaaatcgctcatgcctactcttcaatcagccacatagccctcgtagtaacagcacattctcatccaaataccctgaagctcacggcgcagtcattctcataatcgccaacggccttacagtcctcattactattctgctagttaactcaactagaaacgcactgaagtcgcatcataatcctctcctagggattaatccaatccactaaagtttgatgactataaaagctcgttaactcgcttaccacatattactaaggagaacatgggtataaccagtcctgggaaatccgccaagggaagacaaagagatatccctatttccacaagggtcccaattaaacccg

SEQ ID NO: 605779 - DNA, 628 bp, Homo sapiens
cttctatgcgcggagccttccccctttcttcccaccaacattcttggctcggtaccaccgggatttccactttccttttctccggaagcctcgccatgaagcccattggttagggtttcaccccaataggggcataggtagccctaggaggccctccaaatggtacccatggtttcgcatttgtgcacgaaccctgtagggcctatagagcccactggggcacagggtcttctcgggttccacgtatagccgcatgaacacccagcccgtcttcagctaacgcttacacccaatgggacctggcctcgaaccaatgcagggctgaacaactaacggagttcagcttggaagaaatttacagccaagcaagaattgagcgcaatcagcccactaaccaggaggaccttttgagaccatctttgaggaaccccgggagtcgcaatgggactactgattttcaccagctcaaggaagctccggacgggtctgtggaatctcgggacagcagccttcctcgatcacgaagaccgtccacgtggggtccgggctgcagggggcaagactgttcactcccaatgtggcccccagccctgatgtgggccacctgctccagcagcggctggaggag

SEQ ID NO: 605780 - DNA, 365 bp, Homo sapiens
tattggcattacaggtgtgaccccgtctctacgaataattttaaaaaaattagctgggtgtggtggtgcatacccgtgtcccagctactagggaggctgaggctggattgcctgagctcaggaggttgaggcttcagtgggctgtgatcgggccaccgcagtgcaggctgggtgacagagtgagattgtctcaaaaaaaaaaaaaaatttcgtctgtgtggtatcatgtttcagattttttttttttgggaaagctgattattttcccggtgtccggcttttttataagggccttggttggattataattgcttgtgtttggaacccattattttgccctgtgaccgtgcattgaacttcttgtg

SEQ ID NO: 605781 - DNA, 595 bp, Homo sapiens
  misc_feature (7)..(7): n is a, c, g, or t
  misc_feature (79)..(79): n is a, c, g, or t
  misc_feature (119)..(120): n is a, c, g, or t
  misc_feature (143)..(143): n is a, c, g, or t
  misc_feature (217)..(217): n is a, c, g, or t
  misc_feature (393)..(393): n is a, c, g, or t
  misc_feature (471)..(471): n is a, c, g, or t
  misc_feature (542)..(542): n is a, c, g, or t
cgacgtngaaccccattggcgtggagctggaggtgctggatggccacgaccccgaccccggcggcatgctgtgcagacnggcacgagcgcatacttcctcccgcccgggtgcgcgcganntgcgcgtgggccgggtgcgaggngcatcattcctgccgccagaacctgggccctttcctgggattgtggacatgttcggaactggaggtggcctgcntggagtatcgggctagtctgctggctgggaagggttttgctgtgatggctctggcttattataactatgaagacctccccaagaccatggagacgctccatctggagtactttgaagaagccatgaactacttgctcagtcatccccgaggtaaaaggtccaggagttgggctgcntggaatttccaaagggggttagctctgcctttccatggcctctttcctgaagggcattacggctgctgtcgtcatcanggctctgtggccatgttgggggacctacgctaaaaggcgagacctgcccctgtgggttcaacagaattgcntaaggtaccaaatggctatcagacattgtgatgtcctgaaagcctttgaaggc

SEQ ID NO: 605782 - DNA, 266 bp, Homo sapiens
ggacctcagttctattcctctacctcatcaccatcctaatagtcctcggcatcatcggcttcttcttcttccaccggggccactttttcctcctcagctacttctactactttgaattcactcccatctgcatagtctgtgtctgctccgccccaccaaacatccgagtcatcctcctccgcatcagcagaatccacattgtcactttattcagccagggggcaacacacaaactctacccctcggaacttgtcaattccgcaggg

SEQ ID NO: 605783 - DNA, 909 bp, Homo sapiens
  misc_feature (458)..(458): n is a, c, g, or t
  misc_feature (672)..(672): n is a, c, g, or t
gtgcctgtgtatcaggcagtcgtgcgtatcactgtggaagtgtgctcctgggcagttgaggaatcctggcactaccgtttcgtgtacttctttgccacatgattatcagagcttaatacaataacttatgaggtattgtcaggaggttccctacaatattgggatgggtctcgtagagtaaacgtaattccaatagcttcaggattggcagacgtagacatatggtgagttatgcaagatgtgcgtatgaggcaggaattgcattgtagcgttcctagaatatgaggtgtgggtgatgacgctggcttcatggcgtagaatctgtatgaaggagaactgcgagagatatcgacgtgtgggagacgcagagatccaataccaagtaagagggccggtcggcttgaatgggtataaatctgactggtgcgatttctaagatcaggcttaaggggtttcangcttgtgaccacgtccgtcagtgtctactttctggtcactcttagataaggccaatcgatttggagttaggcagatgcctctcgagtggtggatgactcgagctcggacatccatgacgcaagggagaatacgcgtcattcacagcccgaggtcaagcggattaactaaagcccagacgaaatggaacgattcctggagtggtagggatgcaancatggggcagataggaagtcgcggtggcaaacgggagacgggagttcggcaagcgaagagcgaatggcccggagcgaccgacacaaccacagggtgtggggggcggccgggaaaaacaagaaccagcggggcggcgcatgccgcgccggacgtcgttcccagaacacgggacccgggggcccaaacaaacacgggcccgcccaacacgggtgggcccgctcaagccggctacccgcg

SEQ ID NO: 605784 - DNA, 882 bp, Homo sapiens
gggggcaggtgccgccgcgtagacgcacccggctgaccccgtgcaacatgtaaacggcgccagcaggcggacgctggcttctccgcctgggacccctccgcccgaccgggccccgcggcctcgatgaggacacaccatgctgaccggggtgaccgaggtattttctgttgcctgctggtgcactgccccccgaagctgtgtggtgccactggagagctggtcgaagtccagcgatggctacacctttgtagagtgtcaagcccggcgctgtgctgcgggtgaagcatgcaggacccgccccagctgtgccccacctccaccatcatccgatcctccggatgcagccaggggacctctccggcttggtccgctgtcagcgcccggatcacctgtgtacccgaatgggcggttgctggtggaaaacctgggccgagcccctcgagcctgactcctacacgggcagaatggtctggggagccgctggccgcctggaggtggagcttggcagatccggcgggcagctgattggccgcttggcccccggcaggcgcaggcaggcggagcggcgcagtggcaggtggtgggcggtggtggcgagcaggcgcccaagaggaccatcatattgactgggagacgcgcatcacttagctgcaaggggccaaggctgactgtggtgtcttgtcatccatggtgtcgcggggtccctggcatctggaaggacccgtggcttcttgtgggctagcatgaggggtggtctgactggcggcgggccggtcgcgccggggcggggtaacctttgggcggtgggctgggccttcggttgccgggagtggccggcccggggccttggtcggcggccgcctcgggtgaggggcacctcct

SEQ ID NO: 605785 - DNA, 452 bp, Homo sapiens
  misc_feature (8)..(8): n is a, c, g, or t
  misc_feature (287)..(287): n is a, c, g, or t
ttctcccnatgaggacttctgccccctgcaagcaaacttttgctttgacaagccccaggcatttcatatatccctctgaaaatcctagggcagaggttccccaaacctcaattccttaacttcctgtgtgtcccacaggctcaacacccatgtggaagcttcccaaggcttggggcttgcactctctaaaccccacagcccgagctttacgttggccccttttcagccatggctggagcggctaggatgcagggcaacaagtccctaggctgcacacagcaggggancctaggccccacccacaaaaccatgttttcctcctaagccccaagccctgtgatgggaggggctgctgtgaaggtctctgacatccctgcagacagaaaactgactaaagaagaaatagaaaatgtgaatagatgtataataaagagattgagttagttttttca

SEQ ID NO: 605786 - DNA, 1060 bp, Homo sapiens
  misc_feature (262)..(262): n is a, c, g, or t
caagacctcaacgtttggcgcaagtggtggccgatgtgctctgcgagttcctggcaggtggctagtgcactcatcatcctactacgtgacgcgagtgtctactcccgtgtgtgcatcattgccagataatcgcaaagaagtacaaggtggccggtccagatgtcctgccacccggagctgaatacagtactatccaggaacacgctggctctgcgtcaacgccactcctggagaatgaatgactgtggacgaactgtggtgngtggtgacttttcggattaacagagcacctgcccaggtggatgaaattcggtctattgaggatcaccacagcctccagctgcatgtccagtcagcgtcagactacgcgtgttgtctcatgtggagcagcatgctcctgggccttcatcgctgaagatcagcgtgatgcgatgccgatcctggaccacaaacccccagggctgtaccttcacagtcctggtggcacacgatgagaagccggcacttcgcaagatggagaagatccaggtcatcaaggatttcccctggatcctggcgggatgagcaggatgtccacatgtcatgagccccgggtgataccattaaaaaacatgacgtcggacattttaacagatgcagtttacgtggcagagcgcgctcgatacggcagctgaggggggcgacttggcaacccagtgatgccaaatgtcagactttgggggatccgcgctaggcagtggtgcatgggtgcgccgaatccagaggtcttataggcccgtgtgttggaaggcccgaccaacccggggcgatcagggctgtaggaggaaggcttcacaggagggggtacaggatgaccggaactcgacatcacagccccgggggtcccccgcacaacggtggtgccacaacgagcgcggcggtcacaaagggcccagcgtgtgcgaacacacaaaaaaagggggggcagaactcacagggcgcacacaccccgtctgacgaggccacgggaaaaaaagagcagggagcaacagcaggatgcacagaacacctgcgagacgac

SEQ ID NO: 605787 - DNA, 198 bp, Homo sapiens
tgagtatgaatgtcgggtcgaagagcgtatgatgggcagtgaggggcgcaatgatcaggcatatatcgagaagtagcgtacgtaaacgtactctagaatatagtagatgcgaataaaggtgatatgatggcgagattgtatgatgtattgattggtcatatatgggcgggtataatacctcagtcgcgtccatggcat

SEQ ID NO: 605788 - DNA, 139 bp, Homo sapiens
gggaccggtaatgtagctgtactgatgggagactttcaatcatttggagactatttggcgtgttagcccaggtcttcctggctacccagaacttgtaccttggatttttcaagtttcttttgaatttcgatcacttcta

SEQ ID NO: 605789 - DNA, 205 bp, Homo sapiens
aaccccccccccgccagcttcccctgcctcctacatccagtttgtttttgttcaaagtaaaaatcctgtgttcccccttcagtgacccctaaattgtttgttgttgtttttttttttaattgtcttcaaaaaggaagggccccattaaagggtgaccttgtaataaattggaatttcaaataaccctcatgtacttgtgtttata

SEQ ID NO: 605790 - DNA, 176 bp, Homo sapiens
tgtgatatccccgggtaggatcatctacaggctatagtatcatcctacaggtgatggtacatgctacgaggtgatggtacatgctacaggtgatggtacagctatcacgtgatgtacagctatcaggtgatagtacagctatcaggtgatgtacagctacgaggtgatgtacagct

SEQ ID NO: 605791 - DNA, 760 bp, Homo sapiens
cgtaacgtcatcaacactgaattcgcgtacatactgccaacaatgagcatcatggtctgagtgccacctgtcaaccgctgctatcatgagtatgtcgcatgatctgcgaagaccttactgttgcgcaagatgcgagtcgtagatgcacaggagcatagtggaagaccgacgatacatgctgcagaccttgctaaatcgttgtgactccaagaaggcctaccatctcagaggagcacattgaccttctgtgactagccctatatgaacatgtccaggttgtcaccaggcactagcatcttctggacaggagtcactgagtaacgaattcagaggactcacttgaagtgtccctcgctcactccattagggcattacaataatacgctgttataaaatattctctctgcccaattgtcctgcaaacaaattgtacaaataccacatcatactacatagcacccggctgcctgcgcaaacagctcaaagatgccacctctcggggctctgaaccgggcttcctaccttgtagccgacgtaagaccccacaggcctggtttccagaccgttaccccaatcgttgccccacaagtgaagagcgctacagcatggaatggcgcaacttacctaggctaggggcccattcgggcaacaatccaccttcctggcatcctggggcaaccatgcgctgacaccaatcgttagcgtccaacctactgagagacgcgtcccaaaataccgctaatacgacgaaccacctctg

SEQ ID NO: 605792 - DNA, 141 bp, Homo sapiens
  misc_feature (31)..(31): n is a, c, g, or t
  misc_feature (97)..(97): n is a, c, g, or t
  misc_feature (106)..(106): n is a, c, g, or t
cctgggatttaagaggggtgctgatcccggnatgcctgaaccaactgttttgagccttctttggggataaaggattatttggtcttctggatttggnggcaatcancggacagcatggaatatgtgtgctctggctcggat

SEQ ID NO: 605793 - DNA, 148 bp, Homo sapiens
gagaaagccatgtttcagtttcgagcgccaagatcgtgaagcccaattgcgagaagccggacgagttcgagtccgcatctcccaggctcttctgagctgagatgaactcgacctaaaggctaagctaaggagctgaaatattacgaca

SEQ ID NO: 605794 - DNA, 394 bp, Homo sapiens
ctagaggacccaagctctggacaggggcatctctcttgaacccaaatgtctctcttcttattaccaaaaccatggctctatttcttcttcacatccactggctcttcatgtctattcccattcccttcgggccaacagaccggtgggaaaactgagaccggccgttcagagatggaccgagaacttattttggattgtggatttggacttttttgtacataaattagaaaaacccaaatactcccaagatgacttcccctggctcctaatcccagctgacagaggaggatgtaagggcttagccatgatctgcaggggtctggggagtccaggccgggctattgcttgggtctctctctatttatatatctcagttcacagtgtttcttattcc

SEQ ID NO: 605795 - DNA, 563 bp, Homo sapiens
  misc_feature (398)..(398): n is a, c, g, or t
tggagacgggggtctcaccagtgggccacactggtctcgaacttcgggcctcaagtgatctgcctgactcggcctcccaaagagccggcattataggcctgagccatggtgcctggcccctagccccattttctacggggacatgggacttacggatgtgtaaggattctgggtatatgaaggaatttacctttggtgtttccctagcaactaatgataagcatttggcaggtgtgtattcttttttgaggggagagggagtctggctcggtcacccaggcgggggtgcaggggtgtgatctgggctcattgcaagctccgccttcggggttcacgccattctcttgcctcagcctccggggtagcgggaattagagagtgcccgccaccaggcgggnttcattggtgggtatataaagaagagagggagttgcatggtgtaagccgggagggtctcaatctcgtgacgggatgacccaccggtttgggcctcccaaggtgtggggattacgggcttgagccaccaggacggggagaagtgggtttcttatcaggacggcatt

SEQ ID NO: 605796 - DNA, 234 bp, Homo sapiens
gcaggagaatcacttcaacctgggagctggaggttgcagtgagccaagatcgcaccattacactccagcctgggcgacaagagcgaaattccatctcaaaaaaaaaaaaaaaaaaaaaaaagggggggccttttccccccgccttggagggcccttttacacgggggaaaaaaggaaaaactgggcttgggggggggcgtttggttttaaaaaaccaaaatgaagccgcctccg

SEQ ID NO: 605797 - DNA, 760 bp, Homo sapiens
tgagcgggtggagagttgtgcgccggtccctgtggcctgagctccggctccgtgctggggcgcctgctgatgtctcaagatggctggagctgggcgaattaaagcacatggtgatgagtttccgggtgtctgagctccgggtgcttcttggctttgctggccggaacaagagtggacggaagcactgatgctcctggccaatggctctgcacactcctgaagtccagctgtgcccctagtgtccagatgaagatcaaagagctttaccaatgacgctttccccggaagaccctggggcacctctgatctctcccttctctctttgccccctggcacctctcctgtaggctcccctggtcctctagctcaccatttccaccaacgcatgtaggacactggacacacctgatgggccaacaagcgtgaggtggacatgcagcacccatcctgccccagagtctgtgcaccactgatgtcaccatgaaaccatttgcccttctattgaagtctatggggagctcattcgtgcacaaccagcattgacatcacttctaggccagcggctatgacgaaggcgcaccttaacctttatgcgagctcaagaacaccaagagaaagttgcagtagaattacttacatcccaagagaaatgttactggccaggaaacccaacgtgtgactaataccgatacaggtgcggcgtcaggatcctgactctgtcagaacaacgctggcccccaggacggcatatcatcccacc

SEQ ID NO: 605798 - DNA, 569 bp, Homo sapiens
  misc_feature (20)..(20): n is a, c, g, or t
  misc_feature (65)..(65): n is a, c, g, or t
  misc_feature (69)..(69): n is a, c, g, or t
  misc_feature (73)..(74): n is a, c, g, or t
  misc_feature (76)..(76): n is a, c, g, or t
  misc_feature (81)..(81): n is a, c, g, or t
  misc_feature (93)..(93): n is a, c, g, or t
  misc_feature (97)..(97): n is a, c, g, or t
  misc_feature (100)..(100): n is a, c, g, or t
  misc_feature (108)..(108): n is a, c, g, or t
  misc_feature (119)..(119): n is a, c, g, or t
  misc_feature (168)..(168): n is a, c, g, or t
  misc_feature (176)..(176): n is a, c, g, or t
  misc_feature (200)..(200): n is a, c, g, or t
  misc_feature (202)..(204): n is a, c, g, or t
  misc_feature (230)..(230): n is a, c, g, or t
  misc_feature (232)..(233): n is a, c, g, or t
  misc_feature (236)..(238): n is a, c, g, or t
  misc_feature (240)..(240): n is a, c, g, or t
  misc_feature (264)..(265): n is a, c, g, or t
  misc_feature (283)..(283): n is a, c, g, or t
  misc_feature (297)..(297): n is a, c, g, or t
  misc_feature (304)..(304): n is a, c, g, or t
  misc_feature (317)..(317): n is a, c, g, or t
  misc_feature (338)..(338): n is a, c, g, or t
  misc_feature (349)..(349): n is a, c, g, or t
  misc_feature (353)..(354): n is a, c, g, or t
  misc_feature (357)..(357): n is a, c, g, or t
  misc_feature (386)..(386): n is a, c, g, or t
  misc_feature (404)..(404): n is a, c, g, or t
  misc_feature (440)..(440): n is a, c, g, or t
  misc_feature (464)..(464): n is a, c, g, or t
  misc_feature (471)..(471): n is a, c, g, or t
agatcgggttaagtacaaantatagtctttaccatacaaaaagatacataatacaaaaacatganaccngccnncntgcgngcccgacggcgnttcnggntgtgatanctctcagacangggtggggttcagtgctctgacactggactgtgtttaaagtgctatggntgagagtnactgaccaagtgctggcagctgcngnnnggggccaatatccctatctcctaacncnnggnnngngggggggtggggggggttttgtgnnggggtgggctctggtttntggtgggggtgttnggggggngtggtgggggggntgggggtcttggtggggggtncctccttgggnttgnngtngcggtggggggggttggtggcggggaccnttttttatggtttttggntttgttttttttttttttgttcattgggggaatctnaaaagttgttaatttttttttgtnttttggnttaaccctagtgggacagtagagcagtttcagcttacatttaagatggctgatggggaggtcaaaaaatttgataggaattaaagtgctaagaacatc

SEQ ID NO: 605799 - DNA, 292 bp, Homo sapiens
gctcgaccggcaaggtcgggctgcggcgttagtctgccttgcggaagttatggaagtgatgcaaaccgccgccggtgaagaagctttcgccggggttggccgagtattgccggctgagggccgcgtcgagcattttcggcaaggagcggtcgctgttttgcgccaggtagtccaccgcccagagggtgatcgggtcctgggcgtcattcgccacttttttcagttcggcgggtgactggttgccataacggtcgtgcagttcggaaatgatctgcaggtagctggtcagcac

SEQ ID NO: 605800 - DNA, 168 bp, Homo sapiens
  misc_feature (76)..(76): n is a, c, g, or t
gtattgagtcagctcccccaagatgagctgatgccccagagagagctctgtacgtcaccaagtaaccaggcccagnctccaggccccaactccgcccagcctctcccgttctggatcctgcactctaacactcgactctgctgctcatgggaagaacagaattgctcc

SEQ ID NO: 605801 - DNA, 632 bp, Homo sapiens
  misc_feature (247)..(247): n is a, c, g, or t
  misc_feature (484)..(484): n is a, c, g, or t
  misc_feature (496)..(496): n is a, c, g, or t
  misc_feature (509)..(510): n is a, c, g, or t
  misc_feature (572)..(572): n is a, c, g, or t
aaaaaaccctgtttttaaaaaaaaaattggggggccccccacccaaaaaaaccgcccctgttaataatggcgaggggggcctcccccccaaatttgtttttccataaaaaaccgggggcccacataaacccccttttagaagggaaaatttggggccaaaaaaagtttcctcccttttaaccccgggggtggaaaaaaaaatgtggcccccctttttttattaagggccccaatttttaatattttngggtttttaaagaaaaaattttcccggagaaattttttggggggcccctacaaaaagggaacagagtttccggggaaacctttattgcccccggagattgggcctccccccttacccggaaccttccaaaaaagggagaggcttggcctaagagtttgagagtggacgcccctgggaattctaccaggggggaagttttacgaggttcctcacaaggaaagagttgggcccaccttntgcccacacaancaccagacctggnnctggctcaccaaccgaatatccagctaaaaggcggattggtgtggtgacgttctcaacccanttcagtgaaaatgtgagagatagtctttgcgcatgatgtaactacaagccaaaaaacctt

SEQ ID NO: 605802 - DNA, 663 bp, Homo sapiens
  misc_feature (487)..(487): n is a, c, g, or t
  misc_feature (526)..(526): n is a, c, g, or t
  misc_feature (570)..(570): n is a, c, g, or t
  misc_feature (607)..(607): n is a, c, g, or t
  misc_feature (610)..(610): n is a, c, g, or t
  misc_feature (663)..(663): n is a, c, g, or t
tgcagtggttcaagcccgtttatcccagcgctttgggaggcataagcgggcggatcacgtggttaggagatcgagaccatcctggctaacacagtgaaaccccgtctctactaaaaatacaaaaaaattagccgggagcggtggcaggtgcctgtagtccctgctactcaggaggctgagacaggagaatcacttgaacccgggaggcagaggtgcagtgagccgagatcactccattgcactccagcctgggcaacaggagcaaaactctgtctcaaagaaacgaaacaaaacaagaaaacacatttgataccaactcataaccaagtctggattacttctgtagctcattatcactgataaccaagagttgattaatcaaagtagactacctgtcagtctatgtacagaactaaagataatccttattcttggttgtcgagtacagttttaggaaatggatcatcttaaaatagggtaatacggncttgtgcagtggctcacgcctataatcccagcactttgngaggccggcggtggatcacctgaggtcaggagttcgagaccagnctgaccaacatgggagaaccccatctctactatacanaantagccaggcgtcgtgtcacatgtcctgtcctagctactggggaggctgaggcn

SEQ ID NO: 605803 - DNA, 263 bp, Homo sapiens
ggcgcggttccgctcgacgtatctgggaatctgatccatagctctgcgtatcccgacactcatcacaacatcatatgatcagctttgttcactagcacagctatcgcgctagatactgtagacagcgcgctctgctgtgaactagcttgatcatcatactatcgcttagtctcggggtattggccgagctgtggcatcgtattcccagaattcgaggtagttcggattcaccgctctggtcagcggtgctgtcgtaaacatct

SEQ ID NO: 605804 - DNA, 315 bp, Homo sapiens
  misc_feature (76)..(76): n is a, c, g, or t
  misc_feature (277)..(277): n is a, c, g, or t
taaatatgtttattcttagtttttgtctttattattattattaattttggatagcatctcactctctgccaggtgnagtgagcggtgcatctaggctcactgcaactctgcctccccggtcccaatcaattctcctgcctcagtctcccgagtagccaagactacaggcatgagccaccttgcgcggctaatctttgcattttaagtagtaggggtttctccatgctggtcaggctggtcccaaactcctgacctcaggtgatccgcctgtctcggnctcccaaagtgctgggattacaggcgtgagctgccgtg

SEQ ID NO: 605805 - DNA, 208 bp, Homo sapiens
agtgtcatcttcacagtgaacactcaggggcccagggctttttataggcacaccttcctatggttggtcaccaagctaggtgctattggtcatctgctctggttcacaccagagaaccaggctacaagagaaaaagcagaggccaagagttggagggagaaatagtcggtgaagaacccggtattccattaaagacccgtcataatga

SEQ ID NO: 605806 - DNA, 153 bp, Homo sapiens
ctacccccattatacaagctccagttacaacagctccagatacaacagctccagttacaacagtcttccagttacaacagcgtccagtttacaacaagcttgcatgtggtatttatcaacgttgacctgactctatttcattctagcaattgt

SEQ ID NO: 605807 - DNA, 410 bp, Homo sapiens
  misc_feature (280)..(280): n is a, c, g, or t
  misc_feature (392)..(392): n is a, c, g, or t
cgatccttctgcctcagcctcccgagtagctgggactgcaggtgcatgccattgcacctggcataatttttaaaaatttttgtagagatggtgtctctctgtgttgcccaggctggtatggaactcctggccatcaagtgattcgcctgccttggtttcccagaattttgggattataggccaccatgcctggccaaaacagctttattgagaaataattcacaaaccatacaatttagccattttatttatttatttatttattttttccagacggagntcaactctgttgccgaggctggagtgcagtggcgtgatctcggctcactgcgacctctgcctcccgggttcaagcgattctcctgcctcagcctccctagtagttgggattncgggcgcccgccaccatg

SEQ ID NO: 605808 - DNA, 675 bp, Homo sapiens
cgtggtggctcacgcctgtcatcccagcacttgggaggctgaggcgggtggatcacaaggtcaggagatcgagaccatcctggctaacatgatgaaaccccgtctctactaaaagtacaaaaaaaattagctgggtgtggtggcgggcgcctgtagtcccagctactcaggaggctgaggcaggagaatggcgtgaacgcgggaggcggagcttgcagtgagccaagatcgtgccactgcactccagcctgggcgacagagcaagaccccatatcaaaacaaacaaaactgtgatgataaaaagcggccataaacactaatatcaaaccatgctactcgtgtcttaaattttcaaatagcttgtgcacctgaaatacaaaattaagttgtggaaaaacagtttttaacgtgtgtggctcacaagctaattaacgtgtataaggttctggccatgtgaaaggttacaaacataccagttcattttgaagaaaaaaataaacagaaaaaaaaagaaaaaacattgtgtgggcggctggtggcgccctgggaagaggttttttgtaacaccacttggttggggggcgggggcccatgttgggtaagtggacgtgtggccatgagcggatccaaaaggagatccgggcgaagaaagggggggggttttcaccaattaag

SEQ ID NO: 605809 - DNA, 232 bp, Homo sapiens
tcagagaccgtgtttatgacccgctcagaactgatgagatcaagggaatgtacaagcgaaacgccgagcaggactggaccttccatgatgtgccagcttcctgggatctcactgcagcagagcgctgagcgccagcagcacaatcagcagctggggtgccgcagcgcaacatatgcacacgtggcagctggggtaggtaactatcttgtccggagaattctacacgctaaag

SEQ ID NO: 605810 - DNA, 970 bp, Homo sapiens
cgccctctccctcttgccaatacggtccgggctgccccggtgtgtctccgttgagtcgatgtcgttgcagtcctcctggcatgggtctggtccccttctcccgcgctgtaggccgcgcctccctacctgaccaggggttcattgtggcccgtctttactgaggctggcgatttgggccgatatgacaccccgacatggggtttcggaacagcgcccccccacttggtcgagtgccccagatctagcgaacaaggtcttcgggagagtaaaaccaggcaatgccaggggacccactacgtccctgagtgtttcccgggagttccctggtcgttcctcgacgcacgccgttggccccctggttacgggcccgccaattgtgtgaggaccccagaggggccacggccccaaattctttgggacaccaaggtgcccagcaccacgtgtgactctggtaggaatttgaagaatctgttgagtcacccccataaagcgagtccgggaggtcttaatcccctagtctgggcaacctcctctgtgggaggacacgcgacctcccccacacaatgtgcgtttacttggctggcgtcttgtgtaaagcgcaccttcttccagagtagtatagaacaccccacgcttttttcccaaattgttcccccaaacatgttaagcaggagaaagcccccgcttatgaaatctaataaatggtgggacaccccgagctaatcaataatctagataatagaatatcacgcctcgtcatcttcccttatatgagccttcttgaggttcccacaactctcaccctaaacgccgcctcctaattctcacgcccccacttatgaaagtggttactattcaccagtgagcacccactcaagcgacttttcatccccctgtcatatttaaagcggggggttctcaccccccccacaaacaccacgcggaaacccgcccctcgaaaaacaaaaca

SEQ ID NO: 605811 - DNA, 153 bp, Homo sapiens
  misc_feature (6)..(6): n is a, c, g, or t
tgcagngagagagaactgatttatcaaaggcagagagctggggagtcagtgtgtctgagtaggggacaggtggtgtgtgtggggaggcacaatggaggatgaagctgctgaggtaggccagggtgagcttacgtggggcaagcgttcagtttt

SEQ ID NO: 605812 - DNA, 141 bp, Homo sapiens
tcgatttagaggatcccggccttccacttggtgctgcgtctgtccatccagcatttggtgcccattactgtgtccatcaatgctgagctgcgaccgtactgccttgctcggcaggaacaaaagtaccacgcaggctcctga

SEQ ID NO: 605813 - DNA, 736 bp, Homo sapiens
agcgggcgcgtgttgcgggagaggctgggcttgcaaggcgcgatccaagagggatttaagtcagcccacgagctccatgagaaaaagagagcgagagagaaccacagacagtagacggcttaagcgtttacccgaattaatatatatattttgtgaaaacagaactgtgtgtgttttactcgattgttcgttaatgtgaccgtgcgtcagcgctgtaactgcatggatggggaagcagaatagcaaactggcccctgaagtgatggaggacctggtgaagagccacagagtgtaatgagcatgaactctaagcagtggtacccaaggatttctcgaaggactgtccaagtgggacggctaaatctccgaggaactttcagcgagactctatgtgaagttctttcctttatggagacgcctccaagtttgcccagcatgccttccgaaccttcgactagaatggggacgggtgcattgacttcccgagagttcatcgtgcgctctgtccatcaggctccagggggcagcttggagcatgaagctagaactgggccttcaatatgtatgacctggatggtcgatggccatgatcgacccgagtggagatgctaggtagatcatcgaggctatctaccaataatggtaggcaccgtgatcctgactgatcatgaatgacgatggctgactgcctgagcaagggagtaaacaagatttgcgagcagatggcatgagaccg

SEQ ID NO: 605814 - DNA, 198 bp, Homo sapiens
gtgtgagagagagtgtgtgtgcgcctcagtgtgtctctgtgtgtctgtgggtgtctgactgtatgtttctgtgtgtgtgtgtgtctgtgtatctctgtgtgtctctgtgagtgtgtgtctctgtgtgtgtgtgtctatgtgagtgtgtgtctctgtgtctctgagtgtgtgtctctctgtgtctgtgtgtgtctctct

SEQ ID NO: 605815 - DNA, 278 bp, Homo sapiens
cgacatctaaagagaccccatccatttaatcaagcagtcggaatggataggaaaatgtgtatttagaatatacaatggaatactatattagattcagaagagaaggaaatcttgtcattcgcaaccagcgtgaagaaacctggaagatactatgttaagcaacaataagccaggcacagaaagacaaataccacatgatctcaccttacgtcgacactctaaaaaagttgaattcctagaagcagagggtcgactgcttggattacaaggagggtacc

SEQ ID NO: 605816 - DNA, 634 bp, Homo sapiens
tcacctgaagtcaggagttcaagatcagcctggctaacgtggtgaaaccctgtctctactaaaaatacaaaaattagccgggcatggtgacgggtgcctgtaatcccagctactcgggaggctgaggcaggagaatggcttggacccaggagatggaggttgcagggagccaagagcgtgccactgcactccagcctggtcgacaagagagaaactccatctcaaaaaaaaaaaaattctgtagccttccggggtctcagggtcctcatctgtgaaagggggctaagcattaggaaccacctcagtggaatcggggggatatgatatggctgaagagccgggtccagagtaagtgagtgccccatttttaactccctttccctcacctttgagcttctatggcaattatggtccgaaaattctattgggcaatcatgaccatctcttctatgctatccaggatggtcacattatcttagattcaccatggttatcagaagttatctgtgtccattcatttattcaacaaacttttacctagtgtgggttttaagctggggcgaatggggggtgtggtggtgctgatgaccacagcaggggacgataaggggctgcaggtgctggtggaaggtgt

SEQ ID NO: 605817 - DNA, 395 bp, Homo sapiens
aaccgtgaaagagtgacagggacagcctataggaaaaccaataccacttaaaacaatctcctctctctctctctctctctctctatctctctctctatctcctctctctctcctctcctatctctcctctctctctctcctatactaactggtgtcaaattggaagtaatgatatgtattgcccacggaggatttttgtggggaaatatctaatataccttcagtcaactttaccacgaggtcctgggttcccacgatccgcgtctgaaagtgcgcgacaccgtttgcccctgaaactgcgcgcacatgcactcttccaccgctgagagtcgaagagcttttctttctgcaatgggagtcgggagcgatgcgctcgatcctgcccccagggcccc

SEQ ID NO: 605818 - DNA, 359 bp, Homo sapiens
  misc_feature (21)..(21): n is a, c, g, or t
tttttttgagacggagctacntctgctgcccaggctggagtgcagtggcaatcttggctcactgtaacctccacctcccgggttcaagcgattctcctgcctcagcctcctgagaagctgggattacaggcgcacatcaccacattcagctgatttttgtattttttattagagacagggtttcacatgctggccaggctgttctcaaactcttgacctcaagtgatcctcctgacctcaagtgatccaccaagtgaagtcacttgacctcaagtgatcctcgactcccaaagtgctgggattacaggtgtgagccaccatgcctgggcaaaggtagctatttctacaaagcagccact

SEQ ID NO: 605819 - DNA, 445 bp, Homo sapiens
  misc_feature (39)..(39): n is a, c, g, or t
tcaactgtctactagcatgtggcgacttcattacaagantgtgatggctatacaattatggctaagtatccacgcatcgatttctattttcactttgcaggcacatggtatttccagtgcgcactgcctagtcccgtagtaaagaacatttctcccaactctaaaaatatggtttaaaaaaaaatgtgtccagacccaggcggagcacggtggctcacgcttgtaatcccaacactttgggaggccgaggcaggtgggtcactagaggtcaagagctcgagaccagcctggcggaaatggtgacatcccatctctactaaaaaaaaaaataagcccagagtttagcggggagcgggggaaggcgcctgtaagcccaagcaagtgaggaggcggaggtctggaaatcacttgaagcggggaggcgggagtggccgtgagccaagat

SEQ ID NO: 605820 - DNA, 740 bp, Homo sapiens
gacagctacagcgagggcctcggccatccaagggtctcccaggtggcccacaccttccaccagcagaagccaatgagccgcgcagggagctgctgacacagccctgcaggcagaaggatcccgcaaacgtggcattacgaggatctcttcctctaccccaatgcaggggcctgaggaagctgcctgcccggtgtctgcccctgaggaggcctccccaaagcccagtccgttgtgtcaccaatcaaaggaaaggaagccgtccagcaagagatgacccagaataaccaccaaggaaagccatttcctccctgcccccgaaaatcccctctgtgagagaccgccagaaaactctggaggagcctcaaaaatgctccccgagagaggccagagggtcggcaaggcagttaaaaaagccaccttcgccaactgtgaactgtgtcgtcacctctgtggattgtccggagatccacgggtgatcctcaaggcccgtgggaccggcaaaaggcagcaaggatcactcaggggatcccacctcggggggaccagaggctacacggatccctgtggtggccaacatctctcaaagagcccctcagagccaaggcaccaaacgacaggaagggtcccccaccaggaaggcgagaggcgggcagtgcattgagggaccccaggcgccaggagtgtggcccaaatgtagggagagcctatcttccaaggggccaggcagaagcacagggtgg

SEQ ID NO: 605821 - DNA, 437 bp, Homo sapiens
  misc_feature (221)..(221): n is a, c, g, or t
agatttcccatctgacatggcagctcctgtgctctgggtgacttagctccgggttaacttccatcaggcccagtcctctcctccccagcagtgagactctagaggaagcccctcgtctgggacagtccttcctgcctacccgccacagggccgacctgaggcctcgtgcttgtctggggaggtccccgactgcacttgatgggcacgagggcaacacgacnacaagagaatgcgagctccctgaagctgccgcgtgacagtcaattggccaaaaaaaaaaaaaaaaccatcaatgcataaacccattacccaagtcctcctaaggaatgtgatttccatatattaaccaattttgtggcattaaccttttccaaagcctccgccaaaggtttaaatattaaagccatggggttttttccctccccacaatacaaaaa

SEQ ID NO: 605822 - DNA, 681 bp, Homo sapiens
  misc_feature (65)..(65): n is a, c, g, or t
  misc_feature (83)..(83): n is a, c, g, or t
  misc_feature (87)..(87): n is a, c, g, or t
  misc_feature (96)..(97): n is a, c, g, or t
  misc_feature (101)..(101): n is a, c, g, or t
  misc_feature (105)..(106): n is a, c, g, or t
  misc_feature (113)..(113): n is a, c, g, or t
  misc_feature (124)..(124): n is a, c, g, or t
  misc_feature (130)..(130): n is a, c, g, or t
  misc_feature (134)..(134): n is a, c, g, or t
  misc_feature (142)..(142): n is a, c, g, or t
  misc_feature (315)..(315): n is a, c, g, or t
  misc_feature (323)..(323): n is a, c, g, or t
  misc_feature (328)..(328): n is a, c, g, or t
  misc_feature (331)..(331): n is a, c, g, or t
  misc_feature (335)..(335): n is a, c, g, or t
  misc_feature (343)..(343): n is a, c, g, or t
  misc_feature (369)..(371): n is a, c, g, or t
  misc_feature (384)..(384): n is a, c, g, or t
  misc_feature (422)..(422): n is a, c, g, or t
  misc_feature (442)..(442): n is a, c, g, or t
  misc_feature (448)..(448): n is a, c, g, or t
  misc_feature (488)..(488): n is a, c, g, or t
  misc_feature (507)..(507): n is a, c, g, or t
  misc_feature (515)..(515): n is a, c, g, or t
  misc_feature (517)..(517): n is a, c, g, or t
  misc_feature (519)..(519): n is a, c, g, or t
  misc_feature (521)..(521): n is a, c, g, or t
  misc_feature (543)..(543): n is a, c, g, or t
  misc_feature (551)..(551): n is a, c, g, or t
  misc_feature (594)..(595): n is a, c, g, or t
  misc_feature (600)..(600): n is a, c, g, or t
  misc_feature (612)..(612): n is a, c, g, or t
  misc_feature (675)..(675): n is a, c, g, or t
attaagatcttatagcttatgcagttaaagaaaaactgattgagctacaggtttcctgtacctanactcaagacactctgtgnagancttccccannctgntggnngctgggngactgctaggnaggggnaggncccagagngggaagcatggtacctcctaggggcctcagagtgggtagcgggcttcaagacagccctcagggtgaacagagaggtcaggagtgtcggcttaagccagggcccaggggctacattccctgagatgagtcaagcccagccctctctggggtttccagaacaaaggctaggtgtngggagcancactnaanaaanggcagggngcatgtctctaggcattgctggaacnnnaggagactgtcanagtggtttgggtaatggttgtataatctgtggcaactnggccttcttgcatgaaagtngaaggntgaggatcccttatggaagaatcatgcaccatgactggantggactaaccagctccagnagctcttntntntnactaaagtaggcaaggaaagcncacttgtntcccacaccccactttcatcaactctgttcatgcaggacaaannaaggntctgcccaacanggatggggttatttctcagggcctaggtattgatgttaccttaattctttagtctggaagaanttggtt

SEQ ID NO: 605823 - DNA, 141 bp, Homo sapiens
catggagagagaggccaactcccgaacactctagtggtctgtggacagctctactagtggcaatggctcctaggctcctggacgtcctgctcctggctgggcctctgctctcctattggtgatcgtctagtagtctgacct

SEQ ID NO: 605824 - DNA, 125 bp, Homo sapiens
cagtgatctccgctcagctctgagactaggatacagatacatgccacttgcctggtaatttttttatctttattttgtgtagagatggggtgtcactatattgtccaggctagtttcaactcttt

SEQ ID NO: 605825 - DNA, 490 bp, Homo sapiens
tctagaggatctccattagagaatcacaatcaggattagtgggctcaatccaattctataacttttccctatacagagatgcccctaccgtatggtaattagccccttcaagatcatcttgtcaagctgcttgccagaaactaacccaacttctagaaagctccaactattagcaacatctacaggtcaaaacctgcctggtgactttcagatgccctcactcatgactgtattattcaccacctgttaattctcacttggccagcaatctctacacattcaggcacggaccttcgaggtgatatatctgtgactcctggccccctctgctggacatcctgagagaaacagcccaatcgccggccttcctgtgtcagtggggacttgccatagccacaaggccaggcaggcagagaaggaccgcaggaacaaaggcttagtttatgaaggccccacctcatccttctggagcagtgagaggcagagatta

SEQ ID NO: 605826 - DNA, 563 bp, Homo sapiens
  misc_feature (278)..(278): n is a, c, g, or t
tccagtgaatgtctggcacatggcaaccctcaaacatgtggttactcttggtggtatgggcataactcaggtgactggtacatttcagcaatagcattggaccaagtttaactcagcaagcaatatttccagttaataaggttctcaaaaactcagtgtaagggattataaactgtgcgtgaaagtgtaagaaatgtgacaccctcaaagtctcaccgtgggtagccttttagtatacagtgtgctatattgtgggtattatagtttatagaatgtgncatagccacgtgcatgtgtgtgcgtggtgcattattctcgtgatttttatttaaaatttaacaaagttgtgaaccgtgcaaacaaaaaaaacaaaacaaaaaaaaaaaaaacaaaaaaaaaagaaaaaaaaaaaaaaaaacaaaaaaacaacaaacaacaaacaaaaaaaaacagaggggagggggggggccgccgccacaaaaatatctctccccgcggggggggcgccgcccaagagtgcacggaccccgccaaggatgttatgctaataaaagagaggcccc

SEQ ID NO: 605827 - DNA, 338 bp, Homo sapiens
gctcgacctggaggtttagcctgattttgaagggtacttaagaacagagggctccagaccaggtgtggtggctcacatctgtaatcccagcactttgggaagcagaagttggcggatcgcctgagattaggagttcgagaacaagcttgcccaaatggtgaaaccctgtctctactaaaaatacaaaaattagccgggcgtagtgacacacgcctgtaatcccagctgctcgggaggcagaggcaggagaatggcgtgaacccgggaggcggaggttgcagtgagccgagatcacgccactgcactccagcctgggtaacagagcaagactctgtctc

SEQ ID NO: 605828 - DNA, 124 bp, Homo sapiens
gatcaccacccaacactgacgtaagttaaataacctcaaaactaaatgataaccatacacaacacataatatggacgaagcctaatctcttatactagtatccttaatcagtttttatggtgga

SEQ ID NO: 605829 - DNA, 892 bp, Homo sapiens
ggttattcaatactgcatagtacctacttactatcgactatcactgcaatacaagcgtaatcgagacatgcccagaggtctgcagaggtctctggtgcatctacagccattagggatgatcacacaagcgctcatccccggcccccaggtacctgatccgtactcataggacaatcatctttacagtatgctggtgtaattgctccagcttcctgctgtagaggaagacagcagccttcccagaaagagataggccttccagactctggtgttcaaagcttacagggtctctttttcattgctcagtcctatgtggcatggtgttagaagtggagcgaagcccttgtcctgtatgacagagtcctgatatatgcaaatgaaagtaaattctgatgctggcgccttcaagaacagcctacaaggactctgcctgatgagcaagagctcatcactcaagtgcggtcagagaagtgctccctgcaggccgcagccatcccattgatgcaaatcgacgctcatcaaacagagacctcctcctcccaagttcaaggacaataagcctctggttgaacggtttgagacattctgcctggacccttcccttgtcaccatgcaagccaaccttgtgcacttcccacgcaggactgtccagcgccattccctgcaagcctttgttctcctgaccgtggcctctcaaccatgatggctggtgtcaccaccccgttgaggtacaagctggcacagatagaccaagagtggcctcactggatacatcaagggcctcctatggatttcaggagctaaccaggctcttcctctgagggtctggggagattctgactcttaatctgtattgtgagaaaatcccaatcaaaatccatgatattatcag

SEQ ID NO: 605830 - DNA, 247 bp, Homo sapiens
catgagataaaccccccatctgaccagaaacatgccaatcctgagaataacctcccctccagccagagatattccaactctgcaataaaactctccttcacacagaaacattcgcagcctgcggtaggctcccccttcctaaacccttaaatgcccttagtctgtaagagaatgtccctgaccgaaatcggccagaagcccctctcaggtttattcccaaaataaacctgtctctgttgagccaaaa

SEQ ID NO: 605831 - DNA, 378 bp, Homo sapiens
gcgcttagacattgctgaaaatttagaagcatcaagacgatccaggaaaacatgacctcaccaaaccaatgaagtaaggcactagtgaccaaacatgaagagacaaagccatgtgacttttcagaaattcaaaacagctgttttgagaaatctcaactaaactgaagataaacagaggaagttcagaatcctatcagataaatttaacaaagagattaaaacaatggtgaaatatcaaagagaaattctggagttagaaatgtaattgacaacctggagaatgcatcagaggctctcaacagcagaattgatcaagcagaagaaagaattagcatgaagacatgatatatgaaaatatacagagttgacaaaaaaaaa

SEQ ID NO: 605832 - DNA, 236 bp, Homo sapiens
gtagataatatgctggtcagggctggtcttgaactcctgagctcaagtgatcttcctgccttggcacccaaagtgttgagatttacaggtgtgagccaccacaccaggccagagctatatttccaaagtctgctggccccaggcacactcctcatcaatttctcaggctgcaggcacaccctccccgttagctctcagtagtctcacgccgccccagagtggacatggtatgctct

SEQ ID NO: 605833 - DNA, 643 bp, Homo sapiens
  misc_feature (498)..(498): n is a, c, g, or t
  misc_feature (500)..(500): n is a, c, g, or t
  misc_feature (513)..(513): n is a, c, g, or t
  misc_feature (602)..(602): n is a, c, g, or t
  misc_feature (612)..(612): n is a, c, g, or t
tccctttgtttttctttttaacttggttttttccagggggggtttttgtcaaaatggcccacaaaggggggggtctcttcggtttaaagattttgggggaaaaaaaattttaaaccccccgggggggatagcccttttctccaaaattttccaagggcgccctttttgggaaacttgggaaaatggggggggggggagcttttttttttcaaaaaaaattgtttgtttggtggggggcccccaaatatttgtggaaaaaaattctcttcttttcttttttttgggaagaaaaaaaaacgcgcccgccccctttttttttttaaaaaaaaaggaagggagagggggcgggggggtgtgggggggcaaaacaacccagggggagggggtgttttttttttttttttaaataaaaaaaaaaaaaaaaaccccccccccccccccgttcccttaaaaaaaaaaaaaaagaagggggccccccgtctcttcttttttcttttncnaaaaaaaaaaaanaaaaaaaaaattttttttttttggggggggggggggggggtttttttttcttttcccccccccttttttttttttttcttatttttttnaagccccccncccccccccacggagggggggggggcgcgcc

SEQ ID NO: 605834 - DNA, 649 bp, Homo sapiens
  misc_feature (2)..(2): n is a, c, g, or t
  misc_feature (14)..(14): n is a, c, g, or t
  misc_feature (24)..(24): n is a, c, g, or t
  misc_feature (42)..(42): n is a, c, g, or t
  misc_feature (52)..(52): n is a, c, g, or t
  misc_feature (60)..(60): n is a, c, g, or t
  misc_feature (113)..(113): n is a, c, g, or t
  misc_feature (120)..(120): n is a, c, g, or t
  misc_feature (146)..(146): n is a, c, g, or t
  misc_feature (158)..(158): n is a, c, g, or t
  misc_feature (221)..(221): n is a, c, g, or t
  misc_feature (230)..(230): n is a, c, g, or t
  misc_feature (250)..(250): n is a, c, g, or t
  misc_feature (275)..(275): n is a, c, g, or t
  misc_feature (277)..(277): n is a, c, g, or t
  misc_feature (287)..(287): n is a, c, g, or t
  misc_feature (289)..(289): n is a, c, g, or t
  misc_feature (300)..(300): n is a, c, g, or t
  misc_feature (307)..(307): n is a, c, g, or t
  misc_feature (313)..(314): n is a, c, g, or t
  misc_feature (334)..(334): n is a, c, g, or t
  misc_feature (340)..(341): n is a, c, g, or t
  misc_feature (362)..(362): n is a, c, g, or t
  misc_feature (399)..(399): n is a, c, g, or t
  misc_feature (421)..(421): n is a, c, g, or t
  misc_feature (423)..(423): n is a, c, g, or t
  misc_feature (440)..(441): n is a, c, g, or t
  misc_feature (483)..(483): n is a, c, g, or t
  misc_feature (489)..(489): n is a, c, g, or t
  misc_feature (496)..(496): n is a, c, g, or t
  misc_feature (504)..(504): n is a, c, g, or t
  misc_feature (506)..(506): n is a, c, g, or t
  misc_feature (508)..(508): n is a, c, g, or t
  misc_feature (510)..(510): n is a, c, g, or t
  misc_feature (515)..(515): n is a, c, g, or t
  misc_feature (525)..(525): n is a, c, g, or t
  misc_feature (527)..(527): n is a, c, g, or t
  misc_feature (531)..(531): n is a, c, g, or t
  misc_feature (536)..(536): n is a, c, g, or t
  misc_feature (543)..(543): n is a, c, g, or t
  misc_feature (565)..(565): n is a, c, g, or t
  misc_feature (626)..(626): n is a, c, g, or t
tnggtttgtccaanagagtataancaagggttttttttcaanattaatcaanaaattccnccatctgcaaaagtaagcctatgccattaaatacagccaagatcataaaaaanaaatgtnattaggtctactgaatcttgagattnattcactagaanacacagggaaaaggaaaaagtttgcccttgtgaaaggggtgttttattttttagaagagcttntgaaagccncaaacatctgtgagtttccnaagagccgttacaaaggtattttananaatctatgcngngtcagccaggngtaagcngggggnnggatgcagagggtaaaacanaccccnncagacctgttgttattaaggntgacctttggaagtctcaaactgtaaccacaaagggngtcccccctgcattcatactananacacacatacctgaacnncctttctaccagtaacatttaaaataagcacacttaatactnccagtnacatgtngtagagtntncncnctttnactttttttngnaaanccaanaaatccnaccattccaataaaaaaaaggnaagggaatagctttaacacaccatttatgtttgctattacacttttccagtggaagaaaanaaagcccatataaaatttaaaga

SEQ ID NO: 605835 - DNA, 211 bp, Homo sapiens
cctgcctggaaatgtccttgcatttgtggcctccttcacagcctcctcctcaaaaaagcctttgcgagtgcacaaggagtgtgtgcaaccttgtgaaaggctgggaccacttgcccaaaatggggcccctcaggcacaggggtggggtcctactaacctgtttccccagctcccacacaaaaagcatttaaaataaacacacgtggatgga

SEQ ID NO: 605836 - DNA, 566 bp, Homo sapiens
ctagcttacaggaaatacgtataccaggagacaccgtatactgtgtaaaacgtattatggtggtcacagccttgaacgtgagagtgctgttggcacatagtgggtgtgaagcagaggtgcagctcaatatcctacaatgcgcaggacggcccccccacaacaaagaaggatctagccggaaacgtctgtagtgccgaggcgggggaaacactttgctggttgtgaaatcatccctggcatggacggcttctgttctccccagattgaggcttcatcttctcagaggtcctgctggctggggaaggactccccggcagcggagcctacccagatctggtggtgtcttttttttttttcttggttggtttttggaaacggagtttggctcttcttgcccaggccggagtgcaatggcttgatctcggctcaccacaacctcacctcctgggttcacgcgattctcccgcctcagcctcctgtgtagcagggactacaggcgtgcttcaccacacccagccattttggtattgtaagtagagatggggttcaccatgtagcacggctgc

SEQ ID NO: 605837 - DNA, 245 bp, Homo sapiens
tttagtattctcagtagagacagggtttcaccttgttggctggctggcttgaaactcctgactcatgatccgaccacctcgggctcccagtgcacactattttgtagtaagttttgaagctaggaagtcggggtcctccaactttgcttttcttctggaaaattttttactatttgggaccccattgcagttcccatatgaatttaaagatcagtttttcccataatttggcaaaaagaaccatt

SEQ ID NO: 605838 - DNA, 144 bp, Homo sapiens
acagaattacgcgtctcctgatccatgggccacagaatgaatactgctatctgtcatgaaaacggctattaatctcagagcgaggcatggtagctcatgcctgtaatcccagacactttgggaacgctgaggcaggcaaatccc

SEQ ID NO: 605839 - DNA, 918 bp, Homo sapiens
aggttgggccggcagtggtggtgccagagggctctgtgctctaggagctaagccagcagcccccgagaggggacttggctgggcctttcctatgggcaaggcccatgtgctcttcctgcccatcacagggaccatggagcagtggctgccctatggggctatgatccctaggcctgggcctgggcctgcctgtggcccagagctaccctgggagtgtcagtgctagcagcacagcatacctctggtggcaggagaagagaggcccagcagagcagcaggccaggccttcctgtccaggtctgcagtggagcactcggtgacccagagcagggacgggaggcatgcccgcagtgcctgccccaggccacaggaggacaggccgggacaggcctcagccaaggccagggctgggatcagccaatcatgcatgagctgaggccctggggccgtagcctgcccttctcaggtgccatataccggaccccagatcctgctcgcttggcctcactttttcccagtcatataatgtggggttcaccagccgcgctgcgggaatactttcccgcttctaaagtgggacttgctgttacctcaggaggctcctgtaggtgcaaagtatgagcctggtcagggctttgccaccgttgaagccctgcagaaggtgcaggtgttggggttctggggccacaggaggagagggcacttcccagcaggacccgcatgatgaagtctaggcctttagggggtcccgtccttcttcttccagtctgggggactgcactggtcttccaggccctgttttggagggtaacctgggttctggaagggtgcccttaactttcttccattgcctgttgccatggagcaggagggttccggtaaaaatttgccggggggggcagcccccaaagggggcgg

SEQ ID NO: 605840 - DNA, 163 bp, Homo sapiens
  misc_feature (163)..(163): n is a, c, g, or t
gagctcttaggagcccgtatggatgcgctctactagcgcttgaatactgactccctaaactgggactcctcaggcgtactctgagtggacacaacgatcctgggttatatctctctcccaattcattgttgagcgttacgaggtatccgagctcggaattcgn

SEQ ID NO: 605841 - DNA, 149 bp, Homo sapiens
agagtgaaactctgtctcaaaaaaaaaaaggatcaccagaaaatttcccatgggcagagttcatacccttgggcagagttaccacacagagttgccctgtcccaatgattcatgacagaattcccaatgtgacttggcctctcaccacc

SEQ ID NO: 605842 - DNA, 419 bp, Homo sapiens
gtcgacgagaaaataagggagtaagtgggaaggcaagggattgagaaggaaacagcagagagaggagcaggaggaggagcaggagcaggggcaggaggaggagcagaagcaggaggaggagcaggagcaggaggaggagcaggaggagcaggagcaggaggaggagcaggagcaggagcaggaggaggagcaggagcaggagaagaagcaggaggaggagcaggagcaggaggaggagcaggaggaggagcaggagcaggggcaggaggaggagcaggagcaggaggaggagcaggagcaggaggaggagcaggaggagcaggaggaggagcaggagcaggagcaggaggaggagcaggaggaggaggagcaggagcaggaggaggagcaggaggaggagcagacatccagagtcgacg

SEQ ID NO: 605843 - DNA, 402 bp, Homo sapiens
ctactactactaaataagcggcagtgcgacaggggccacagcacagcctgctggactcgggactgtcctgtcaactccagacaactgaataaacaggccgggtacagtggctcgcacctgtaatcctagcactttgggaggccgaagcgggtggaccacttgacgtccgtagttcgagaccagcctggccaacatggtgaaacccatctctactaaaaatacaaaaattagccaggtgtggtggcgcacatctgtagtcccagctacttgggaggctgaggcaggagaactgtttgaacctgggagacagaggttgcggtgaaccgagatcgtgccactgtactccagcctgggtgacagagtgagactccgtctcaaaaaaataaaagtcgacgcggccgc

SEQ ID NO: 605844 - DNA, 124 bp, Homo sapiens
cgacgtgacttttctggaacgctacggactactctggaacgacgctggacgacttactgggacacgggggactcctctacgacgtcgaccctgacggactgaacgcttggaccgtggccgatcg

SEQ ID NO: 605845 - DNA, 465 bp, Homo sapiens
aggatatcagacagctctggatataaagaagaagataggacaaaaactggaagattggttgaaagtatcttcatgttatatgccaagtccatgcagctaaacaactgtcctctcctgctggaggctacaggtttattctctggagtgtaaaatagaggatctctgggctggtagacagcaggcacagatcgaggtaaggaatcacatcagttcctgccacttccctccaaaaaaagataaaaatattgacaccaggacttcccccaatgaaatggcccagacagaatatcaagcggtaaagccaccaaccaactactcctctccatttttagtgtcctattcttaactatgagaaaacaaccaagggtcacaaagcatcaaagaaagagacaaaaacaaacaaatagataaaagcagcttttatgcaacagaggctatgcaagtagaagaaaactttaaaaaaaa

SEQ ID NO: 605846 - DNA, 1640 bp, Homo sapiens
  misc_feature (597)..(597): n is a, c, g, or t
  misc_feature (1110)..(1110): n is a, c, g, or t
actcctgtctgtgttgtatctcacttcgtcggagcatcctatttgtaagtcactacgtcttttcagatcgatccgacgcgggagcgacttgtgttgttcggctgcgcctctttttttgtgcgagaaccgtcgccgtggtgtggtttttagtggtgctcatacgttgtcttccacgacgaggggtgcggttgtcttctcccccccgcgaggggttgtatagcgtccacatagggctgcgttttttttctctcctcgccttgggtgccgccagctggacttcttcctccgctgagtgtggcgcacagcaggctactccttggtggtcggacaaatttgggcccacatgctgtttgtgaggagttctcctctctcctacccaccgtgttgggccgaacgatgcgcgtcccagattgtttaaatgggctcgtccccgctgagtttggccccttcttttgttgtatgccctccccccttttggggtccccgcaaactggtgggggtgcccctacaataggggagtgaattttcttcggccgtgtttaattattctatttcttgggggcgccccccccagagttttttgtgcgcgcgtccccncttgtatatgggctcctaacataggtcgtagtttttacttgctccgcaaggcgtttcccaaagtgggacgtgcctcctcttcctaatggatgaagtggtcaattgctttgtaatcacacggggggtgtttctatacgccacatttgcaaattgtgtccgaaagacaccaaaacgtgggcctttttaaccgtcagggtaagggttttccaacaatgggaatcctcttctcttgtgtcaatacacccccttggggccaagataagaaaaatctcgtgggggggggcccaacaattgtcgccgctgtcaatattctcctccccttgtggagggggccaaacgaccactccttgtgtggagaacccccctctttatgtggtcccccccttgctcgtggagagcacatttttggacacaagctctccacacacaccttgtccctctgtgggggtttctcacagaggttgtcgccccgcatgtctcgttctcacgagctcgcgagggggggctttgtgnggggagagatcccccacacacacagaggggagaggcgcaccacatcccttctacaccccacggtgtgccacacaccacgagccctcccacacccccgtggagatttctccctttgtcccctctcacttccctctgagcgcgttttgcgcccttctcccacagcgtggccttttgagatcttttagagattcctcttgggcttgtaagccaggacccaagattctccccccagagcgcacaccccagattgttggggggacgaccctggtatattttttagacacaacaatctccccatatctccccaccatggtctcctctcccccttctcccaagggtgccaaattttatacccgccaatatgtgactcttgtgcgttgtcatgtttatgttcttgtgtaataaaatggagaatgtttgtggaagatgaccccctcccctgttgcccgcgctggttctcttcttctcccttttccccctggtcacggcgtaactcatggaagccaggacccgtaagggacctttgatta

SEQ ID NO: 605847 - DNA, 200 bp, Homo sapiens
taacacggtgaatttgcccaccaccgcgccgtgctaattttttttttgtattttaagtagagacggggtttcaccgtgtaagccaggatggtctcgaactcccgacctcgtgatccacccgcctacagcctcccaaagtgctggaattgcaggcatgagccaccgcgcccggccttgaacacatctttatctgaaatcta

SEQ ID NO: 605848 - DNA, 507 bp, Homo sapiens
tagcagagtacacaagcactttagcaagcacttattcaactgccccatttaggacttgcctaacattctccattaacagttaaacatagtccaggattaaatggtgtttacttaattttccagaggtgacatactgcctctggtatcaaattggattaaacctgataactttaatgccattggcttctgttggggaggaaaaattttttggtatactctagagaatagattttttactattcactaagggacagaacatttatcaaaatcatctgggtgatttgaaagggagaaatatactactttttccttgccagaagcaggtccagggcattattagcttgtggtaacaattgaataatccagcaatgctgacttatttgagattcagcctttaagcccctgctgtgtggtaagtcctgtccaatctgctggcatgctgaagcagggagcctgcagaggctttggaaggaaaaaccatttaacacgtctcagatactaaagact

SEQ ID NO: 605849 - DNA, 332 bp, Homo sapiens
taggaaagaaaaagaagagagaaagaaagaaagaaagaagaagaaagaaagaaagaaagaaagaaagaaagagcaagcgtgcagacttaaatgtccctgtctgacagctttgaagagagtggtggttctcccagcatgcagtttaagatctgagaacagacagactgcctcctcaagtgggtccctgactgccaagtagcctaactgggaggcacctcccagtaggggcagactgacaccccatatggccaggtgcccctctgagacgaagcttccagaggaagaaccaggcagcaatatttgctgttctgcaatatttgcttgttccgctg

SEQ ID NO: 605850 - DNA, 102 bp, Homo sapiens
caaagttttaagtagcgtgttttagtgacgatcgcatgatgtcgagggccggggccccaggctggtatctgttcacgccgagagggcctgagagtgaaggat

SEQ ID NO: 605851 - DNA, 449 bp, Homo sapiens
tctactcacattgacaaaattatgtgagaatgataaacactgattctcaggaaaaaattattgatgagcacaaaatagattatatgatggattgtttgttagggtgttatttatgatggtgaggaaagttaagttacataccaaacaatagaatgatattaataagtataaatccataatataaaatattatttagatatttaaataatcctataaataaacatatactgccacataaaatgtgtgtagaatattacttaataaagtaatttaaatagataatatattcatctagtaagatcccatttatattaaatgtatgaatgtatatgtatatatgtgcatgtacacatacacatatatacaatcatgcatctattaatgataagggtaagtttggagaaagatgttgttagattatctcatcattgtgtcacatcagagtgcgc

SEQ ID NO: 605852 - DNA, 110 bp, Homo sapiens
cagtctgagtagctgtgattacagatgcacacaccatgcctaggctaattttcgtattttttggtagaaatggggttcaccatgtaggccaggctgctcttgaactccta

SEQ ID NO: 605853 - DNA, 247 bp, Homo sapiens
gtgcacagagatggacagaagttcaaatccgaccatcatgtggatgttggataagagaatacttctgtctccccacctctaagttgcgcgccactcggggtactcgggcgcgaattcgatgtccgcgtcatagctttatcctggccggcgtgcaacagatggacaagttcagaaatctgaccaagcatgtggatgttggataagagaatactctgctcccgctagcctctaagttgcgcgccaatcg

SEQ ID NO: 605854 - DNA, 406 bp, Homo sapiens
  misc_feature (367)..(367): n is a, c, g, or t
tttatgcttattacaggaattagggaccagttgtgataagctgctgcaagatttgatgaattttattaagggacgtagtaaaccttcatgggatgcacagatcaaaagctattggctgatactgggtgcaaaatgtctgtagataacaggtggcaaaagtggcaagacatggcgcttccaattaatgccacataaatataatatcatgttagtgaggctaaactcaaaatgggatctcccgaagactttgtaacactgcttggtgctacagctcttcctagattgacacctccttgtccttgaagaaatgggacactgtgacagtgttacctctcagaagttggagatactcaggtggtggttttanagcatgaaaaggaagatggcgccatttctaccatagtac

SEQ ID NO: 605855 - DNA, 334 bp, Homo sapiens
ccgttgtactttatctgccgccttagcctcccaaagtgctgggattatatggcgtgagccaacacgccctggcacttcttgtctttgccacattttttagatatgtatttgtgttttatggggagcttaatttgctaatggaatctctgttattttcctaacatgcccggctgatttttgtattattagtagagatgggcttacactacgtaggagaggctggtctcggactcctgaactcgtggttcgaccccctcggcctcctagagtgctagggattaccggcatctgtcaccgcactcggcttatacctgtgcaatactatgatagcatg

SEQ ID NO: 605856 - DNA, 167 bp, Homo sapiens
actttctgaggatccccagtcagtttttctagaaggcctcgtaagtcgtcctgtgtgctgggagatcaagttcacagcatcagagttaagttctgtaacatcatgcttccgagatgaggatgacatcaatgatgtgacttctatggcaggggtcaacctatatgaag

SEQ ID NO: 605857 - DNA, 99 bp, Homo sapiens
ccaaccactcacctactccagcaacctaagcaaaccattaccaaataaagtatagcgtagaattgaacctgcgcaatagttatagtccgagggaagtgg

SEQ ID NO: 605858 - DNA, 106 bp, Homo sapiens
aacattccttggaacaatttgagaaatacttagcggttcaaccttatgagtatgaatgctcaggaaatacgcactaggatatgtactgtggcttgatttgtagtag

SEQ ID NO: 605859 - DNA, 164 bp, Homo sapiens
ttgctctttgctgtcaagacagaaaatatcatcataagaaaactacaggccgggcatggtagctcatgcctgtaatccaagcactttgggaggccgaggcaggcagatcacttgaggtcaggagttcgagaccagcctggccaagatggtgaaaccctgtctct

SEQ ID NO: 605860 - DNA, 365 bp, Homo sapiens
ctggcggtgctatttgctgaggaagggtgataatcatgtggcaaactcacatttgcatgactggccgtgtaaaaacatgatagataacttttgtcaacatatctttaagagtttatatcacgcacagtttaaaatcatgatgagatgctgatggttggactatattcatgtctcgtatgtcgcaccatattttggttcacagtttatccatgatttagcatgccaagagaacatctcagtcagtaagagaacatctcagtcagtgtcaccttgagaagagcatcaaaagcagagggagcagaaggaggactgtctgggcttggagactcggcgcacccccacactcccttgcattctcctcagga

SEQ ID NO: 605861 - DNA, 911 bp, Homo sapiens
  misc_feature (589)..(589): n is a, c, g, or t
tcagatagacgtggggcctattgaactcaatttgcttggaaactgcccaggaaaggctgagagcctgaaccccctccttgggagcagctaaagggagtcttcaccatgggtgaggtgacagcagaggaggtagaaaagttcctggattcaaatattggctttgccaaacagtactataactttcactaccgggggaaggtcatctcagacctcctcggggccaaggaggcagccgtggacttcagcaactaccacgatgtgaacagcgtagaggagagtgagatcatctttgacctcctgcgggacgttcaggagaacttacaggctgagaaatgcacattcaatgtcatgaagaagctctgcttcctcctgcgggctgaccgcatgagcctgttcatgtacaggacccgcaacgggatcgccgagttggccactaggctcttcaatgtccacaaggatgccgtcctagaggactgcttggtgatgcccgactccgagattgtcttccctctggacatgggtgtcgtgggccacgtcgcacactccaaaaagattgccaatgtccccaacacagaagaggatgagcatntctgtgacttcgtggacaatctcacagaatatcagaccaaaacatctggcttcccccatcaatggaatggcagaaggatgttggtaagcccataattcattgctggtgaattaaattataattgaacccccctttccccgaagaatacaaaaatcctttcccgagtcccatatctttggaacgcggtcccaagggtttcccgaggtctccggacttgaaatcgcggccaattagcgggcggcacgacgtcggcgacgcagaagagcacaagggcctaaagcggcgttctcgcgcacccggccctacccaacggttctgacgg

SEQ ID NO: 605862 - DNA, 114 bp, Homo sapiens
tatccccaagaactctggcgaaaatcattttaaaagagttatcctaagttaatctaaccttggaggtagaacagttatgaggcttctagcaatcgactaagacagctccatggg

SEQ ID NO: 605863 - DNA, 1170 bp, Homo sapiens
ccggtggttcttttcctagtggtcgtcgcgttctcgcccctgtacgcttctgtggcctgtgcgccgccttccttcgccccccctgtcttctctgttgctcgggggatgtgctccgctactctgctcttcctgtgtctcttctgcctaccataggcctttcgcctttccgtggcgatggtcgcttcttcttctcgtttccactgcgtctctgcgctgcttctgctcctcgcgtcccttctctatcgctcttgcgaagaatttccgcgcgttgctgccccggtgcttctcgttttctgtgtcttcctgttgtcagttgtggtcccttatgtgtctatgatgtcttgcttctgatctctttttccgctctttcctctgttgttgatgtgttatgggcaccttctcttgttgtggcttcgctttttttgtttgtcaacttcattttctagtggtttccttgtatactctttctgtggttgttgttcttttatatctttttttttttcagatgtcacttcacttttatatccgaacaaacacgaatctcagactacctacaattagcttcagagttgatattatatagaaattattccgaaaattattcttgtcacagagtaactactatatcccacatgaaaaagggaagaaatcccacccaatcacgagcaaaaggcatcctctgtatgctttccgctggcaatgcgtagctttatgctattctcaaatatttgtcatggcgttcagttctatccaccgcttcgtccaatggagttcattctagatttcttggagaaccatatgagactaatgacagcatctgggacacacggacgtatcaagttcatggtcggacattcaatattatatataatactcaggtcatgagaattcactgtgctgagaggatcccgaaatgcatttctaacaaagcattagtcatgcctcaaagactgccctttgagttaggctcagtattattatccccattttagacagaacggaaaactgaggcacctgtactagttaagtgacatgcaccagggttacagcacagcaagtgcagtaggacaccagtggttggacgaggccgtggccgtaaccaccagcataacatggcacacctcgcttttttaaccattcatgatgacctatattgagctacacatacat

SEQ ID NO: 605864 - DNA, 612 bp, Homo sapiens
aggagcactggccgacttggagaaaacatggctgacgaaggagcggttatgattaaggaacgttattgagaccaggagcccctctggatcagtagggcaccattgaaggcctgcaacgagccccgtgagtacggtttaatttccgatctgatcgattggaaaagatattgtacctaatcggctggacgagcgtgagaaaagtccttcggagccaaaggttacgccgatcaacgtattagcaccggctccattggaggaaggcgagtttcacatggcccacatggatgtacttacagcgggatcaggacgtgcatcgacgtaaaaggggagcgccactgtacatgtactaaggtaaccgcggaaatacgagaagaatcatttcatgtacgacccggaaacggttgtggcagcacccgttccgaagacccggtgactacatccgcacggcgtcaaagcctaaactcacatcgattataaaagttcaaagcatacacctacttagttggagccgaactcaaggtaaagaaggcggacggaatccgcggttgaccatgatccggatacagtgcattacctgggtaaggttaaattaactgttgatgtttccgacag

SEQ ID NO: 605865 - DNA, 839 bp, Homo sapiens
tcacagaaaatgttctccgctcccagacatggtgtccctcgtgcttcctgcctcgtgaagcgcagcagcatggcatctgtgggaatgtgtgaatgatgcttccctaagtgatgaccctgtccaagcctgtgtccacctcacatgccttcctgtgtgatacaatggcttgtgcatgacttcacatctgtgctgtggaatgtctgacatgtgcctggtgaatccaattcgtgaacaatgaatggatgtgttgtgcttgtcatgtgcgtgtgaccatttgtaggatgacaccacccatggttggtttgttgtggcatatgttgtgtgctacgttgagaaagaccgcctctgatgtgcctcctgtgactctttcacaatgaccttgtcattttgcttgatgcaccactcagttgagttgaattgcacatgatgtgctgtttcgtataatgaactatgtgcaatagaactctacacgacaagacatgtgccttcttagccacatgtacttgcaatggaagagtttgtgccatgtgattgaggtgagttgtgcgaacgaagtgacacgccttggactgaaacgggaacctttcaagcatgacacttgataagaaagtatctttgctcaatgtcagtccctgtcgctccatttggccctcaactacccccaagaatttgcttgccttgcatttaccgtccttgcgggccagtgagcagacattcgacccaaaccattgacttgtgagagtcccatgtgttggaacttggatgggccacttgtgtggccgacgaaacgcctaggaactttgtggccaccgtggataagtggcgtttcacggcactgg

SEQ ID NO: 605866 - DNA, 134 bp, Homo sapiens
ggggaaaaaggggggggggaattttggttggccccgttttaatttttttccaaattttgggggggggggggcttttcccccccggttttttttttggggttttaaaaacccccggcgggcccctttccccccca

SEQ ID NO: 605867 - DNA, 271 bp, Homo sapiens
ctctagaggactcgctgatcgcttagcataagctaaactcacctgagttgtaaaaaactcccagttgacacaaaatagactacgaaagtggctttaacattatctgaacacacaataagctaagaccccaactgggattagatacccccattatgcttaagcctaaaactcaacagttaaatcaacaaaactggtcgcccgaacactacgagcccacagcttaaaacctccaaggacctggcgggtgcttcatatcccttctagggggtta

SEQ ID NO: 605868 - DNA, 1770 bp, Homo sapiens
  misc_feature (376)..(376): n is a, c, g, or t
  misc_feature (488)..(488): n is a, c, g, or t
taaaaggtccagttttttttggaacttgtttataaaagagaggtttagtcaaaaagaaccaagagccccatgttctatctatcagaactccctgcggaattctttcttttcttggtctcccatcttttctttctccctcagctcggggagccagcagccgagggggaggtggggcgaggacacctctcctgttgcgtggtgtgcagccaccgaggtgtggcgtggacagccgaggtctctcccgcggggccctttactgtgtgcagaagtagaggtcctcccaagagtgtgtgtgcacgttgttggccgaggggctcttgtgttgcaaaaacaagagccgcgagagccaccaaaaagagagggtctctccacaaanctgtttatcaccgcgccgtgcgtgtgggcatataatagaagtgaggagaggggcaatttgatgagatctctttataatctctttctcgcaggagagagctgtgttgctccancactctctatctgcgcgctagcgtgctggcaagacaatgtggagggcggccccagaagaagattaagaatagttagcagagagcgagagagccctcgtgaggaggagaacacagagagaagcggcccagaagtagtggcgacgcgcgcgagacagaccagtcatagattgagagcagcaagtaggagcagcgactatacagccacgggagaaaacacgcgccgcgggtcgcaataaaagctctacgacgcccggaggagagttcgcgacagggttgcggagggggggcgctcttcaacaacccccccaaagaaggaacgacaacgacactaataataaaaagtaatcatccccacaccgagagtaatagagagcaccccgaagagcgacccaccccgttgtagtgggggaggccccacagagcacactcaagggcgtcgtcagcagcaaaagtatttcccataaccttccacaaacatcgggcgtacggatagaagcaagggggacaaacaaggagcaacataatacaacgaggaagaatgcaggcatctcccccacccgcagtgacaaagcagcaaacaccacacaacacccccagaggaagaaaagcccccccccgagaggatgtagtagaccacgcaagaagaagaacacgattttcccccccgcgcggggagcaacacccacaagagtgagagacacaccttcttgactttgggggacggagagcaccccacaagagacaagaacacaacagtcgtgtggacgcactctactgctggcggtacacaacaagccggctcggtgggggagacagaacacaacctccgactaaaatagtgtggctacgaaaaccacacacaggaacaggcgtggggcagcgataaaacgagcgacgaaacaacacacgagagaacacgaaccccaagagggagaccccgatgtgacgatcacccactcccaaaagaagatcgttatctcataaaaccgtggtgtgggcgacccagaaaaacacgcagaggctcattcatacactggcggaaaacacaaagacacctctgagtgatccacttactcccaccgacataccagcaagaatgtgggagaaccccaacaaagcaaagtgatgggacgacaacggcaccaaccgaccgcctccaaaccagggagagaccaagcgcgcggatgggtgcagcacacgaacaaccaccaacgagacaacgcactgaaaagagaaagattcgtgacgaacgagaacccgacaaaagagataggtcaaagaa

SEQ ID NO: 605869 - DNA, 1163 bp, Homo sapiens
  misc_feature (235)..(235): n is a, c, g, or t
  misc_feature (498)..(498): n is a, c, g, or t
gacgcgagctgactgagggccggagcggagcgatggcgacgcggggaggggcgaggtgatcgcggccggtgtgctgggtggccacctgctcccctgagcacctggccccctgctcctggtggagcagagtcctggagcgggatcctgctggcccacaggttgcgaggggctggtgttgaagaatgtgtgggcggaacaattccttggtcactttaacctaggaaggaatggtccntccacggagaagcttggcggccttaccagggatcgggcggggggccagcaagcggggctcccgggagtgggatggtgacccgtgataagtactggcaccgctcttacaacagagagtcctcagatccagacagcccaggtgcttcgtgtctcgaccgtgcagctttgactaaggagtgcaggactcatcgtgaggcgtatcacttgctccacatgcgcctggggctgtggtccgcgttcttggttcacaaggaaagtgatccnttccaagcgtgcgagttcaagtactacccaactgtcgtagttgatacccgtaattggagcacaacggtcgtttaagggtgccctctgggaccagggacagacgctgtgtcgatttgagcaggatggattctatgagtggggagcgatgtcaggggaacaaaccagagggagcatactttcatctatgttcctcaaatcaagacggagaaagtcaggtagcattggttggctgcagatagtcctgagcaacctgtgacacaagtcttgggacaactggaaggctggtgccatgtgcgcgatctttgactggtgggagcccacaagggaggacgatgtcatgtttcctatacaatatcacaggggattcctgaagggctgagtgaatccccccaggatggctgcccctaaaggaaggaggcgacaaccggccgcgtgggaaaccaagccaaggagaacaagaataacccccacggagagacatccatacagtgagccccctgggggaagcaatcagagaaaccatagatgctgatgaacggggtacagcgaaacagaggccgcacaagctgtagtggagggccacagaagaagccgaggcagtgacccgcacgaacgtcccaccggacactgaggcagggacccagcagccagaattgtgcctcgcg

SEQ ID NO: 605870 - DNA, 1020 bp, Homo sapiens
  misc_feature (109)..(109): n is a, c, g, or t
  misc_feature (171)..(171): n is a, c, g, or t
  misc_feature (686)..(686): n is a, c, g, or t
  misc_feature (937)..(937): n is a, c, g, or t
  misc_feature (941)..(942): n is a, c, g, or t
  misc_feature (954)..(954): n is a, c, g, or t
  misc_feature (959)..(959): n is a, c, g, or t
  misc_feature (973)..(973): n is a, c, g, or t
atcgctatagttagcacaactgtggaaaccaaggaccctgagaaggaaatcagaccagctttggagctcttggagccaattgaacagaaatttgttagcatcagtgccncctggtaccaaaagacttgggaacagaaagccagatctttatttcccgcacatatgatgccnaccactcatttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttcctagtgaagttaaacaaacatggggataccgacacagacaacttgagacagtttttcttaatcttttaatcaggtggtagctatgtgtgctgcttgcgtgctcaagagctgggatccattacaggttgggtgttgtcatcttgtgcctcttgaggtntcaggagattctaaattgtgaattatctccagcggtttggggacagcattccggaagttttccccttagtgacttaaatgttttgggtatttagtgctcacaagtgttatgtggcagggcccaaattagcattagccacaagtttgggcttatatggtgggcataaaattctaacacaaacccccagaacattagggagtcatttggagaaaagcctgtatgtggggttttaacctaataaagttgatganacannaggggacaggangcgancataaagcggtcangtgtagggcatcttggaatctcaggcgtggcttcttcaggtggacca

SEQ ID NO: 605871 - DNA, 152 bp, Homo sapiens
atcctgcagttgacctagagatcccactctgaacactgggaacagtgaagtaaaatcttgtcgaacactgcaccatgaaccttagagtgaagctcttcctggaggtacaatgtggagcttctaactgtcatgaatgtgtctgtcaaggatgt

SEQ ID NO: 605872 - DNA, 319 bp, Homo sapiens
ggccctggtgggggaaaaccaccccccccattatgcgggagaacccagagctggtggagggccgtgacctgttgaggtgccccagctttgggcctttgaccctttgagagatgatgtcctgcccaggcccgatggcccctagggccctgcaagcaactttgctttgtggccaggccaggattcctggagctggcctgagaggggtcaatgggccctcgggggcccaagtgggggtttcaaccctttccccccccccccagccccctgccctgaaatgagacttttttttggaatttttaaaaagaacagagaggcccca

SEQ ID NO: 605873 - DNA, 950 bp, Homo sapiens
ctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttcaccagcgtagagtgcttctgacgcaagacaacactgaaaaaagttattttacactcaaaaaaaaaa

SEQ ID NO: 605874 - DNA, 959 bp, Homo sapiens
  misc_feature (378)..(379): n is a, c, g, or t
  misc_feature (386)..(386): n is a, c, g, or t
  misc_feature (389)..(389): n is a, c, g, or t
  misc_feature (391)..(391): n is a, c, g, or t
  misc_feature (396)..(397): n is a, c, g, or t
  misc_feature (399)..(399): n is a, c, g, or t
  misc_feature (401)..(403): n is a, c, g, or t
  misc_feature (409)..(410): n is a, c, g, or t
  misc_feature (415)..(415): n is a, c, g, or t
  misc_feature (427)..(428): n is a, c, g, or t
  misc_feature (444)..(446): n is a, c, g, or t
  misc_feature (450)..(450): n is a, c, g, or t
  misc_feature (452)..(453): n is a, c, g, or t
  misc_feature (458)..(458): n is a, c, g, or t
  misc_feature (460)..(461): n is a, c, g, or t
  misc_feature (463)..(463): n is a, c, g, or t
  misc_feature (477)..(477): n is a, c, g, or t
  misc_feature (482)..(482): n is a, c, g, or t
  misc_feature (488)..(489): n is a, c, g, or t
  misc_feature (494)..(495): n is a, c, g, or t
  misc_feature (519)..(519): n is a, c, g, or t
  misc_feature (521)..(521): n is a, c, g, or t
  misc_feature (524)..(524): n is a, c, g, or t
  misc_feature (530)..(531): n is a, c, g, or t
  misc_feature (538)..(538): n is a, c, g, or t
  misc_feature (543)..(543): n is a, c, g, or t
  misc_feature (551)..(551): n is a, c, g, or t
  misc_feature (554)..(554): n is a, c, g, or t
  misc_feature (557)..(559): n is a, c, g, or t
  misc_feature (563)..(563): n is a, c, g, or t
  misc_feature (568)..(568): n is a, c, g, or t
  misc_feature (571)..(571): n is a, c, g, or t
  misc_feature (902)..(902): n is a, c, g, or t
  misc_feature (904)..(904): n is a, c, g, or t
  misc_feature (907)..(907): n is a, c, g, or t
ctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccaannaaatccnagnanattcnnanannnaaatannaaccnaaaaacccaaannataaggaaaaaaaacnnnaaanannccaanannanccaaaaacctaccnacaanaaaacnnaaaanncccaaaaaccttaactgccaatantnatnaataannaaaaaanttaanaccccaanaanccnnnattnacaanganaaagcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgngnttntgaaccgcaaggagccaaccctgaaataaaatagtttttttttcccccccca

SEQ ID NO: 605875 - DNA, 959 bp, Homo sapiens
  misc_feature (902)..(902): n is a, c, g, or t
  misc_feature (904)..(904): n is a, c, g, or t
  misc_feature (907)..(907): n is a, c, g, or t
ctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgngnttntgaaccgcaaggagccaaccctgaaataaaatagtttttttttcccccccca

SEQ ID NO: 605876 - DNA, 101 bp, Homo sapiens
ttgacacccatcgcagtgatggtcttaccagtcagagtcttcacgaagatctgcatcccacctctgaagaagggagcaccagagtgcaaggtggcactctt

SEQ ID NO: 605877 - DNA, 197 bp, Homo sapiens
cacttcctgagtagctcggactacaggctgtaccaccacgcctggctaatttttagattctttttcgtagagataggttcttgttatgttgcccaggctggtctcgaattactggctttgagcagtccaccttccttgtcctccccagtgctgggattgtcagcatgagccaccaagcctggcccagtacgcaatac

SEQ ID NO: 605878 - DNA, 427 bp, Homo sapiens
  misc_feature (91)..(91): n is a, c, g, or t
  misc_feature (121)..(121): n is a, c, g, or t
gccccctttacccccgccaccaccacccctggtggggggtggtttgggggggggggttttattttgtggcgccccccccccctttttaacncccttcttttttttgagggcgcgggggggnaaaaatatattcgcccccccccggggggggcccttggggggggcccccctttttttttaaaaggggggggggcccccccggcccccccccttttttttttttttcgggggagggggggggtttttccccggggggggggaaaaactccccggttttcccgaaaaaccccccggggggggggcccccccccgggctttttttttttttttttttgggggggggggggggacccccttttttttttttccccccccctttttttcccgggggggggggggttttaggtttttgggggttcccccccca

SEQ ID NO: 605879 - DNA, 172 bp, Homo sapiens
  misc_feature (22)..(22): n is a, c, g, or t
  misc_feature (36)..(36): n is a, c, g, or t
  misc_feature (147)..(147): n is a, c, g, or t
  misc_feature (159)..(159): n is a, c, g, or t
atttttacaaacaaaacaaaanaaaattagctggangcggtggcacgtgcctgtagttccagctacttggagggtactgaagtgtgggaggattgcctgagcttagggagtttgaggctgcagtgagccatgatcatgccagtgtantccagcctgganaatgtagtgagac

SEQ ID NO: 605880 - DNA, 894 bp, Homo sapiens
ccagctcctgcctcccggcggcctctgcaggcccaagtcgttctcaagtcggcttccccaggcccagctccggcctcttggcggcctctccgggtgcaaaagttcctcgagtcagcctctccaggcccagctcctcctgcctcccagtggcctctttcggcccagcccagctcatgcctcccggcggccttcccaggccccgcttttgactttcggtggcctctgcaggcctcgacaaggcccggcctcctgcctccagaaggcctgcactaggcccatgtctctgcgctcagcagcggactctccatcgcccatgcctagctctcgccgtcactgtcggcctcccgagtccaacagctcctgcctgctcggccgcttcggcaggcccagctcccgcctgccagtggcctcttgcaggccctatggggctgcattgcctgcacagacagccgtttccaggcccagcttctttcccgtgtcctggcggaccgtctccggtgcccagataacctcgctcgaagtctggcgctctccagaccgcatctatgcagccgtcccggtcatctctctccggagcccagactctgtccctcccgtgctgcgtctaccaggcccgactttcggcctcccaaacaaacgtctttggactcagctcctgcccagcctcccagcggccctggtagggcccacagcttcccgaagccaagctccccaggcccagctcaggcctcacggtggcctctccaggccagctccctgccctctgatggcatctgcaggccccagacggcctccggttggtgggctcctctaggccaggctttgggcctcctggcggcctctgcaggccaacaccgtcctgaaagtcggctctccaggccagctccggcctcc

SEQ ID NO: 605881 - DNA, 141 bp, Homo sapiens
tgattaagacttttgggtgctttcttgtcaacacaatcattaccgatcgtaacgacctacatatggcagatagcgtgtgcatgtctcagtgactctatgcatggggtcaccgaaatgtgacaaatatgctgatgctccttg

SEQ ID NO: 605882 - DNA, 884 bp, Homo sapiens
  misc_feature (619)..(619): n is a, c, g, or t
  misc_feature (642)..(642): n is a, c, g, or t
  misc_feature (644)..(644): n is a, c, g, or t
  misc_feature (699)..(699): n is a, c, g, or t
  misc_feature (709)..(709): n is a, c, g, or t
  misc_feature (714)..(714): n is a, c, g, or t
  misc_feature (716)..(716): n is a, c, g, or t
  misc_feature (835)..(835): n is a, c, g, or t
tgcctggggggcaggattaggaatctcttcactaccctgattcttgattcctgcctctaccctgtctgtccctttgtctttgaccagatctttctcttaccctgcaacgtttatctatctttcccctggacaggcagcctcctttgtgtgtattcagacggcagtgattgagcttgctcgtccagtgcagctccctcctgcgcacagaaatgctcagggtcactgaaccactgcttctcttgtgaaagtagagctagctgccactttcacgtggccctccgacgagtgtactcgctagcctactacgccctgtgtcttcccctgtcctaacagctgatggctcaagacacaggctgggcagatagccctgcccagagaatcatctctggcccagaaaacgcctcttctactccctccctctctcatgaggcacagcccaagccaagcgctcatgttagagccagtgggccagccacagagcaaaagaggcgtttatttgtcagtcccctctctctgggtcagaaccagatgggcatgctgaatgccccctgcttacttgcgtgagggtgccccgcctgagtcagtgctctcagctggcagtgcaatgcttgtagaagtnggaggaaacagttctcactgggnangaagcaagggcaagaacccaagtgcctcacctcgaaggaggccctgttccctggngtcagggtgnactgnanagctttggctgagacctgttttttgtggtgccacaaaccctgctgaacacagtgtctgttcagcatactaaccagcattccctacagcctagggccgacattggtttagaagtctgggnaaaaacaaaaacagaatttgggaaccttggaccactcctgtccctgtgg

SEQ ID NO: 605883 - DNA, 731 bp, Homo sapiens
agcgggctagtgttgccgccgccgccgccgccgccgccactgctgctccatggccgcgcccgccccgcgcccccgccgcgtcccgtcgccgcccgcccgcgtccccgacgaattggacacttgatgaagggacaggacacggagcagatgacaaacgcagactggcatgcagtctgttttcacgggtgggcaagaacaacagtggaatgtccttcacgttcttacaaacatatggtggcagtttgtaactctctgagtttattgtactttggcctacaaagggggtctctttcacggcaaacacagaatggaacccttcagcagacatgtctacagttgtaaaacaatatacggatacgatacggcattcgcggaaggtcgtgcaaatggttcccgctcaaagaacttggcggtaacagttgaccgcaggactcggcattcatgagcacggacttctcatcacgcttctctcatgcagacgttttacggcctattcggcactcgagcgacatgcactttggcacggtaccgtcgagggagcagttcccctcgactggagcgccactcagatggcctgcactcccatgccacttgggctgcatggtactgacgttccattcagcagaaacttcttcgtccaagtttttcataggaacgctgcaggtgaacgtggagtgaaacgacgactgcggattgaagggtgaaccccttccagccccaatcccaatcca

SEQ ID NO: 605884 - DNA, 476 bp, Homo sapiens
cccggggtcggccccttacccgcccgtggggattaagccccaagcatgcgtcagcttacttcagcccgtgctgctgggcccgcacccccctgtcccctgtcactgtggcatcctgcacccctcctcacccctccgttgagcccctcgtgccatgccatggatgggccctcccgtcactctgctggaccggatttattttctgagtccaaaattaattgatatgtaaattttgtccaagaagtattttagctgtgtctgtggtgtgagaaagtcattttctgattttcagccctcctttgcacagaagagttccccgtgacgctggtgtttggttccaaaggcggggtaccctagggaattatcttttttttcacttccccttgcatttgagatcctcctgggaaccaccgcaacccgtatcccctattaggaggttaaatccattaaatggccccatcatttttgttttagctcca

SEQ ID NO: 605885 - DNA, 176 bp, Homo sapiens
ggaagagggacggagatgcggatttcttcacgcctccccttggtgacttcaagagcctcgggcatccctttctgcaaagggcacctgaatgtgtctgcgtcccggttagcataatgtgaggaggtggagagacagcccagccttgtgtccactgtgacccctcttccccagcccag

SEQ ID NO: 605886 - DNA, 408 bp, Homo sapiens
ccacactgtctacgacggctatatacacatccccatctcagagagcaccttgtacatatcttaggcccttaatgcagacctctatgaaaagtccttctaatcagagggactatgcatagtccttattatgtcttgaactgtctctaagttccatccagagacaagaagtgatcacgtgaccacaagccagttcaggcaatcacagagatattgcaacatttgtctccgacttgacatgaacttgggtggattctcactaccaggtctatctaccatcttatttgttaatgaacatatttgtcttcagcacattgtaatcagatacccaatgagtttcagagggtttgaaaatgaacactttagacatgaatagcctatatggtgaacttacagaggcaaagcgactgg

SEQ ID NO: 605887 - DNA, 218 bp, Homo sapiens
  misc_feature (116)..(116): n is a, c, g, or t
  misc_feature (140)..(140): n is a, c, g, or t
  misc_feature (166)..(166): n is a, c, g, or t
  misc_feature (183)..(183): n is a, c, g, or t
ccaaagtgggaggattgcttgagcccaggagttcgagacctgtctgggcaatatggtgagacttcatctctacagaaaaactttaaaattagccaaggtgcggtggtgcaaacctntagtcccaggtgcttgggagtctnaggtgggaggagagcttatgcctggnagggagaggttgcagtnagctgagattgtaccattgcattccagcctgtctc

SEQ ID NO: 605888 - DNA, 706 bp, Homo sapiens
  misc_feature (5)..(5): n is a, c, g, or t
  misc_feature (93)..(93): n is a, c, g, or t
  misc_feature (96)..(96): n is a, c, g, or t
  misc_feature (106)..(106): n is a, c, g, or t
  misc_feature (116)..(116): n is a, c, g, or t
  misc_feature (122)..(123): n is a, c, g, or t
  misc_feature (126)..(126): n is a, c, g, or t
  misc_feature (128)..(128): n is a, c, g, or t
  misc_feature (143)..(143): n is a, c, g, or t
  misc_feature (148)..(148): n is a, c, g, or t
  misc_feature (215)..(215): n is a, c, g, or t
  misc_feature (222)..(222): n is a, c, g, or t
  misc_feature (249)..(249): n is a, c, g, or t
  misc_feature (296)..(296): n is a, c, g, or t
  misc_feature (334)..(335): n is a, c, g, or t
  misc_feature (389)..(389): n is a, c, g, or t
  misc_feature (404)..(404): n is a, c, g, or t
  misc_feature (462)..(462): n is a, c, g, or t
  misc_feature (491)..(491): n is a, c, g, or t
  misc_feature (497)..(497): n is a, c, g, or t
  misc_feature (557)..(557): n is a, c, g, or t
  misc_feature (689)..(689): n is a, c, g, or t
atgtnttcttgagcagtgagtttgtaggctcccacaggtcctcttctcatggtaatagtgtggccctcagtgcaaaggagaatagaacccggnagnccagaatggnccttcccctntcctcnntgnantccagtgctcccaantggtntcaggtaaagaaagattaatttgagtggttgggtaggaagagatgggaaggggcaaatcctaatggngcctganccctagagtggggagatccagggaagnagaaagggtgggcataggcacctcctgggatagaagctttgtagttnatagttcgattagtgtgtgcttaggaaataggtgcagnnataaagattagatgggtgaagaaggcaagtgtttcgacaggggttagttttcancctcagggatggaancattcagggtgaagcctgggatgtgggaaaaggagaatcagggtgatataaaaataanaaaataagtaataaaaaaattataaaaantgttgnttgtgtgaatagatttgaggaaaagtgttgcttttgttaaaatcctggagccgttaagtnctgaatattcttctggacatcattgctggctggagaaaggagccccaggcccggctcggctgacatctgtcaggtttggaagtctcatccagctggctgtgctcctgagagatccttagggctgctgggagnggccgggctggtgatct

SEQ ID NO: 605889 - DNA, 102 bp, Homo sapiens
ttcacgatcgacacctacagcgcacgaaacctgaaaggggtctgcttgaaggcgcaaaaaaaatctaaggaagaccgtcgatgcctaccagacttggacact

SEQ ID NO: 605890 - DNA, 141 bp, Homo sapiens
aaacccctttttaagcggggggggggggggtttccccaaattttttgggggacccccccctttttgggggggaaattttttttgggggtttttttggggccccccttcccctaaaaaaattttttttttttccccccccca

SEQ ID NO: 605891 - DNA, 83 bp, Homo sapiens
gggaagggggattatgaccagatggaaatgaaaggaaacgggagactgtattaataaactagcagctttattgcccttaaaaa

SEQ ID NO: 605892 - DNA, 117 bp, Homo sapiens
tatggtgttgtgggtagcatgcgtgggcagtatctgtgaaaggtgactctattgaaggaagaagggcgccatcttctgcccaccatgctatagacgtgctgctatgcacccagctgt

SEQ ID NO: 605893 - DNA, 182 bp, Homo sapiens
cccaatccagaggattagtgtacaactcctatgtgtagatgggtcgatcgctccttctgggggctagcgcatctcttgcagttacagctcggctgggtatcatcagtggccggcgtcatctacatcaatacccagaccaagtttgatgatcctgtagatcctgtaagcatggtccgagcgga

SEQ ID NO: 605894 - DNA, 133 bp, Homo sapiens
caggatagcagtggtaactgagtgtgtagtgttaggaaatgttggtctgtcagtgtgactggagaatgtaggggtactgaatgagcccagaaagacaggcctggggaatgggagactgtgaacgggagactcc

SEQ ID NO: 605895 - DNA, 149 bp, Homo sapiens
atgcacacccagtgccatgccaccctccctgctcgtgccattggcacgcacgctgcagctcacacgtacacacacacacatgcactgcccacttgcacatgctcacgcacacgttcacacattgcaacacggtctctcagtggtacctg

SEQ ID NO: 605896 - DNA, 179 bp, Homo sapiens
aaaagacaacctgatcctggagaaactaaaaccttctgcacagcaaaggaaacaatcaacagactgaaaagacaacctacagattgagagaaagtctttgcaaactattcatctgacaggggattaacatctagattatatgaggacctcagccacctaccagcaaatgagaccacctg

SEQ ID NO: 605897 - DNA, 312 bp, Homo sapiens
gaaaacttttgggtttttccttttgctaacccagggagggtcctaaaaggaaggggacttttttctgtttgttttaagttgccctgggggatttttgacttgaggcccatttttccacccacccccccccttttttgtaaaattaagtccctttagctggaatggggaagggggccaagggtcatttttttgggtgggggcaaaaatcaaatcagccccaggaaaaagttaggattaatttcttaaaaaagaaatccttactatttcccccaaagggaaacccctataaatgtaataaagtttatgttttga

SEQ ID NO: 605898 - DNA, 464 bp, Homo sapiens
ttccaccaggtaatactgcacttttccccacacacattaccttataaataaacaccaaaatactggttctaccaggactacaatgcttctatgtaatctaaagaggccaaaaaagttattcctttttttaaaaaaaaaggcaaaaagacataccacccatatttatagatctaccttggccggaacccacctcttcttctatctggcacagggctttcggatggaggcctacatccaccatgggggttggccggcccagctgaatcgggccaggggaaaagaaagaaaagggcttagattccgaaacgtgaatattggccctctgggatacgtagccgtccatccactccgaaagtggccccatgaggtaaaaagaataagccggccctccattttaagataaagctaggcaagtccccagggccccgctccggaattctttattttgtcaaactggggttaca

SEQ ID NO: 605899 - DNA, 104 bp, Homo sapiens
  misc_feature (5)..(5): n is a, c, g, or t
ctgtntgggaacacaggagacagcatccggactcgtctcggcagcatctcatgagctctcacggggctcgttacacgctctctgtcattgctgtccaccacgaa

SEQ ID NO: 605900 - DNA, 1020 bp, Homo sapiens
  misc_feature (380)..(380): n is a, c, g, or t
  misc_feature (428)..(428): n is a, c, g, or t
  misc_feature (469)..(469): n is a, c, g, or t
  misc_feature (527)..(527): n is a, c, g, or t
  misc_feature (563)..(563): n is a, c, g, or t
caccattacactccagcctgggcgacaagagcaaaactccatctcaaaaaaaaagggtgaacttgaaggcaggtcctgtgtccatcttttcagattctgtatcccagcacttgggacatagacaaacacgaagatgacaatcaatatttgccaaaatgaaaaaacaaacatgtaacatcatgtaaaagaagctggttagctggagaaatttctttaccatagtcttgcttgtggatccagtagtgacttttacattttatatctaaatagaagctggaggcttggttgggtactcataggcataaaatattatgttatttattatagagttaaatgctacaaagacaaatctaattaataggcctattttcctttttaanttctactcataatttcttcatagtttttatgataaaaggttggatttngattagaactcccatgcttttgtgtcagaattaaaactggnattagaataaataattcaaaagctagagaaagagtacaatgagaagccatgagttgcntttgaattataatattatgtcttacagatttggggnatatgctaaagttaccaaagttgtagaaaataagggccggggcattgtgagtcaccatctggtattccagccactttgggaagccgagggtagacggatctctggaaggtcaggaagtcgagaacaggctgggccacatggtgccactccgccggggaccaatagttccaaaattgggccagagatagaaggggtgcacccgtatgtcctgggaaccccacgaaaaacgcgctggacagagagaaactcgctgggtgtcccacaggagacgcagacagatgcgaagcaacgaccacacaaatgggacacacgagagacacacactcgtggcgtcgagagcggcgacagaagaccaaccacccgagttgaggcaacccaccactgggccaccaaaacaataccaccacgcggtacagacaccaaacaagtaaactatgcgagcgacgcaaaacagagg

SEQ ID NO: 605901 - DNA, 171 bp, Homo sapiens
ctggtctgaacttaggctggtctactacaaatacaaaattcgtgggcgtggtgtgcgcactgtaatcccagtactcaggaggctgaggaggagatcgttgaaccccgaagggcgaggttggggtggagccaggatcgtgccattgcactccagtctgggcaacggagcgag

SEQ ID NO: 605902 - DNA, 429 bp, Homo sapiens
  misc_feature (42)..(42): n is a, c, g, or t
  misc_feature (82)..(82): n is a, c, g, or t
  misc_feature (111)..(111): n is a, c, g, or t
ctgggtaccagccaccattctcagtgtttcacctccatcaantaatgcgtccctcacctcagccctttgaagtgacaggtgntattattttcattacacagatcaaacacntgaggccacactcgtcaagtcacttgctcaaggtcacccagcttacacagcggcagatcgcgggcttgaacccaggtggtcaggctctggagcccacaattgtcttacccactatgcccctctctagtcatggtccccaagaggggcttggagacccccttagcaggtgaaagcaatgccagccttccttatttcattatgcacctaagactcactggcatttgggcatgcacttcccaatatgtgtatatttatttataaatatatacagatactatcctctgcacgctcctaataaagcttacattcctccatctt

SEQ ID NO: 605903 - DNA, 989 bp, Homo sapiens
ggcgggcgcgtggctcacgcctgtaatcccagctctcagggaggctaagaggcgggaggatagcttgagcccaggagttcgagacctgcctgggaatatagcgagaccccgttctccagaaaaagcggaacaacaaaacaaaccaaatgcacaaaacacaaacacaacaaaaaaaaaaaaaaaaattggggggggagcggcccaggacataaaaaaaaggggccccgggaaaaaggtttttaaacacccactcgcgtgttgggcgcggccggggcggcccccaagtgtagtgttaaggtgacacctgggcgccaaagggttgtgacccaaaaggagaaaccggggggccataggaccaagcgggttgggcttttccccacccaaataaaaaaccgccgccggcgggaacaccccggacgcggtgtttcttggacacaacctcccaaagagggggcggtgcggagaaggccaacagcagggcgcgcacaaacacaaggggggcttcccaaggggagcgcccgagaaatttaaaaattaggcccgcggcggctggggacacagcacaagactaacagaaaaacaactgaaacgcgacacgcaggcctgcatgacacccccacaagccagcacgacaacaccagacgaactatccgacaactaacacgcacctgcatgaccgccgcgcaataaaaaacgtggcccgcgatgaaacacaggggcgcaaaaaacggtcgcagtaaggagcaccggcaacaccacacgcgtgtggacacacacccaaccgagaccacgtgaccagcgaacacaatattcaccaaaacagccttcaggcagccacaccacacgtctccaccgaaacagcccaacgctggacatactgttcgcaaaccggcgcgcaaggggggcataagcgagagacacaaacctggattggcgaccagaaccgtccaaggacaattccaaacaacggcgtaacgccaacgcacgaa

SEQ ID NO: 605904 - DNA, 301 bp, Homo sapiens
  misc_feature (124)..(124): n is a, c, g, or t
  misc_feature (170)..(170): n is a, c, g, or t
  misc_feature (234)..(234): n is a, c, g, or t
  misc_feature (284)..(284): n is a, c, g, or t
taacacggagaaaccccgtctctacgaaaaacacacaaaaaattagccgggcgtggtggcgggtgctgtagtcccagcactcgggaggctgacgcaggagaatggcgtgaacctgggaggcggnttggcagtcagcggacatcgtgccactgcgctccagcctgggcgancagaacgagactcagtcaaaaataaaaaagccatgaaggaataaatgtatatgggtgatgacantaaaattcaggttctgtgggatttagattaatttcctaggcaagaggcantttggcatttttaattg

SEQ ID NO: 605905 - DNA, 347 bp, Homo sapiens
agcttaaaacgccgtccacaagaatctgatccttgcccttggctggcccccgggaaaaaacagccggcaagtaagccccttcacctctggctagagtggagcggggtgatcaaaccttactgcagccttgacctgcttggctcaggggatgtacctgagcctaccaatagtggagaccacagttgtgcaccaccatacccggctactttattttaatatatatggggtctcactatgttgtccaggctgggctcatactcctgagctcaagtgagtctcctgccttggccacccagagtgctggtattacaggtgtgagccattgcacctggtctttttgcattttt

SEQ ID NO: 605906 - DNA, 161 bp, Homo sapiens
ttttttttgggggtttaaaaaaatccaaaaacccctgggcttttgggggaaggtttttttttgggggtttttgggaaccgtttttgtttttttacttgggaaaaaggggggtttttccccccccctgttttcccaaaacccaaaaaggggtttccccccca

SEQ ID NO: 605907 - DNA, 123 bp, Homo sapiens
caatatgatctgtctctactgacagcagttgactcatatatatctatcctgactcgcggagctgtagctcctgtagtaacgtgtagtctccgaagagcctcggaacgtccctatgtactcctg

SEQ ID NO: 605908 - DNA, 287 bp, Homo sapiens
tttttttaaaacccccccaaatttttttggggggggggcccccctgaaaaaaatttttttttggggggtttccccccccctttcgggaaagccccgggggtttccctggggggggggggccctttccggggggaattttttccccccccccccggggaaaataagggggggattttttttttcccccttggggggggggggggggggggtttttttcccccccccccccgcccccgggggtttttccttaaaaaaaaaaaaattttttcccgttttttggggggtta

SEQ ID NO: 605909 - DNA, 947 bp, Homo sapiens
gggatccaacaaggagtggagtctgtggctggctatggcagacatgctttctgaggaatgttgacggaattcggacgctcatccctcctagatttctctgatcatgggcccatgtgctggtggtggccgtctactccccagccctaactagacttcacgttcatggtataaggacacctcctacctgttacatactactggccctgatgttgtgaagtctagtctaccaaatggaggatgttacctcagggaggagctcggtggtgctcgaagatgcatgaccactcatgtcaggtgtggccctccagagcttttgaaagagtgatgttgagtgccttgtgtaatctccgggtatttcttcaagcgtaccatgaccctgaagtcgagttacaggacgccggctcccgtccgttgagtgccacgatcccagtgaccgtctggttcctgagcttgagacagtttgtcgccctttggaagtcaatcgaaagcctacaacatggtggacatctataggcaactctgtttgttgaggagcgtgaattgttgtgagatcatgcccagattatgccaagaacatcattgtttggtttggaagaatgaatgggaggacgtgtggaattgttggggaaacaactaaggtgggctcaggatgttggattatattcatctgtgaaaggggctcgttgtgtcagattctgtgaatgcgatgcaatattccagtcatcagttttgtgatgtcctgggcttgctacctggcacgacaggaatacgggggcatcataccggatggtggcaaagttttctaagcatttgatgaggaatggttccaaagttacgagtatcacaaggaaggccttggggggccatgaagtagagattagaccttgggggaacacattggtggcacggagaatgtggttggaaaagcgggggacaattaaggggaa

SEQ ID NO: 605910 - DNA, 100 bp, Homo sapiens
caaagagctggaagatgaccagggcatctgataagtcactgtacaaatgattgactcgagggttaacacccagggagtccatccagttcctaaatgtccg

SEQ ID NO: 605911 - DNA, 418 bp, Homo sapiens
cgcggtggatcacgcctgtaatcccagctctcagggaggctaagaggcgggaggatagcttgagcccaggagttcgagaacctgcctgggtcaagtatagcgaggaccccggtttctccaagaaagaaaagagaaaacaaaaaagaaaagaaaactgtctgtggggggcgccgcacgcacgtggccgcttgcagaaaaagagttttcaatgaagaacaccccttaggtgcaaggaggggcacgcggcgggcccccccgaaagagagtaggtaggcgagtgccacacaacggtggggacacacgaacggggtaccacgaagaagggaaaaacccggaggggcagcagcagcaagcggagggcgagggatgtaccacgccagcaagtgaaaaaaagggcccgcgggggctaccccacggt

SEQ ID NO: 605912 - DNA, 508 bp, Homo sapiens
  misc_feature (434)..(434): n is a, c, g, or t
aaacaggtctctccttaaccactcaaaagagccaagtgagaggaatttgtggataaagacatttaaaggtagtatgaaatctttaatcacgccaaatcaacactcatcaccacgacattctgtcagtgcctccagggattaaggacatatgaatgtctttccctgaaatgtgattgtgacattggacttagctatttgggttttcatgaaacccattgtcaggttaaataatgatagagtagtagatgttctgcacaattgcttttgttataaaacttgaaaaaaagtatattaattttttatgccttgcctttcagtgcattattacttatctttgtgcagagtagattaagtaggtccattgaataagaaagcattaatttggtagattctctgtgttaagatgctcagtattttttatggaataaaggtgnggaaaggtttctactcctggtcaaggagtagaaacaggtagaaaatatttatatttcagccctgcttctccttt

SEQ ID NO: 605913 - DNA, 851 bp, Homo sapiens
  misc_feature (17)..(17): n is a, c, g, or t
  misc_feature (155)..(155): n is a, c, g, or t
  misc_feature (177)..(177): n is a, c, g, or t
  misc_feature (182)..(182): n is a, c, g, or t
  misc_feature (191)..(191): n is a, c, g, or t
  misc_feature (197)..(197): n is a, c, g, or t
  misc_feature (205)..(206): n is a, c, g, or t
  misc_feature (215)..(215): n is a, c, g, or t
  misc_feature (221)..(221): n is a, c, g, or t
  misc_feature (237)..(237): n is a, c, g, or t
  misc_feature (257)..(257): n is a, c, g, or t
  misc_feature (273)..(273): n is a, c, g, or t
  misc_feature (279)..(279): n is a, c, g, or t
  misc_feature (310)..(310): n is a, c, g, or t
  misc_feature (314)..(314): n is a, c, g, or t
  misc_feature (326)..(326): n is a, c, g, or t
  misc_feature (332)..(332): n is a, c, g, or t
  misc_feature (334)..(334): n is a, c, g, or t
  misc_feature (336)..(336): n is a, c, g, or t
  misc_feature (356)..(356): n is a, c, g, or t
  misc_feature (358)..(358): n is a, c, g, or t
  misc_feature (399)..(399): n is a, c, g, or t
  misc_feature (426)..(426): n is a, c, g, or t
  misc_feature (850)..(850): n is a, c, g, or t
gcggcggcgcgtggcangtccggcgggcgccaggcggcggcggaggcccgagcccggcccagcctcgtcccgcccggtgcccgcctggctgctaccccgcccccggctccggtcccgtcctgtcccggcccgccgcggcctcgccccggcccccnctccccgcctcccgacggaccngcgcncccgcgccnccaccncaggcccnnccatgaccnacttcnaattgggtatcgtccngctcggccgggtggccgggnaggtgagcggcgcgcncccgcnacccggcccgtctcgcccgtccaggcctccncccngggccgggggcngttgtncngnccgcggccggggcgggggcncngacccgggatgggccccacccggccggggacgctgcgcggncccggctgctggccccgcgcgggtgcngcttcctctcgccggccggcgggcacgcacccctcggctctcgggtccacctcgccaccctccgccctgccctgccggacgtcgagcccacggccctctccccagccgggtgcggagatgcgtggctcgagcccgagccgcgttctcccggagccctcccagtggtgtcggcgatccggggcctagcgcggcgtccgggctgccagtgcggccacacggtttaaacacagcgccctttccgaggcagcgccacttccacacctctcgccgaggcgggtctggtgtgggctcttctgtgcctcccagttctcagcagggcttcaggctcgttttaacgctgccaggggttggccacgttaggctgagcctcagactcggagcagagaggaagaagcctgggccctgatgctgcagactcagggcnt

SEQ ID NO: 605914 - DNA, 239 bp, Homo sapiens
  misc_feature (22)..(22): n is a, c, g, or t
  misc_feature (24)..(24): n is a, c, g, or t
  misc_feature (27)..(27): n is a, c, g, or t
  misc_feature (36)..(36): n is a, c, g, or t
  misc_feature (40)..(40): n is a, c, g, or t
aagattcccccccttttttccncngangccggcttnctangttttattttaaatcttaggaaaactgaaatttccttactggaacggagaaatagtcgtttccctccctcttttcttccacaggaaaaaaatgttgggtacttacggatgcagttctttggtttgaaatttattgatacggcaaaatgtctaccaaagtttttaagatcccgtaaactattgatgtactgccatgttat

SEQ ID NO: 605915 - DNA, 523 bp, Homo sapiens
  misc_feature (44)..(45): n is a, c, g, or t
  misc_feature (141)..(141): n is a, c, g, or t
  misc_feature (148)..(148): n is a, c, g, or t
  misc_feature (366)..(366): n is a, c, g, or t
  misc_feature (374)..(374): n is a, c, g, or t
  misc_feature (498)..(498): n is a, c, g, or t
tatcttttgtagaatggggcggcgacccggctcatctcaccgtnnagaagctgttggcccttcggagcaagacctcggtcctgtataggtgagatcctggcccgccaggagctcttcctaataatggcctggctgctgcanaggctcnacctgcaggtgcctgatgaggggcagctgccctacctggaaagcatcctaaaggtggcctttctgagcgcctctttcaaagggatgatctaggtgcgccaggcctgaggggaagccctctctaaggcgagcacctaaagggtgggactcacagccccgggtcaccctatgaggtcccacaacacagatttagagatacaaccccggaccctgttgcgncattgttncgtactgccaaaccactctgcgctcttttttaacctgtggcactgccaaagatgagcataaacagcgttgttttttattcagggcggaaaaagaaaaaacagatttttttttaaaggaatgctnttaaaaaggaccttgtcttcccacg

SEQ ID NO: 605916 - DNA, 203 bp, Homo sapiens
aatgtaaatacatgaaactataatatttgctatatatttcaatagactgcaaataaaccaaatctattccaccatttggaatccctttacacttttaattcatatattccactctttctgttacatatatttctatcatgggtcaaggattgaaccatattatttccaatgagttgggatttcctaagagagacctgagctag

SEQ ID NO: 605917 - DNA, 1156 bp, Homo sapiens
  misc_feature (1156)..(1156): n is a, c, g, or t
gccactccggtgcaggaggtggaaggtggcgtacctgacatagaagagcaagagaggcggactcaagaggtcctccacggcagtggtcagaacacaagtgaaacgaggaatcccagctgcctggcaccggtgggccatgatagatgtgcttcagtgctgtgcagacgacgcagaggctgataagacacagaatagcaggctgatgcgtcgggtctgatagaatgagacggatgtagtgttgacaaatagatgtctcagggacctcaaaaatcgtgagccttattaacacaacgggaactcgtgagtggtgcatgacgcaccgccataacaggcttagaaaatagggcttcctctaaggtcatcagaagagtcgataagacgtccaagtgacgcattgtaatcaactttgtcatagcgacgaaacctttagctggaggttacaaattcgacagcgtagatgcgctgatgtgaaaccaagagtctagtccctcgccgtggacatacgcgtgggcaaaacaccgcttaccagatcaggttgaacgcatctggaatgggacagtccgcgcgcgcgccgcttaggcacggaacttgtttcgcaccggcgatcgcaaggcgtcaaccaagagcaccccatggaaatccgcacgaagctaatcctggttgggacagagttcccactggagcgacgcatattgcatggtccggcaatgctgggttaacccccacgtttccacgagggggcagctgcatggtcactaagctgggcaggtctccccttgttgcagccttggacagactgcaagaaaggctctttcgcaatggcggagcccatttacccacgattttgcggtaggtttgcccacgtggcaccaggaacgccttaacgtatgcaagccatacttccaaacgaggaatttggcgaaacgcaagcaaccgttcctgaatcgaaacggccaatttatgcatggcagttatatagcgcacggcgattgttcctagggatggggcaccaaagcgttggtttcattgcccgagtattcgttcgttctcagagaacgcaaaccttggaccccggtgggcacctcttctcattgaaagtggcacttggtactcggatggataatatcgcctaggtcagttcggaagtcaaaaagcn

SEQ ID NO: 605918 - DNA, 157 bp, Homo sapiens
tggctccacttggttgcgggtggttcggggcaggagacgacgcaggcgagcggaaggggcggtaacccaatggccttagttctcatggcgtcctctgtggtgtaacctaaaaaataaagttattgtgtgattagaaggtaatcgggtccgtggtcat

SEQ ID NO: 605919 - DNA, 410 bp, Homo sapiens
cacaatcatggcaagccagcgccacttatccagtgaggggtaggagtcaggtagttagtattacgagggggtgttgttagcggcgtcgtgatcgaaacaggttggacgcgaagcagcctaacactcaggacttgttagttagactttgcgttaacaaaacatccgtacgcgcgagatgatagtctacactactctgactactctatccccctcaacagatcagtggccaagctcagacgcgcactgtaatccacgtgaacgctactatccataaaataaaacctcttaccttacgtctatattacatctcacctataaagatctcacttaacttatacaccattacacagtacagcatgacattaactcattctactgatatcgttctttcgcagacccagattatatcc

SEQ ID NO: 605920 - DNA, 410 bp, Homo sapiens
  misc_feature (14)..(14): n is a, c, g, or t
  misc_feature (81)..(81): n is a, c, g, or t
  misc_feature (120)..(120): n is a, c, g, or t
  misc_feature (126)..(126): n is a, c, g, or t
  misc_feature (156)..(156): n is a, c, g, or t
  misc_feature (241)..(241): n is a, c, g, or t
  misc_feature (246)..(246): n is a, c, g, or t
cgcctgtccatgtnactccacttcctgatcctctatgtcggacccttgccactcatcttccagatcacaccgctgaccgtnacccagtggctgatggtgctgaaaatctccttgcccgtnattctnatggatgagacgctcaagtttgtggcccgnaactacctggaacctgcaatactggagtaaccgcttcctaaaccattttgcagaaatgtaagggtgttcggttgcgtgcatgtangtttntagcaacacatctaccaaccctgtgcatgactgatgttggggaaaagaaagtaaaaacttccaactcactttgtgttatgtgggggaatgtgattccaatggggttgttagcttttaatcaaatactgattacaggtgtacaatttaggttaatcaggaaggct

SEQ ID NO: 605921 - DNA, 239 bp, Homo sapiens
ccggttagcggagagggaggttgagcctgtaagggttggttagtggagagggagggtgagcctggggaagagttggttagtggagagggagggtgagcctggggaagagttggttagtggagagggaggttgagcctgggaagggttagttagtggagagggaggatgagcctgggaggggttggttagtggagagggagggtgagtctgggaagggttggttagtggaaagaggaggg

SEQ ID NO: 605922 - DNA, 134 bp, Homo sapiens
  misc_feature (28)..(28): n is a, c, g, or t
ctcggtacccgtgtcgaagaagatcggngtcattttgcattttttcaggtcggacaatgtgacgcaaccttgacgcgctggcttaatcatatccagcatctggaagagaaaacgatatacacacgtatgcaaaa

SEQ ID NO: 605923 - DNA, 494 bp, Homo sapiens
ggagcacataaggtatgtagccggagtaaagagaaatgatgctagagaggtaagcaaagagctagagcttgaaacactttactaaggagcacatggagaaaaatccactggaggagagtgacatatcaatttggaaattggatttgagaaaaatgactcagtctgcagtatagaagatgtattggagggtggaaaatactgatggcagaaagaatgttaacctgggttactttatggtaactacatatagtaacccaggcaagaagcaatgaaggactaatccgaggcaacatcagtgaggatggaggcatgttaatggatatgggagagtttaaggaggccacggaaggtggtgactggtttgttgagttagagaagatgcacaagtgagtgaaaggagtcatccttgaaatggacaaataagggacctgtgatgccatttaagggaataagaaatatagcaggagttgtgtgtttagccaagaatttagcat

SEQ ID NO: 605924 - DNA, 111 bp, Homo sapiens
ctaagtttgcttcttcgttaacttccaatacttcaagttctttattggtaagtgaagagattttcttttttaaaacgtcaagattgcgcgcattcgaaaaaacaggtgcag

SEQ ID NO: 605925 - DNA, 943 bp, Homo sapiens
agctccgagttggcccagtgtatcaccacaccaagtacagggcagaatagtacaagtcacccgtacaactactactgcttgggaacgcaggcccccaacatcccaggcctcagtcctcagttcattcttgacgttcagagagtctcaagctgagccagcccgcagttcttaggcagttgagcgcagcgacgacagcaccagagccaaggcagtgcactgttcctcctcctggtttggagtcctttccttcccaggcaaatactttcgagaatcaacacctggagacagtccgctcctactgtgaacaagcttgtggcagcttcccagcacgaccattgaaaatatctctgtgtctgtccaccagccacagcccagagacatcaaacttgctaagcggggatacccccagcttctaagatcccagcttctgcagtggaaatgcctggttcagcagatgtcacaggattaaatgtgcagttggggctctggaagagggtcagaaccttctctctctgaattgggctcagctccaagccgtgaaaatagtaatcgagattcccatcagctagtattcgacagtctttaagtgagcctttgaatacatctttatcaatgaacagtgcagtccagaactccacatatacaatttccgtcattaactcctgagtgcggaaagctcacaatgagttctgcagtcagtagcaatggctcctctatgaacagagtcgggctaaaggatccataccgaggcccgtgagcacagagcagccggacacagaggctggcgggggcggcaggcacaaacaccaagaaaggccctgacacgggggaacgacagcagcgaggggggggcaaccgccggggaagctcccatataccacaaaactgagccacggacagggtggacacacagacagaaaccgagcctgctccaactgccttg

SEQ ID NO: 605926 - DNA, 988 bp, Homo sapiens
aaggaggatctcgtgccctggctcccagcacaatgaagatcaagatcattggtcctcctgagcgcaagtactccgtgtggctgcggcggctcctactcctggatcgtcgcgtgttacaccttccagtcagtatgtggatcagcgagcaggagtatgacgagtccggcccctccatcgtccaccgcaaatgcttctaggcggactatgacttagttgcgttacacccgtttcttgacgaaacacctaacttgcgcagaataacaagatgagatggcatggctttattatgttttttttggtttggttataggtgtttatttttgtgttatttgggctagacgtacacggatttaacagcggggaacggtgatggtgacagcagccggtgggagtgagcatcccccagaggttcactaggtggccgaggagcttggatggccatggtggttgttatagatagtcagttccgaagatatgaggatgcacttggtgtactagagaagtcccctgtggccatatcctaaaggccaccccaagtttactctctaaggagaatggcccagtcctctcccaagtccacacaggggaggtgatagcatggcttcgggtaaatttatgtacggcaacactttttttaatcttcgccttaaatactttaattggtaatttggaatgatgagcttggggcccccctttcccctttttgtcccccaacttgagatgttgaagcgtttgggtccccggagtggtgtgaggcagcaagggtttactgtaacctggcttgagaccgttgataaaggggcccccttaaaggagcaaaaaaacaggggcgcgcaaaatctccagggccagttcgcgaccccttttggaaggccaaagggcggaaaacgaggcgcggggtaacacggtggcacgactgcctggagacacttggtgcatggcaccacatagccgaagatgttggacatcgggatgtgatacaaacacg

SEQ ID NO: 605927 - DNA, 834 bp, Homo sapiens
  misc_feature (416)..(416): n is a, c, g, or t
  misc_feature (466)..(466): n is a, c, g, or t
agtcaccgaggatggtcagtattccaaggtcagagacactgcccgggcggggatggtgcatgttccgtggcctcgcccaggccgacggcgccctcatcatcagtgtgtggattctgggattctcactagtctggcatgacgaggtacaaggacagcactcctctgatcccacctcctgcgcaactgtacgcagctgggctccttggaggctgttgtaggtgattgcgtccaaggtaccccagtcagcacctcgccattgctgcgtttgcccagcgagggtgggcaaacgtaggagatgcttgtgacagcactatgaggactctgaccgaagggcctctggaggatagcctcgtgttcagggcccaagaaaccgtgtcgagacattgactggcttggtagcgttgcgcgagttcccnatctgggaagccatgcgtagcagtatcaggttgtctcccacgcgagtcancacgtaacagcctggtgcaccctggcagcagggtataccaaccaggctccggtgtttactgatccagcatcccccctcgatggcgcccggtcccagtcctaagagacgccatcgctatgggagagtaccccaactaaacaagccatgaacctcaactccggggaggcaactccagtggattcgtgggcacaaaactccatgggcagctggcagaaattggaccttcggacaaggcgtctactgggctgtcttgaaggtggctggccaagcaatgtgccgtgggttgagaggccaccctttaaaggagccttataaaacccctggggttggcccagagttctgagaatcaccggggtccaaaacccagg

SEQ ID NO: 605928 - DNA, 798 bp, Homo sapiens
agcggattggcgtttttgctcagaatcgcgactaaggcttttatttttttctccctctgaacggttaggctatggctgcgataaatggccgtcaagctccaaggctgaaggtggcggcgggcccagtgcatgctttgagctgtacagatatattgcgccgccctgagggctgcacggatgtgctgctggaccaacttgggtcctaaaggcaccatgaaaatgcttgttactgggtgcaggtgacatcaaactcaccaaagatgcgcaatgatgcttgctctgatagagatgcaaactcaacatccaatcagcattccttgatatgcaaaagtagcaatcaactcatggatgactgtcacatggagagtggtactacttcaacatgttctaattgattggagagttcattaaacacaagctgacctgtacgattctctgagggccatgcaccctagaaataatagctgaaggatttgaagctgcaaagataaatagcacttgaagttttggaggaagttaaagtgacaagggatgatgaacaagagaaaatcgcgtcttagatgtagctagaacatctttgcaaactaaagttcatgctgaactggtctgatgtcttaacagaggttgtgggggattctgtttgggctgttagaagaccaggttgaccctattgatctcttcagtggtagaaataatgggcgaatgaaggcataagttaggaacagatacaaagttgatccaggattagtgtggggatcatggtgccgtcatccagatttgaagacgcgagttgaagat

SEQ ID NO: 605929 - DNA, 1404 bp, Homo sapiens
gccgaatggaaagaatgccaacgggaagagaaggtggcatcctgtgcgccagttgtccgtgacgaagcagtgaggctcagaacagtgtgtgtagatccctgtctttgagaaacaaggtgcattgcgaacttgttggacgatgtggcagccacgggacgagtccaggcccattgaagcagaggctcatgcgcgcgtttggtgaagatggtcccctgctgatatcaggcgttgcaacggccagagagcgcatgcctctatacaggtccgggacgtagagacacggttgaccgtccgtggccagaatatagaccccacgtttccgagcccaagtggcactcctgtgcacctcaggcccagaagcaatggcgttagcgtccaaggccttgtcgttttagagggcttggtgctcaccaacaacagggtaaccaaggaaccctattgaagaaccaaagaggtccagaaggacgtacacggaaacgccaggaaggaactcgtgttctgggggccccccggtgagccccttggaggggacagggaagatgtgctttgccattgcggaccacattaggggggtggacccgctcctcaaaaacgggatagggaggacgcacccggttgtcctctttcgggacgccaagcgaaggtttcacactcacccgttctacactatccttggtctgagagatgaaccgagagttacaaggccttcaagttcatgagcgtgcgctagccaattggcaactcaccggaaccgtttggaaatccccagattcgaaagcctggcgttggtcctttctatttgccccttgacccccattgtattggatcgggttacaaaaatggggggcggtcccccattttaacgttgcctatttaattccgagcaggcgcgacaagagtgggcccaaaaaaggacactttgtgctggacaccggttcctaaaggtctccccaaaccaatgtgtaatatggaaccctttagcaagcccaaacattggttcctgccccgttttccagcgaaccaagatggtttgaaaaccgttccggcggcaaaacggaccacaaaatggggcctgcctcttttttggggccgttaaaaaggccgctggggatggaggagaacggccttattacaggggaagcgcgcgagaagatttttacccaaacatttggacccacacgaaatttaccctggaatttgaacggaaattccctgagccctggcgtcaaccttttgggtggaggtttggtgccacaatttgggttcccctttgtgcgggttcctcttaagagggttcctttggttggggtcttgcggagtaatttccgaccccaaagggccttcggaaagaaccaaggggggcaacaagcgtggcttaacaaatgtgaaaaccattttggcccg

SEQ ID NO: 605930 - DNA, 153 bp, Homo sapiens
aaaaaaaaaaaaaaaaaaaaagttaaacccatttaccccatctggcccgggggttaaggcccatttttccttgcacgttcccagccccctcttcgggggggggcttctcagtgatccctttgaaagggatcacttcccttccttatatttctc

SEQ ID NO: 605931 - DNA, 250 bp, Homo sapiens
gcctggctattgtatttttagtagaatgaaaggggttgccatgtaggccgggctggtcttgaacacctcaggtgatctgcgtgcctcggccctccaaagtgctgggattacaggcgtgtagccacctcacctggcctcagatgaatttagaaaccactatttattcttgagatggagtcttgctctgttgccccggttggagtgctgtgctgtgatctcaggtcactgcagactctcccgggttcaagca

SEQ ID NO: 605932 - DNA, 263 bp, Homo sapiens
cgagaccctcgccgtgctggacctcgatcatagctatctcttcattcagggcccgccgggtacgggtaaacctataatgccgcgcacgccattgttgctttgttgcgcgctggaaagcgcgtgggtgtttcatcgaactcccataaggcgatcaacaagttgctgggcgaggtagacccacttgcagcaaaggcgagcttccgttttagcggtgtcatcagccccacgatcctctatgcctgactgatccggggtgtcatcag

SEQ ID NO: 605933 - DNA, 216 bp, Homo sapiens
caggggagtgtggtccctcaaactcaagtgtagctctgtgcgcggggtggcttttgcctattagtttcaagcgtaccaatgcgcttctgtccatggcttgtcgaaatgaggtacaatgtgggatgccacaaaggggtgggacttttccactcagaccggagcaagctgcagaagggagggcatgtgatccaaaaccgccgtcgggccggcacaagc

SEQ ID NO: 605934 - DNA, 1361 bp, Homo sapiens
ggcaggcttctccgactagctgctcttgtcaataatcaactccctgtgagtggaagccagatggccagcttgaagattgggctaggcagcattcgatcttcctttcaggctctcctgccatgctggggtccatacctcagcctggatcgtgagctctgtgcccccatccgggttcgttcccatggctgagcaccgaggcttgtggtgcactcaggccttgtgaagaccccgtgtgtccctagcccttgccgtttaaggccccagtgcccacgttcccaagtaagtcatcacttgcgtcagggtccgtcgtgatgtcatccttcttcgcacgtgggccgcaaactagccctggagcctcctctcatccttggcctattcaatgcgcgtgagaggccctcaggaagactccccacacaacctaatgggcgttatgcatgctcctcgcgtattgcgtgtcctcgaggtgccgtttcgccactttctctcacgcctgctcattgtgccagatctccacccctaggcctccagcagggccacggtaacgaaggtcaacaggaccacggggcaagtctgggcgagaccttcccagaggccccttgagggtccaagactgtcggtgcgccccaaaatttgaacacaggccctttaaccaaaagcggttgcttaacccgaggacggacgggcaacaagattcccaacattccccaagccgaggaaaggaacgaacgcggagttggttgtcggcgaaggcaattaacttcccctaatttctacccgttcccttccgttggggacgtccttccacatttggccttggagggccttttggctaggaagggccatttcccacaaaggcgggacaaagcccaatgcccctacccacaagatttggaacgaaagcatttcccattttcacgttcacgtttcagcttgcttcacgattcttccaccctttcacacattaggtcccccttttggcactttcaacacatgtctcattcttatactttaagaactttgggagtgtacggatttccactttccacttcttccactttcttccccaagtggaccaatgtgttttgcgcccacggaagggtcattgagtggccccaaatccccattggggtcttccaatggagacacctctccccaagggcccctggttgggggaaagcaccttgggaggggtgtttaccttgaacttcctccttgaggccacatgtgggaacgtcccagggaaggaattgcttcagattcaccccaaaaaagtgttccccaagaaaaagaaatggagtgcgcctgagagttggagatgactatacccttcaaagagctatcttccacttaaggagtaccca

SEQ ID NO: 605935 - DNA, 464 bp, Homo sapiens
acgtataccaaacaacaaaaatcatctaccatagataacatatgcacctatgtcatcagcacttatcacaataacatggaatcaacctagatgcacatcagtggtgaactggataaagaaaatgtggtatatatacaccacgggatattacacaaacatagaaaggaatgaaatcatgtcctttgcagtaatatggatgcagctggaaaccattatcctaagtgaattaatgcaggaacagaaaaccaaatactgcatcttctcacctataagtgggaactaaacaatgagtacacatggatgcaaagaagggaacaatggccaccaggtcttatttgagaatggaaggtgggaggagggagtgatccatcgtgtaaggtaagaatagagactaagccggcccggcacggtggctcacgcctgtaatcccagaactttgggaggccaaggcgggcagatcaggc

SEQ ID NO: 605936 - DNA, 207 bp, Homo sapiens
gacccgcggtatgtttacgtatatctttatgtacatattttatccctttacacttgtaaggtagtagttttgtaattgttaggttagattactcgttggttattactgcattgtcggaactagaagcacaagcattttactacactctcattaacatctgctaaccatgtgtatgtgacaaatacatttgatttgatttgaaattac

SEQ ID NO: 605937 - DNA, 145 bp, Homo sapiens
tttttccctcaaatcttatttgaggcctaacccccagtacctcagaaggtgagcgtatttggagacagggtattaaagaggtaattatgttaaaatgaggtcctacgtgaggtccctagtccattccaactggaatccttatagg

SEQ ID NO: 605938 - DNA, 365 bp, Homo sapiens
ctgttgaggtatccgcaaattatttcaataaataataacaacgatcgtagcccgcgttagcggacgaagtctatagcgcagcttagaagtaatactgctctgagtgagtaacaagaagcctttctcctcgcacacgcttacatcagtaactaataatatactgatcattaacaaccaataactcaaaacaacactaaaaggttcatgtaagttacacttgtcaacccaacacaggagtgcaccaaggaaagatcagaagaagtaaaaggaactcggcaaacacaaaccccgcctgtttaccaaaaacatcacctctagcattactagtattagaggcaatgcctgcccagtgacaccagtttaac

SEQ ID NO: 605939 - DNA, 1036 bp, Homo sapiens
  misc_feature (87)..(87): n is a, c, g, or t
  misc_feature (89)..(89): n is a, c, g, or t
  misc_feature (115)..(115): n is a, c, g, or t
  misc_feature (737)..(737): n is a, c, g, or t
  misc_feature (780)..(781): n is a, c, g, or t
  misc_feature (827)..(827): n is a, c, g, or t
  misc_feature (936)..(936): n is a, c, g, or t
  misc_feature (953)..(953): n is a, c, g, or t
  misc_feature (990)..(990): n is a, c, g, or t
  misc_feature (1010)..(1010): n is a, c, g, or t
  misc_feature (1036)..(1036): n is a, c, g, or t
ggtggtggttatggagattggtcagtggtttataggtcaccatagttaagagttagttgtgaggcaactgattcttaacttacctgngnacgtaccaaaaaggagcacatctcanctgatacatgtctttagaaactctgagaaaccccagcccagaagacctctttgatgagatttaacagtctcaaaaaatactttggaggttcacgtagactatagccctctagtgcattgtctttaaccgtgagtaaagtgaggaatggtgacgtcgaggagccctgatattcacccgcatcctgacatttttaattgacgtggcggaggggagatcggatgccatgtggcgcaccaatcggctggtcacctcgtggtgcgccggattacggatggttgatcgatggcacaggtgggagtgatgggatgctataaacgttagtcacttcgagggaccgcctgttacagcccagccacatcggccatggtgcctgaggtcgccagcggagggagcgtatatcgctcatgaggtaagatgtcaccaccgaagtatgagtgttaaaacggtgtcaacatgcgccccgcggttgtgggattatgggtggaaggctcgcggggagggcgggttctcatgagttgtgtaagccatggtgttaagcgggtgttctggagacgtaatgcgtcttatgagagtcagtgtgtgaaatcgagttatttgggggttataggtttatatgcgggtnagtgagaggtcagtgaggcagtaggcatattgtaccgtgtggnngcttggcgtagcggtggatggctcggcgtggctctcgggagggcanggtgagaggaaggcggggaggactaggttcatatgccttggcctctaggggggtgggtctatgggtggtgaggagtattgtggcataatagcatgagggtcttgggttntaaagtgctgaggggtnagtgggtgtggtggtcgtaaggtgctaagttagggtnttgtggagatggttgaggcncattggtgtttttagtgtgtgttatn

SEQ ID NO: 605940 - DNA, 121 bp, Homo sapiens
gggagaagagggggctttggaggcagagtccgtaggcgtggacgagggagaggtgcccttctccgccctgtatagaccaaggagcagctggacaaccaattggatgcatatatctcgaaaa

SEQ ID NO: 605941 - DNA, 333 bp, Homo sapiens
taaaaaaaaaccccccccccccccccccccccaaccaaccggggggtttttttttttgggggggggggggggccccccccttttttccttggggggggggggggctttttcccggggcagggggggaccaaaaagttaattttttttttccccccccccttttggggaaggagggggggggggggggggaaattttttgggcccccgggttgggcccgggccctttccccccattttggggggggcaggaactggggggggggggggggggggggggggagggtttccccttttttccttttttttgaaaaaaaagggaaagggtttttggga

SEQ ID NO: 605942 - DNA, 967 bp, Homo sapiens
gaaaaggatgtcgacttgctaatttcttcgaaataatttattcagtttttaaaaagccccttttaaagcgatctacttgaagattggtataagttttcataaaatgtcttttttgttatgtgtcccaaagatatcttagataaagctattttgaagttcagatttcagatgaggcaacattttcttgagataattacccaagtttcatccatgttgaagtggtacaaaatatttctgtgaaactaacaggaagatattgttcaggataactaggataagttgttggttagttacccagcctaattgaagagtggcagaggctagctacaaaaagcaatcttttgcatattcactaaagagtttaaaagctattgtattattaacataagtctttacaatgcttgtttcaaggaaccagcagaaaaaagagctaagaaaactgagaactaacattaaaaatagattagatttagaattaagaatgatttcttgaattgtcctttgtttcttcgggtctagaacatattgaatttttgtaaatatctgattcaatgtgtcttagatcctcattattttaatagggaaacgagaagatttcagtaagttcttaccatgctaatatgtaaagttcatgccatccaggctgtaagagcgatctcatccgcttgagaatatgtatttgaggtccgactattctgtttacagcagtttgaaacacatattttgccaccaatgtcgtattattttagaagatgttacttgctctaaatatgatatgtaatgggcatattaatgtggaagcgcgccgaccatttacaattaccggggaaaaaaaggggggcaaaaaaccacaggggcgataggacaatgtaaagggcaagaggatataaaaaggggtcaaagaagagaggtgttacaatttgatgaaacaaaacagagtatgcacgggtcgaataagatattaacc

SEQ ID NO: 605943 - DNA, 308 bp, Homo sapiens
gagattgagaccatcctggctaacatggtgaaaccccatctctactaaaaaatacaaaaaaattagccgggccttgtggtggacccctgtagtcccatctactcggaaggctgaggcaggagaattggcatgaacccgggcagcggacgtttcagtgagccaagaccacgccactcactctggcctggacgaaagagcgagatccatctcaaaaaaaattaaataaataaaataccaggcatagtttgcatgccttttgtccagctactcaggggctgtggtagaaaatcatttcaccacagttagag

SEQ ID NO: 605944 - DNA, 226 bp, Homo sapiens
  misc_feature (94)..(94): n is a, c, g, or t
caattctagtcataatagtctatatgtactaaattcactatcagagatctgattaaataagaatactaaactcaacagtagtcatgtgattatntgttcattcagaggactatgggtcccactgccgcacacgtgtctctggttctcaacgaagtgtgactgctctctgaagaggtagggtgatggcgactgtgttgtcaagtctgccttcgttgctcccatcttc

SEQ ID NO: 605945 - DNA, 150 bp, Homo sapiens
catgttactaccttctcaggaacataacatacaatagctatttaggctgatgggagcaagatgcggtctgctcccatcaggctcagcatcattcaccatttttctctttttcttctttttcttttttgattctgatgggacgaagatgcg

SEQ ID NO: 605946 - DNA, 114 bp, Homo sapiens
caggtggccaaggcagggggacagcaagggacgctcaggcggggaccatggccggacggcggcctcggagcgggctgtacgggcgcatcgtcaagatgagggtggactaacagc

SEQ ID NO: 605947 - DNA, 425 bp, Homo sapiens
gcctaatattttctcaatccggaaaagttgttgcccgccaatttctcctgtggacccccgggctgccactggtccagacttcccgaatcggtgtgcgcacacctgggttggactcgccggtctggagcgccccccttggtatatactgcctctctccacaggtgttcgctaactctatggagtggctcccccccatagggctataacaccaaaaccccattctcccgggggtcttaccccgcggccctttgtcccgcgtaatcacagccgggggtatactccagggccaaggctttgtcaaacacgttgggccgccaacaccataatttttcatccgccctcgctccgtcagagtgatttccccaaatttttgaaaaggggccctttttcccttttccccccccttccccccttgaggccaaaaa

SEQ ID NO: 605948 - DNA, 383 bp, Homo sapiens
ctgagaagcccaaggttaaatttcagagcactccagccaagcagtcaggtggtaggttgctgttaaaatttgcctccatcctttcctaacagcattgaatttgcaatctgaacccaagtgaaaaaccaaaattgcctgaattgaactgaatgtagctgcactacaacagattcttaccgtctccacaaaggtcagagattgtaaatggccaatactgacttttttttaattcctttgattcaagacagctaacttcattttaagaactgttttaaacctttgagggctggttaatttgcgtagaataaatctctgttttggagtctatatggccatgtttagacgccacggttaagctttctgaagatgaagttcagccattg

SEQ ID NO: 605949 - DNA, 248 bp, Homo sapiens
tggaaacgaaccgtgtcagattgcacatccctgggcccccatgcccccatgccccttttagttacacaggacagaggaggcaaagcttttgccccctgttattttcactttctttgtccagtcttttgtttttaataaacagtgaccctccctacttttttttttaatgatttttgtagttgatttgtttgaactgtggctactgtgcattccttgaataatcccttgtaaaaattgtcagtgcttta

SEQ ID NO: 605950 - DNA, 583 bp, Homo sapiens
tgaggatccccgctgctcacatgtactcactcatgtggggagctaaaaaagtgaatctcaggtcggcagcggtggttcacgcctgtaatcccagcactttgggaggccgaggcaggcagatcactggagcccaggagtttgataccagcctgggcaacatggcaaaaccctgtctctacaaaaaatacaaaaactacccacatatggtggcatgcacctgtagtccccgttacttgggaagctgaggtgggaggatcacttgagcccaggaggcagaggctgcagggagctgagattctgagattgtgccattgcattccagatagggcagcagagcaagaccttgtctggaaaaaaaaaaaaaaaaaagggaatggccgggattcggtagatcacttgggagagcacggccatctaaacaataggagggtcttccattccataaataggggaggtcttcccattaattgagggtcatcttaaatccctatccagcaagtgttgggaagcttttaggtggcacatgtctggtgcggcctgggtaaaaatttatacctaaggcatttattggtttggatgtcat

SEQ ID NO: 605951 - DNA, 697 bp, Homo sapiens
tattaggcataggaggaggtctgagtgttaaatcaggacgaggatctctctgtgagaagctgcatctccccgacacccgctcgtccccttctctttctgacaccctcctttccttcctccctcgctccacatccactccctcacctcttattactacagagaccctcactctttactctccgagattaactgagagccgaccatgacatctccaacaattttcaccctcatatccccacaaccacatacacgagaatggagtcagggtattccggagagaccgaactcggactctcagacacctattcccagccgactgaatagctaaactgaccatcgagaggacgagaggggaaggaggtgcgaacgcccctatacatcaagctaccatacacataccacaaccaacacacctccacattacaaagccggattatgcatccctgggggcgggacaagaccctcgataccacgggggcatggaaataactcatctccaactccattacgacgacttggcaacacccagacatgaagacagattgacgccaaaccacttccactgacgtcccgcatgggccaagcacccactggggacatcataaagaaacagcaggcccccctggcccttggaacaacccaacaacacgagcccgaggcaaggcccaccatgaccgccactgggcctgggccgatt

SEQ ID NO: 605952 - DNA, 184 bp, Homo sapiens
gagcgaattaccggggtcgaggtgagccagggccagggggcccccggtaaagtttagttgaggctggggaaggcccccggagctcgtttccagatcgaggtaaaagggccttttttaaaggcctagtttatgggatggggcggcggagggaattttttgaaaaataaaatgaagctccagggta

SEQ ID NO: 605953 - DNA, 421 bp, Homo sapiens
tacgttggtgaattgtatggtatgtaaattatagttcaataacatagttccaaaagataatcaaaagcatgaaagcactattgatgtggtttggatctgtgtcctcaccgagtctcatgttgaaatgtaagccccctggtgggaggcgatgggattatggggcagagtcctcacaaacggtttagcaccacccgctcagtgctgttctcctgatattgagtcctcatcacatctggttgcttcaaagtgtgtggtgcctcccctctgtctccctcctgctctggccatataagatgtgcctgcttctccttcgccttctaacatgattgtaagtttcctgaggcctccctagaagcaaaagctgctgtgcttcctgtaccatctactggaccgtgagccaattaaacctcttttctttata

SEQ ID NO: 605954 - DNA, 109 bp, Homo sapiens
gatttctgaggtaaaaagctattatgtttcctgggccaggttctactctgtgaaattcagcctggtgatgagactaaaacatgtgtttattatttattccccccacccc

SEQ ID NO: 605955 - DNA, 347 bp, Homo sapiens
ccgagcctagctagctcgtatcctctctgtggctccatatgctagcagagaggttgcactagaggcttgttcatgccgggcaaggccaagtcccctggatggttatccgggctgctttctgcacttgaacataaagtcctcctcaagacagcctgttgtctgcctcttggcaaccaagaagcctgcagtgccatacgagttctgaggcatggactggaggcccaaaggcagcgcacaccctgctcctgaccctgcggcttgtttcctctctgtggctccatttgtagcacagttgttgcactgaggcttgtgcatgccagggaaggccaagctggctcaaagagcaa

SEQ ID NO: 605956 - DNA, 105 bp, Homo sapiens
ataaacctggaatatagtaaaagctcaataaagtgtgagcctttcacaattggtattctcgtaccttaataggtaaccgttctttattccattactacctgtgtt

SEQ ID NO: 605957 - DNA, 1083 bp, Homo sapiens
tctatcacccatgaggctggagcacgcaaccatgatgatgctccatgtgaaccatgtctacttgcccttctcttgcctcatggaggaatccgtgtgtcatgcacgtaggtagctctgggactaactgatgctcatcaggaataatcggcccgagtgacgagctgcaccgatatgcttgcacaccagaagtattagaatgagtaggtctcattgatgggtacgatacatccgggtatcgtcatcacgacgatgttagatgcaccactacgtaagcataacagattgatgcacacatgtaacgggcccacttggccgggtgtacaccgtttaaaagcaaatggggaaaggcacgattgggactagaaagtaaacgggcttgtatgggcacgacttaacagctttcccttgacacttgtcgaaagcgcaaggtacatgatggcggaactggcccacatgaaactccgggccaaaacgccaagtgcacagccggattccttggagttgagacaacccttgtggattcgccaaaaacgggccaacgcctttttcccccattgagtcatagggccttacaaagtattgggttttacccgaaaaccgattaaattcttacaacccaaccaagggttgaccaacggagctcggcattccaaaattggtagagcaagacttggcgcgcttttgccgtttgtaagcgccaatccgtagatcattaaagcacagacaatttcgttccttttccccgttggagaaacgccaacttgtccgacgctagaagaaaatttgccgatgagcccaaacgccgcgaaccagtcgggaaacctaagttttggcgcctcccccttttagcggttgtgttagaagcgaacggcgttccatttaagttgattgcggcgtgtcgcaacaacaacacatagggcccaaggccactttgggcttacgagaacgggacacttcctggaccagcaaacagagggcatatcggattagcaccgtttaacccagtgcacccccggtataggaggcgcttaatgccgtttcacgcaccaaacataggtgttaccgggcacatttaaacttcag

SEQ ID NO: 605958 - DNA, 301 bp, Homo sapiens
ccaacaggcccgggggggacctttcccggacacctggcctcctcggcgaggcaggtggcagaactggttccacgtctgatcttccttagacaaacctgccttcagaggaaattgtgttcaactggagaaactggaaaatgtactagatattggctgatatgaaggatatatgttttaagtatgataattcgattttggctctgtagggaaaggctcttattttaaaaagatgtgcactagagaaaaaggaaacagcatgtagcaaatacatccacggatgtcctcctggtttaaaaaaaaa

SEQ ID NO: 605959 - DNA, 1043 bp, Homo sapiens
ttgctgctcgtgattgagatctagaaccgtagccagacatggagactggaggacgagcaaaagatgcttaccagacatccggcagatccgtgaggaggaggaagcaggcaagaggaggaattcagtggcatcccgctcaacacacagtgacgagcagccacatgcagagccagtctggcagaacatgctgtacaatggcccagagagagcagagctagcagctcctgctgactgcagcagtgatatccatcatcgagtcacactaccagcaagcaggactctgcaccggcacggcagccatcattatgcaccatatccttgccactgcagcaggcgacccaattgcagcatggaacccacagaagcgtcctatcctaacacaccgtctgacacactaacactgctcgctaggcaccattacacttcgaccacccaccaaggactccttcgagtcactcatgcgagcaactcaagcaaatagttggacccatgctactgcgctctatgcgcgcacctggttacccgcatgtaggatctatgctttcactcctctgggtcctaaaccctgggtacacgcctatcacgactgcaaacaccccttcaactgcgcgctttaatgcggcattctccccgcctcgcgctaagccctcctcttactggcttacacgtatacggcaaatctggaactatccacacgtccttaaactcacttaaaaaaaggagtctcattaattggaactcattgcccgcaccacagacagacgcaaacgaaagcaaagcgcgggcaccccacgcacgctacccaccagcaacgagtacataccagcctacaccagggagggccaccacaaacgacgatcaaaggaacggcatcacacccagagccccacacccactagagaacacgaaaagaaagtcgggacgccaccagacaagcggaaggacacactgcgcgaccaaccaagtctacagaagcccaaaacggaccgacaaccggcaaaccccgtcccaccaccccgcccacccacacacacaaccccaac

SEQ ID NO: 605960 - DNA, 1334 bp, Homo sapiens
gaagggtagtctgggccggagcaattgctcctgctgataatgcccagcactttgggatgcctacgcaggtgtatcgcttgcgttgcgtccagataatatcaagaataagtcatggagctaactatggcaaatactagttctacttacggataacataaagtatagtaagcatatatgcgctggaggctgtggtaggcgatgttgcctgttgtcccagcaacttgcgggaagaagctgtaatggtgaggcactaaatgagactatggaagcccctggagacgacgcgggcacggctgagtcacgttgagtctcacatgagtcactgttcacgctggcagctttgcaagactctaggggctgtacctatcaatgcagaatcccctgggacttgttatcaaagggggagctcggggcgagcgagcacggtcccatcgaaaactgttccgcgtgatatgtacaatagcaagcttatctaaaagggagctgaggtgaccttcacggggaacttcgacacacgttgcaccgagctaggatctttcacccggcactgcttgtaacccaggttaagtgaggcatttctaagcaccgtgtacggccacgtgggtggctagtaagaccccaccaagaggctttggacatggcgtgaacctttggacacgtctacaccgcggcgggcaatttggaggaacctcagggcatgagcattgcctttcccaaaaggaagtaccgcttaggggaaagacgtcccccatgtgtaagccaaccaaaggacttgagcgaaaccattcggctgcgttcccatatctgtaacagttggacactcaacgtttccacggggcctgtcgagactacaatgggctatgagcacggtccagcttgtgcaacaacaaggcctgtccccccaggtgaatattggcaatctggcgtagtacggtgcgaccaagggggaacccccatacatattcaacccctctggtgcaaccaccccgctggtacgccccgcgctgttcggagagaactggcctggccatatctggtcaaaacagccgcatgttaatcgtttattgtgaggggaccgccgcctgtacaaacagggggtgcgagtacataaaagagttaaagcagtaactagtgttacaatacccagaaggcattacattacggattaccaaacggtgaacgcgtgtgagcgcactaaccgaacattgcggtttgtcagcctaccttgtcactgtggtgcctcctgtgatcacctgcgcacgtagcataggctatgtcgtagacggcaaggtggtatgcgccgcccttcgacatgtccaacgtctctacagctg

SEQ ID NO: 605961 - DNA, 479 bp, Homo sapiens
tagctttactgagattttgttgcttatcacacaattcaccattgaagtgtcctgggctgatctgatgccgatggctccgagtcaaatgctctctaaaggaaattctcagaagatctccggggaaaagcacacataatttatagaattagaaagcaaaggatttgtaagacatcacaaggaattcagttaccagttaggactggtcacctccaaacttaagtacaaagaacttatttacttcttccaaggaaatttatttgggggattttttatgtggccatgatgatgctgtcagtggccgaagctgcattctggcaactccagatcctgggtgactttgcctagctctgcccggcctggtgttgcaggaaatacgctaattccaggcacggaagctgggagtgcatccggtctggggagactttgcctttctaagaggctctcagtgctgttgatggtgcacattcgacctttgagac

SEQ ID NO: 605962 - DNA, 171 bp, Homo sapiens
tcgataagggccaacgatgaagtgaaaggtatagaatcgtgtgagggtgggactgtctactggagtagcctcctcagattcattgaactaggtctgtcccaatgtctgggatggcggatagtaagttagtaattactgtggcccctcagaatgatatttggccttatcgag

SEQ ID NO: 605963 - DNA, 384 bp, Homo sapiens
cagctgcagcatatcgtgagtgatgagatctgtgtgcaggtgactgacctttacctggcagaaaataataatggggccaccggagccagcgtgaacacacagaactcaaggagcctcctggagtcaacgtatcagcggaaagctgagcagctaatggcagatgagaattgctttaaggtgagagttgggcaggtggtcgaagaccttgctggtgacaatgtcagttgttaggattctctgaaccagaagttaaagccggggtactttgacctgtgattctactcctggaccttttagtgagttcaccagagaactacagagtggaagtaattgtcttcctggacaatgtagtgtgtttctttcctgcctttaaagaaaaaaaaa

SEQ ID NO: 605964 - DNA, 744 bp, Homo sapiens
  misc_feature (68)..(68): n is a, c, g, or t
  misc_feature (105)..(106): n is a, c, g, or t
  misc_feature (109)..(109): n is a, c, g, or t
  misc_feature (160)..(160): n is a, c, g, or t
  misc_feature (162)..(162): n is a, c, g, or t
  misc_feature (167)..(168): n is a, c, g, or t
  misc_feature (172)..(172): n is a, c, g, or t
  misc_feature (184)..(185): n is a, c, g, or t
  misc_feature (216)..(217): n is a, c, g, or t
  misc_feature (219)..(219): n is a, c, g, or t
  misc_feature (230)..(230): n is a, c, g, or t
  misc_feature (234)..(234): n is a, c, g, or t
  misc_feature (238)..(239): n is a, c, g, or t
  misc_feature (241)..(241): n is a, c, g, or t
  misc_feature (284)..(284): n is a, c, g, or t
  misc_feature (298)..(298): n is a, c, g, or t
  misc_feature (336)..(336): n is a, c, g, or t
ggcctcggccgccgaatgcagagagaggagaagcagcttgaggcatcattagatgcactgctgagtcnagtggctgatctgaagaactctctggggagtttcatnngcnagtgggagaacgagtatggccggctgacctggccatctgtcctggacagcntntgccnntgcntttctggacagnntgaacacctctgaacaaggtcttgaagcatnnanaaaacaccgcntgtnccgnnanccaggtcatcattcctctggtgttgtctccagaccgagatgangatctcatgcggcngatggaaggacgggtgcctgttttcagccatgaggtangtccctgaaaccagtctgagaatccggaacgcctgagcctcgtgaaggtggtaaagaaggcaggagatagctaactgtacgatcatgactgctgcgccgcatttggtgcagggatggcggaccacgatagcagagtccacaagcttgatactaacgactgtgttcaaagccttctggtacgaacacagtcagcaagacgacggagcgacgaactcagaggagctggaggtctcgcggctcgaacatagccgtatgctttcaacctctacagtacacgtattgccttggctggcagttgttgccgttcgggcaaggactagtctaatggagaccttccggcgcggtggtcctggcaggcggccagcggagctgggggatcttgtggacctccggttcagcgggatgggg

SEQ ID NO: 605965 - DNA, 124 bp, Homo sapiens
tgtgacctagaggacccacatctctccctctcgacatcctgcggcgcgggtgtggtggtagtagcaaatattcaaacgagaactttgaaggatgtcggagagggagaggatgtcggcgagggag

SEQ ID NO: 605966 - DNA, 661 bp, Homo sapiens
  misc_feature (68)..(68): n is a, c, g, or t
  misc_feature (105)..(106): n is a, c, g, or t
  misc_feature (109)..(109): n is a, c, g, or t
  misc_feature (160)..(160): n is a, c, g, or t
  misc_feature (162)..(162): n is a, c, g, or t
  misc_feature (167)..(168): n is a, c, g, or t
  misc_feature (172)..(172): n is a, c, g, or t
  misc_feature (184)..(185): n is a, c, g, or t
  misc_feature (216)..(217): n is a, c, g, or t
  misc_feature (219)..(219): n is a, c, g, or t
  misc_feature (230)..(230): n is a, c, g, or t
  misc_feature (234)..(234): n is a, c, g, or t
  misc_feature (238)..(239): n is a, c, g, or t
  misc_feature (241)..(241): n is a, c, g, or t
  misc_feature (284)..(284): n is a, c, g, or t
  misc_feature (298)..(298): n is a, c, g, or t
  misc_feature (336)..(336): n is a, c, g, or t
ggcctcggccgccgaatgcagagagaggagaagcagcttgaggcatcattagatgcactgctgagtcnagtggctgatctgaagaactctctggggagtttcatnngcnagtgggagaacgagtatggccggctgacctggccatctgtcctggacagcntntgccnntgcntttctggacagnntgaacacctctgaacaaggtcttgaagcatnnanaaaacaccgcntgtnccgnnanccaggtcatcattcctctggtgttgtctccagaccgagatgangatctcatgcggcngatggaaggacgggtgcctgttttcagccatgaggtangtccctgacccatctggagaaccaagcctgaccctgaagtggacgaacaggagaagcaatctgagggacaagaggctgcccgcatgtggtgcagatgcagcccagaagcagatccagagctgtgaataaaagtgtgttcaaaccctttcgtggagaaaatcagcaaagaggagcgagaaatcagagaggtgggaggtctccggccgaaacaagcagaccttttaaccctacagacacttaatgcctgtggggccagcttggttccctttgggcaaaagggactatcctaaattgggggagaccttcaggcaagcaggggtcctgg

SEQ ID NO: 605967 - DNA, 976 bp, Homo sapiens
gcctgtctggggcatctgtctgggactctgtcggtgcctctcacctggcgaggggcttgtggtgggggtaggcgggaagtccttggcgccgggctttgtgccaagccctgctctgctgggctgcgggctggtggcgctcacccagctcctcacctgccccgcgtcctcctgtatttcttccttttctggttggacaactggagagttgagaggaggcacgatggcttccatcccagaaatcgctctcctctttccatccctacagagagggacagagaggcaaagttccttgcatcccctggggcgcttgtccctgtgagctcccggtgtcctgcacacgtgggcccctgagtcacctgggcctgtgtgtgtgcgatgggtggctccgtggccaagctggctcctggggttcacttactgatttcctaccccaactcttactgtgtggctttgctggcttccattggggagtgcacatgggtttggatgggcagatgagggcccgctggagagctgtacccctcagatgaaggccagcacttgatggtttttgatggataatgcggttgacctctttgttaccttccacaatagtaatgtagaccaacaaacagtaaactgactaaataataagattcgtgatgaattagcccaaattgggaagaagcaacttccttcataaacattgagaagaaggtcaaaccaccttgacgtggactgcatagagacctgcgaactgggtatgaccggaagagatggagagatgtaactgtgaaatcacgtatcgctgagaaggctaggatggtcaggggacggagcgatgaaacgtagaaagggagagaaactgaagttcagccgaggagagaagaagatcggaggcaaaggacgaagaggaaatgggaacacgagcgagagatacgagaaaatgaaagacgagacggttttcgtagtacctttcttttcgattgattccaag

SEQ ID NO: 605968 - DNA, 839 bp, Homo sapiens
  misc_feature (168)..(168): n is a, c, g, or t
  misc_feature (319)..(319): n is a, c, g, or t
  misc_feature (327)..(327): n is a, c, g, or t
  misc_feature (329)..(329): n is a, c, g, or t
  misc_feature (338)..(339): n is a, c, g, or t
  misc_feature (342)..(342): n is a, c, g, or t
  misc_feature (344)..(345): n is a, c, g, or t
  misc_feature (348)..(348): n is a, c, g, or t
  misc_feature (352)..(352): n is a, c, g, or t
  misc_feature (354)..(354): n is a, c, g, or t
  misc_feature (372)..(372): n is a, c, g, or t
  misc_feature (374)..(374): n is a, c, g, or t
  misc_feature (377)..(377): n is a, c, g, or t
  misc_feature (382)..(382): n is a, c, g, or t
  misc_feature (385)..(385): n is a, c, g, or t
  misc_feature (399)..(399): n is a, c, g, or t
  misc_feature (405)..(405): n is a, c, g, or t
  misc_feature (409)..(409): n is a, c, g, or t
  misc_feature (414)..(414): n is a, c, g, or t
  misc_feature (438)..(438): n is a, c, g, or t
  misc_feature (446)..(446): n is a, c, g, or t
  misc_feature (449)..(449): n is a, c, g, or t
  misc_feature (464)..(464): n is a, c, g, or t
  misc_feature (469)..(469): n is a, c, g, or t
  misc_feature (471)..(471): n is a, c, g, or t
  misc_feature (476)..(476): n is a, c, g, or t
  misc_feature (481)..(481): n is a, c, g, or t
  misc_feature (489)..(489): n is a, c, g, or t
  misc_feature (494)..(495): n is a, c, g, or t
  misc_feature (504)..(504): n is a, c, g, or t
  misc_feature (510)..(510): n is a, c, g, or t
  misc_feature (530)..(530): n is a, c, g, or t
  misc_feature (540)..(540): n is a, c, g, or t
  misc_feature (545)..(546): n is a, c, g, or t
  misc_feature (575)..(575): n is a, c, g, or t
  misc_feature (582)..(582): n is a, c, g, or t
  misc_feature (592)..(592): n is a, c, g, or t
  misc_feature (602)..(602): n is a, c, g, or t
  misc_feature (616)..(616): n is a, c, g, or t
  misc_feature (633)..(633): n is a, c, g, or t
  misc_feature (651)..(651): n is a, c, g, or t
  misc_feature (658)..(658): n is a, c, g, or t
  misc_feature (665)..(665): n is a, c, g, or t
  misc_feature (718)..(718): n is a, c, g, or t
  misc_feature (747)..(747): n is a, c, g, or t
  misc_feature (749)..(749): n is a, c, g, or t
  misc_feature (796)..(796): n is a, c, g, or t
gagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgnacgtccgccccgaggctgaggaccagtaggcagctcccaagatgggtgaaaggaaaggggtcaacaagtactatcctccagacttcaaccctgagaagcatggctctctcaaccgaataccacaacagccacccgcgttgggagcgggccnggaagccntnacagggcannctnannaancgantngaaaatccaaaaaacaantnggncgaangcntcaagaaccacaanggcaangganttcgntacaaatcagaaaagaagaagganggcaaatncancacaaccccgaatancaggntncggantaaantccacccnatttnnaacaacaangagaancagacggaccccgccaacancgacaacganaattnnagctgcgcccagcgcaaggaggagcgcgnggacagngcggacaaanagcaggggcngaccacagagcaanagaagaagcagaagcgngagacggacgccatgttncggccgnagcacgncgaggccgaccgcagcacacactagaaggcgccgtccacacggtgccacaacnaggaggcccagagcgccgtgaagacgacntngcccctacagcagtcgtggagaagggtcgggaaaagaaaaagccacncaggaggaggaggagagagacaggccttcaggcaaggcgagcc

SEQ ID NO: 605969 - DNA, 336 bp, Homo sapiens
gtgtgagaaatggctgactttgcatggaagtcgtgctaaagagtgggagcatgtgtgtgcgaattaactgaagtcagagagtggaatatacgtgcagtgaaggaagctgagtgcttcatttgcaacagaccatgtagtttctaacatgttatttacattgtttaattactttcagcgctcgtttggctatcatcacgagttcttatcgctataccatttgtgcacatcagttatacatgatacataaatgttaatggatgtcaggccttgattaagataacctgcaagaacttattcagattattttatagtagtgcctttattgatagcagataa

SEQ ID NO: 605970 - DNA, 411 bp, Homo sapiens
aagaggtggtaacatcatcactcttgcaaatatgattgtactgatagaaaacacagaaaaatcaactaaacgacttccaatgtgggcagggattggtggctcatacctgtaatcccaacacttgggaaggccgtagcgggcggatcacttgaggtcaggagttcatgaccagccgggccaacatggtgaaaccccatctctactaaaaaatacaaaatttatccaggcatggtggcgtgcacctataatcccaactactcaggaggctgaggcaggagaatagcttgaactcgggaggcagaggttgcagtgagccaagatcatgccatcccactctagcttgggcaatagagcaaggctccgtctcaagaaaagaaggtcatttcccaagactagcatagaacatatctg

SEQ ID NO: 605971 - DNA, 256 bp, Homo sapiens
ctctctctgtggggtcatcactgggcaggcgggtctcgaactccttttttttttaatttttattattattatacttcaagttttaggaaacaggggcacaactggcaggttggttacatatgtatacatgtgccaggtgggggtgcggcacccattaactcatttagcattaggtcatttcagcattaggtatcatctcctaaaggctatacctcccccctccccccaccccacagagatagcgtcggggtacgga

SEQ ID NO: 605972 - DNA, 738 bp, Homo sapiens
ggcggactatgtcagataaggaagtgagcgattgagagatggtgcaatagggcatgcctcgaccaggcacgggagacgcccatatgacgtgtgtacatggtccgggcgcgcccgtgcttaataacacgcccccaagtacgaaggagccccgaagctgcatataatgggagttgtggacgaactagagactcagaaagcgaataactggcagaggcagaatccggtgcatataactgtcaccagctcagaaacgaatcaacagtaatagacaagtaggaacccccagataactatcgagcagacgcaggaaaagaagatacagcagtcaggaactaggcagtcgcacactcgattaatacacgtggagctccagtaatcaatgtaacaaggggtaacagagacaacgaaagttgagagtcaggacggtcacgacagcgaaggtggacaggtagtgataaagccaggatatcgatgaaggtaaccagctgagttaaatagtagattattagtgattatggtagatacaagaaggcgagaagtatttatccaggtacgagagagctagttgtagggatgaagaatgaccgtacacattgtaaagaaaagtgacagagtagattagtaagtgacgtgatttgacaacagtcggaatatacccccgtagaagtgatggtaagatatagaggtgaagaagttagagcaccagtcaatctaagagacaggggttagatacagaaa

SEQ ID NO: 605973 - DNA, 263 bp, Homo sapiens
gtggatgatgggaaggaagggggttcttccactttggaaaagtctggtacttcctcaaaatgctaaaaacaatgtgtccatataacccaacaatttccttctaggtattatgagggtgggggaagtgtctgataagtaaatgatagcaggacagcgttagtatccatactatctaaaaagtgaaaacaaccactttgtctattgctatatggataaacaaaagtgtgaactctattacagtggaaaaaccctttttgccaaaa

SEQ ID NO: 605974 - DNA, 249 bp, Homo sapiens
ctcacccgaggggtgcacttcacgctgacctgcctcacctttaaccccccacctggagcgccaggtcctaactctgacctccaaattctctttgatctctgaatcccgtctgactccaacttctctttcaccctctatgagtcccattttacttctacacctgcaagtcctggtttatattggacccctccctccgagctgcagttcacctttgaccttgcctcacctttcaccccccaccccgtcggg

SEQ ID NO: 605975 - DNA, 150 bp, Homo sapiens
acagagaatgctgagagaaatagacttcatattttacagaaggggttgaaacatacagagtattcgtaatgatgcagtagcacatccagatctgactcctaagtagatgaggcattataatgggtagagagttgagagggttaatggcaa

SEQ ID NO: 605976 - DNA, 496 bp, Homo sapiens
ggaacatcaagaatgcccagccaggaggggcatggctgccaatggttgtcccctgttgctctacgagccttctgttccttggccatacccctggatgtgcctcctgtgcctgatgtccccagttggggtcagtctcaatgagtgatgccagtcttcttggagcctctgggcagaaccctccatcaagagtggaaatcgagacgggagccccgtgtagcttcccgtgaccacgccgattgaccagctatcttggggaagtttacttgttgaaggggtttctggcctttagcgaatggggttcactcaagggggttccctgaggcccagtggccaatggtactcccacctgcctaccttagcacatgggtctctgcagggactgagggagccagctgctccttgcctgccctcttgcccatgacagccctcttccccagtccagtgctgggcaacgacgggcggggctgtcctttgactactggtgcccggaaccctg

SEQ ID NO: 605977 - DNA, 353 bp, Homo sapiens
tcatgccactgcacaccagcctgggtgagagaacaatgctctatctcaaaaataaacaaaaacaaaataaaacaaaagaaaaacaaagaggagttttagaacaaaactttggaggaaaaacatatcctctctattcaggggagaagatcagatagggagagcatggtaatttgcaaaatgctcccacatgtcctgaaaaccaacctgcaaagccattgttttgattaaccccaatttacagatgagggaaccgaggctcagacaggataagtggccactcagagggatgttgccagtctgcgtgatttccagtcccacgctctctccactacttagtgtagtttggacaattt

SEQ ID NO: 605978 - DNA, 94 bp, Homo sapiens
ggcagtaccgggcgtcatcacgagagctcgcagcggtggctaggattccacttccggtgtcatgacctcaggaactcaacgtccttgactttat

SEQ ID NO: 605979 - DNA, 590 bp, Homo sapiens
  misc_feature (93)..(93): n is a, c, g, or t
  misc_feature (201)..(201): n is a, c, g, or t
caaagtgggactaacaagactctttttatgtcctctactgcttttctactcaaagtatggtccaagtaccaagaaaaataccacctaggagtntgttagaaatgcagactcggtcccacctaaaccttctgaattagaatctggatttaataagcccagctgatttgtatgcataagaaaatataagaagcacttctttantgcaaccccttaaaacattatgcaaagtctcttaaattttttcttttctttgtgaaatgtaagctaaaatgttcagtggtataaaaagcatcttttaaaagttgtaagtaaagcaaatataaaacaacaatggtagaatctaggtagtatatttgcaaatgttttaaataaaactcaattttgtatttgaaaatgtttcataagaaaatgttggaagaaaaaataataaatattagaatcatgttttctcagtaccttctctcctaagaaaagtcaaggagactgtgaagacagtaaaaagaaaaacaaaaaccaagcctcttcctggtctttggaacctggaaatggatttatgtgaaatcttaattcctctaaagtaaagtgatata

SEQ ID NO: 605980 - DNA, 220 bp, Homo sapiens
  misc_feature (41)..(41): n is a, c, g, or t
ggggggggggggccctcccccccccccaacaaggggggggnttttttggggccccccccccggggttttttttttggggggggccaaaaaggcccccccccccccccccccgggggggggggggggggccccccccttttttttccggggggggattttttttgggttttttccccaaaggggtttttttcccccccccccccctttttgggggggggga

SEQ ID NO: 605981 - DNA, 572 bp, Homo sapiens
cgagctctgggacacgacttttgggagttctttcttccagcgtattcccctcccccctaccttttgcagggcgtcccggcgctggccttcccggaccttgcgcccctcagccccgagacctattgctgggaacaccccgcagcaattttcccgaatcttctggcacaaacagtatcgtctaagtttctttcgggcaccaacaatcgtcacccaaaaatcgtgcccagatctgcgcgcccaaaataggggcaacgaatcagtgggtgaacaagagatcccaatggtcaacactcttgtgtcaccacgccattcatccgactatattttgtgagggccacccaacagcagacgcccccggtggatagaccgctttattgggataatattctcttctctcagggcactcgtcttaaatgaccacttttccagcattgcctacggaaccacccctactctttgcccctgtatggcgcaatctccagacaacaatgattttttccccctactcactataattcattaaccgcctctctcctcccgccttataagattctcatcaataatacacaaaa

SEQ ID NO: 605982 - DNA, 1405 bp, Homo sapiens
ggaggagcggggctgtatcctctctccgccactggtcgtgtgctcgacccactggatatcgcgtgtactcgccgagagcagggggtagtcatctggtcaccaaattgtcacctgggcctgcgattgtagttcagaggctcctattacgaaccagagtattggtgaactggagtgcacagccaatcttgcgcaagataacaagcgagacgaggccgcttatgcgtgtcaggtgaattagcaaggtcatcagactagtgctgagtctaggcggtactggacagaagctgtgggcttcgagatatcacacagatgatatccgacggtcggtgggtgatctgcagccagactcgtggactcgaaggtagcttcttatggggaaacgatcgtagtacggtcgggagggacccgagagtggtgtatggtctacacgataagccagaaatcctggacgacctgctgtggacgatcggttagaagtagaaaaaatcaaattctcagaaacacacggaatagcaggcgcaatctagtttgtctgggcacacttggactaggccctggaggacccccttaacccaaggtagcttgggtaccagtgttgctaaatagggtcacaccgttactttggaccggaaatgttccctaggaaacgttaccatttccgggtaagtttagaggcgagatgaaaagttcggaaagtggttacgagaaggaatgaacctgaggaagagtctagaaatgggggtaccttttagaggaatacacttaacaaaggacttggtaactagatttcttcaccccctgagggggataatggacattcttcgacgttggacataggataaggctgggagtaaacgaggcatagaatggacagatgaacacgccagcgaccggaaatgacccgagacggccacgggagcgcccggccggccatgcaatcctaatcaaaggcgccggcgcaaagggggaatcaacacacagcggagagacgacaagaggccccagagcagatatgacacgcgcctcaaaaggagagcgcaccaccctcaacacgtcctcagcagcccgaggccactgaacggcaagtgtcggaacaattccgcagcaagggacacacaaaaggccacccggagaaaggaacaaaaggcaggccgcatagagaacaagacggtgcacaccaagaagcaggaacacacgacctggcgacgagcgagcacagcccaggaaaacaaacgagccgacacacagccgcagccgcccctcagatcgtcagcacgaacaaacaatcgagaccgatgccactacgagagcacagcatcaggagaggaaacaacggctttcgatcccccccgcccgcgatcccacccgctcagctcaacgacgagaccacagaacacagccgagt

SEQ ID NO: 605983 - DNA, 1093 bp, Homo sapiens
  misc_feature (17)..(17): n is a, c, g, or t
  misc_feature (25)..(25): n is a, c, g, or t
  misc_feature (27)..(27): n is a, c, g, or t
  misc_feature (50)..(50): n is a, c, g, or t
  misc_feature (52)..(52): n is a, c, g, or t
  misc_feature (60)..(60): n is a, c, g, or t
  misc_feature (82)..(82): n is a, c, g, or t
  misc_feature (84)..(84): n is a, c, g, or t
  misc_feature (100)..(100): n is a, c, g, or t
  misc_feature (131)..(131): n is a, c, g, or t
  misc_feature (156)..(156): n is a, c, g, or t
  misc_feature (162)..(162): n is a, c, g, or t
  misc_feature (188)..(188): n is a, c, g, or t
  misc_feature (190)..(190): n is a, c, g, or t
  misc_feature (204)..(204): n is a, c, g, or t
  misc_feature (210)..(210): n is a, c, g, or t
  misc_feature (214)..(214): n is a, c, g, or t
  misc_feature (254)..(254): n is a, c, g, or t
  misc_feature (260)..(260): n is a, c, g, or t
  misc_feature (264)..(264): n is a, c, g, or t
  misc_feature (268)..(268): n is a, c, g, or t
  misc_feature (272)..(272): n is a, c, g, or t
  misc_feature (284)..(284): n is a, c, g, or t
  misc_feature (292)..(292): n is a, c, g, or t
  misc_feature (299)..(299): n is a, c, g, or t
  misc_feature (308)..(308): n is a, c, g, or t
  misc_feature (360)..(360): n is a, c, g, or t
  misc_feature (379)..(379): n is a, c, g, or t
  misc_feature (385)..(385): n is a, c, g, or t
  misc_feature (437)..(437): n is a, c, g, or t
  misc_feature (511)..(512): n is a, c, g, or t
  misc_feature (593)..(593): n is a, c, g, or t
  misc_feature (613)..(613): n is a, c, g, or t
  misc_feature (699)..(699): n is a, c, g, or t
  misc_feature (701)..(702): n is a, c, g, or t
  misc_feature (704)..(704): n is a, c, g, or t
  misc_feature (727)..(728): n is a, c, g, or t
  misc_feature (734)..(734): n is a, c, g, or t
  misc_feature (739)..(739): n is a, c, g, or t
  misc_feature (743)..(743): n is a, c, g, or t
  misc_feature (745)..(745): n is a, c, g, or t
  misc_feature (749)..(749): n is a, c, g, or t
  misc_feature (753)..(753): n is a, c, g, or t
  misc_feature (762)..(762): n is a, c, g, or t
  misc_feature (766)..(766): n is a, c, g, or t
  misc_feature (777)..(777): n is a, c, g, or t
  misc_feature (780)..(780): n is a, c, g, or t
  misc_feature (783)..(784): n is a, c, g, or t
  misc_feature (786)..(786): n is a, c, g, or t
  misc_feature (803)..(803): n is a, c, g, or t
  misc_feature (807)..(807): n is a, c, g, or t
  misc_feature (846)..(846): n is a, c, g, or t
  misc_feature (886)..(886): n is a, c, g, or t
  misc_feature (897)..(897): n is a, c, g, or t
  misc_feature (907)..(907): n is a, c, g, or t
  misc_feature (935)..(935): n is a, c, g, or t
  misc_feature (950)..(950): n is a, c, g, or t
  misc_feature (983)..(985): n is a, c, g, or t
  misc_feature (1086)..(1086): n is a, c, g, or t
agctgcacagccgtgcncagagagntnctggatcctaggcttatctccananaggagaanacacaaagacagcacgagtacnanagagagaacccatacntacacgcacaccatacccctgcacacagcgnactcaaactggaaagggcgcgtccngctcanagcatcacttattaaacttctggaancngcccaccagcatgncgcaantcangattgaagccgagccaaccaaagtttccgaggggaaggangtactnctanttgnccanaatttgccccanaatcttancggctanatctggtanaaagggcaaatgacgaggcacctctaccaatatgagcattgacatctactangtagtagacaggctgaaanaattanatatgggcctgcatatagtggacgagaaacagcatattgccaatgcatcccngctgatccagacctgtcacccgcgcgaggaccgcagagactcctcacacctatacacaatcataagagggaganngatggggactagatggagtaactaggacgtttcacctttcaccgttacacctgagagactcctaagccctccatctccagnagcaacttaaatcccagggngaccatgggggctgtgagcttaacctgtgaccctgagactccagacgcaagctacctgtggtggatgaatggtcagagcctccctntnngncacagggtgaaggggtccgaaannaacagnacccncaancnattnggtntcacaaagnatantgcaggacccnaanaanntnaaatacggaacccagtnagtnccagccgcagttacccagtcaccctgaatctcctcccgnagctgcccaagccctacatcaccatcaacaaacttaaacnccagggagaantaaggatgtnttaaacttcacctgtgaatcctaagagngagaactacacctanatttgggggctaaatggtcagagcctcccggtnnntccaggggtatagcgacccattgaaaacaggatctcattctacccagtgtcacgagaaatgaacagggccctatcaatgtgaaatacgggaccgatatggnggcatcc

SEQ ID NO: 605984 - DNA, 778 bp, Homo sapiens
ggctacggacgccatgaatatttgcccaagaagagctggcacgttccggaacaaggacaatgtcgcccgcgtgcggcgtgacgaggcccaggcccgggaggaggagaaggagcgtgacgcggagggtgctgcgtggctcacaacgaggcccgtacagaattcctacggaagaaagccagacatcagaactcactgtctgagcttgaagcgagcaaagacggcgggagccctcaaagcttctggcccttgtgggacctgattgcagcggagcgtgcatggagaggaacgtggaaaggaggtgagcagaggcaactaaagagtacgaggaataatatgcgacaggagaaagagaggcataggtagaagagcttcttggtgctattctggaccgaatacctggcgccagagatgtgcgcggaggtcacagactcaagcgcgcttagtacccaggcataaggcccccagggtcggaggtagagtccgcgcgcgacacgggatccttgcaccgcattatcgacgaaggtagtctggtaagcacaggctaggagcccatcttgtcgtggcaggaatgcctgtaacgctactcctcgtggaaatgggaagaggaccatcttccgggcgcgcttaaataaactgccaccacgcagaggcatacagggagaccatgagggtgcgtgtgataaatccgggtaacacaaggatatgtctgtcttgagacctatccttggatcccaacagtcttgtgcccgaacgtctacaatgctgtgtagaggccctg

SEQ ID NO: 605985 - DNA, 422 bp, Homo sapiens
  misc_feature (286)..(286): n is a, c, g, or t
  misc_feature (351)..(351): n is a, c, g, or t
  misc_feature (411)..(411): n is a, c, g, or t
agcaggaggggcctgagatggtagctccaggagctggtctagaggcttctggggacccagaggctttgggctcctggtcctggtcagcgtttggtccctggctggaatggggaggggaggttgacccccagggtggagggatggacgcctgcagggtccagctggagagctctgtgccccctcctggagcccccggaacgttgatggtgtgtctggcgccccacttgggtcagcctcatcctgagggctgaacctgagcccctggcattcactgtgcccatgtggnccttcagccttcgttcacgtgactctcacttcccagatgaagatctcctttcaacgacaaaagcntgcagaccacattttgagtaccctttccgagagttccttagagcaaggaggaaagaggtnggaccagcagg

SEQ ID NO: 605986 - DNA, 297 bp, Homo sapiens
  misc_feature (44)..(44): n is a, c, g, or t
  misc_feature (145)..(145): n is a, c, g, or t
  misc_feature (173)..(173): n is a, c, g, or t
  misc_feature (295)..(295): n is a, c, g, or t
gataaaaactcaaaggtaacagggccgggcacagtggctcacanctgtaatgccggtgctttgggaggctgaggcgggtggatcacctggggtcgggagttcgagatcagactgaccaacatggagaaatggtggcgcatgctgntaatcccagctactcgggaggctgaggngggagggtcgcttggacccgagaggcggaggttccggtgagccgagatcacaccattgcactccagcctgggcaacgggagtgaaactctaatctcaaaaaacaaacaggccaggcgctgtngc

SEQ ID NO: 605987 - DNA, 656 bp, Homo sapiens
  misc_feature (30)..(30): n is a, c, g, or t
  misc_feature (69)..(69): n is a, c, g, or t
  misc_feature (96)..(97): n is a, c, g, or t
  misc_feature (101)..(101): n is a, c, g, or t
  misc_feature (144)..(144): n is a, c, g, or t
  misc_feature (158)..(158): n is a, c, g, or t
  misc_feature (200)..(200): n is a, c, g, or t
  misc_feature (234)..(234): n is a, c, g, or t
  misc_feature (239)..(239): n is a, c, g, or t
  misc_feature (283)..(283): n is a, c, g, or t
  misc_feature (290)..(290): n is a, c, g, or t
  misc_feature (322)..(322): n is a, c, g, or t
  misc_feature (331)..(331): n is a, c, g, or t
  misc_feature (360)..(360): n is a, c, g, or t
  misc_feature (370)..(370): n is a, c, g, or t
  misc_feature (373)..(373): n is a, c, g, or t
  misc_feature (507)..(507): n is a, c, g, or t
  misc_feature (540)..(540): n is a, c, g, or t
  misc_feature (544)..(544): n is a, c, g, or t
  misc_feature (578)..(578): n is a, c, g, or t
  misc_feature (586)..(586): n is a, c, g, or t
  misc_feature (653)..(653): n is a, c, g, or t
ccgaatgggggggaagcccggatggtgcgncaccacctcaggcacaaagatgatcgcccgcaggtaagngggatcagcaccccacggcgcgggggnngcgnaggtgaggagggggcaacaccccaatctgcagcatggtctatnagagagggccgggnatggggccgagccagcgacgccagtgcagaaatggtatggancagagttcggaaccgtgcgcaggtccagcggcgngcgcngggccttcccccggagagccatcttggcgctgagcacagggcgnccatagncatgctaggacagcgaggacctcagcgctggntctgcgtgnggaccagaggcaaatggttgacgctagcngttgacaganacnggatggtgccagaggggcttgattggtgcagcgcggttggggccaggacccgcagctccagcttcaatggggagtcaatcactgctgggctcagcaggacaatgctcccaaagtaggtggccctcagcagcatntccaggtcgtggggcacttgtcccccaccagcnaaanctgcagggcccccgcccggaagtagctctccatngcagagtngaagaagaactcagagaaggccacatacaccatccgctcttcctcctgcagctggggttcactgccnggt

SEQ ID NO: 605988 - DNA, 280 bp, Homo sapiens
actcccagtgtgaggggctcatcgcccatccccagcgctgtccctacaggcgcagcacggtcgttatgggccttaccagacctgggtcagctcatactgcaggtccttgatggtgctgttcttcgactcaatgaacatcctccagcttgcgggcacaccagcgtcaggtctgcagggtccatggtcagaggcgagcagcgaccctcgtcgaactgcacctccttcttctccacagcggtgctcagagccttgtcgcttgcggttctagcacctcccaggt

SEQ ID NO: 605989 - DNA, 537 bp, Homo sapiens
  misc_feature (113)..(113): n is a, c, g, or t
  misc_feature (213)..(213): n is a, c, g, or t
  misc_feature (227)..(227): n is a, c, g, or t
  misc_feature (241)..(241): n is a, c, g, or t
  misc_feature (245)..(245): n is a, c, g, or t
  misc_feature (256)..(258): n is a, c, g, or t
  misc_feature (260)..(260): n is a, c, g, or t
  misc_feature (263)..(263): n is a, c, g, or t
  misc_feature (276)..(276): n is a, c, g, or t
  misc_feature (278)..(278): n is a, c, g, or t
  misc_feature (285)..(285): n is a, c, g, or t
  misc_feature (289)..(289): n is a, c, g, or t
  misc_feature (292)..(292): n is a, c, g, or t
  misc_feature (298)..(298): n is a, c, g, or t
  misc_feature (307)..(307): n is a, c, g, or t
  misc_feature (330)..(330): n is a, c, g, or t
  misc_feature (333)..(333): n is a, c, g, or t
  misc_feature (349)..(349): n is a, c, g, or t
  misc_feature (358)..(358): n is a, c, g, or t
  misc_feature (387)..(387): n is a, c, g, or t
  misc_feature (389)..(389): n is a, c, g, or t
  misc_feature (395)..(395): n is a, c, g, or t
  misc_feature (398)..(398): n is a, c, g, or t
  misc_feature (401)..(401): n is a, c, g, or t
  misc_feature (407)..(407): n is a, c, g, or t
  misc_feature (505)..(505): n is a, c, g, or t
  misc_feature (511)..(511): n is a, c, g, or t
  misc_feature (530)..(530): n is a, c, g, or t
atgttgagcaggcctgggtctgtgctcttttctctttctccttagtcctctcaaagcattaactaatctatggggttcattattggaattaacctggtgctggatattttcanattgtatctagtgcagctgattttaaccataaccactgtgttcctggccatagtgtgttctgattagaaatgacccatattatactaagaaaagatccgnctttattttttggnagatagaaataaanagcnatatccctggnnngnagntttttttcaacancnatgttcnttgnaanggtacngatcaagcnttggtgaggtggtttgaatgttntgncattaacagttttccntgaaaacgntttattggggttttaatttatttattaananggattntcnganatttanatttttattttattttttttccccctgaggtctttttacatgtggaaagggaatttgaatgaaaaatttaagccttgtttggttattgttcccagacnttgtcnataaaagccttttagttgnatgcgga

SEQ ID NO: 605990 - DNA, 165 bp, Homo sapiens
gcggtcgcctactactactaaattcgcggccgcgtcgaccctcataaaaggaaagccacaggactgggcagcagcagaatctaagttatatgaagtaggaaatgaaaaatagaagagggaaaataaaaaaaatagaagaggtattgttaattgtggaggacaaag

SEQ ID NO: 605991 - DNA, 238 bp, Homo sapiens
tgcgcctgggcttgggccggtggctgcggcccctgcctctcctgtctcgccgtccccgtcctctgcccttttccgcagcttcgcttccccctcgcgcgcacgccctgcatcgcacccgtccgctcgccgcgcacccccccgctgcctccgcacccgctgccgccgccgccgccgcctctcaccgcgccgccgctgctgcacacattgtcgcagcatcggggcatcctctcacatcgca

SEQ ID NO: 605992 - DNA, 359 bp, Homo sapiens
  misc_feature (8)..(8): n is a, c, g, or t
  misc_feature (20)..(20): n is a, c, g, or t
  misc_feature (83)..(83): n is a, c, g, or t
  misc_feature (174)..(174): n is a, c, g, or t
  misc_feature (225)..(225): n is a, c, g, or t
  misc_feature (249)..(249): n is a, c, g, or t
  misc_feature (309)..(309): n is a, c, g, or t
  misc_feature (336)..(336): n is a, c, g, or t
acataggnacattctaaagnttccttgatttgatcattataagatgtgctgggactcaagcacagggaaactgaactcttttngtgtcattggatgtttcatttttgacactaattttttctgggacaaactctttatgtgtttttcccaaggaatagttatctacttccgggnggcaaaatccttgggatttactaacatggatgatttaccttttcttcaccnttggtcgttacattgttaggaaangcaacaggaaaaaatccaattcatttggacctaaaaacaggcctcaggttttaaaaccangctcacgtttttctttagggggaaaantttgctttctttaaacttacatc

SEQ ID NO: 605993 - DNA, 460 bp, Homo sapiens
taaaaatatcaccatttctcaatttccagcaccaacctttttcaattgtccttgggaaaattaatgccctcctgcctcgtggtaaaatgcccagtcctttccatatgtgttgcccttcccaccgatggtgacggttgacacaaggcgtttctgcctttgcccactatcacttcctctaagggttcccatccgttgtaagaagagcaaggcaagtccttggccagagctccagtgccttggcgccacctgcccagaagtcccggaagaaagccgtagctgcctgggtgctctggaaagttcgctgcacccatcctgtcaaggttcgtccaagccgagatccaatgtagtgcaccgcctcggcgccgcggctcccgccgcgcagacaccgcacccgcagcatcgccctggcccggctggtacacgcgcggaatgttcctggcctactgggccgcgtcggtcc

SEQ ID NO: 605994 - DNA, 829 bp, Homo sapiens
cagaggaagcagccgcgctcccacccacccacacccaacgagaccctcgatacgcctcttctccgggagccagtgccgccgccaccgccgaccgcccaggaccatcgccaccctccgcagccatgtaccaccaggtccgcttagtcctcgtcctcctaccgcaggatagtttcaggcggcccgggaccaccgcgagaccggccgagactccagccggagctacgtgactacgtaccacccgcacactacagaccatagggcagccgcgctgacgccccagacaccagccgcagcctctaccagcctacgtaccccgggcggcagtagtatgccacgcgctcctctgccgtgcgcctgcggagacagacgtgcccggggtgcggatacctgcaggactcggatggacttctcgctggccgacagccaatcaaccaccgagatacaagaaacaacccgccaccaacagagaaggtggagactgcaggagctgaatgaccgcttcgaccaactacatcgacaaggtgcgctataccctaggcagcaggcagcacataagtatacctgcatgggcacgacgactacgaagcagactacaagggcccaaggacaaaagatcgccgccatggggggaccctcctcacgacggagcgaggatgcaggagccagccccgggcaggtggcaccagttaaccaaccgagaaagcccgcgatcgagagtggagcgcgacaaccatggccgcaggaccatcatggccccccgggaaaatgccagaccgagcatcctcagacaccagcaacgaaacccagaagcaaagaccgatgtgccagc

SEQ ID NO: 605995 - DNA, 893 bp, Homo sapiens
tccaaggcttggaccgggttatacagcgtgcggcacgagtgtggccctcagcggcgttggcgctgggctgcacgaaagaggggcgcttaggagtcttctttctcccgcgtagcgccccacttgcacggagcacaagctctctttgtgtgaatagaagggagaggggaggaccaccatttattatgagagaagacaatatatagagaatggaggatatgagaggaagagaagtttaaggagagccccacgaagattctactattggaagggtgagtacatttacgacggtgttgtcccgtgtgtagcacccagaggtgggtattaaggcttccaaggagcctgggagaaggggaacataatgtagggttaagcttttatactacataatatctataagggctccaagaatgttgggagattttaccgacgcgggaagagacccgtcgggtgtttgagaatatagctgagatctatgtaaaattatgggtatgggttaccccggtaaaaatgggcacgaagttcttttttatgggaaaaaatatagagggagaaggtataagggctcctctttggataaagctcgctcgttttaatttgtgggaccacagctcgagtccactcttggagatttctttaaaggaattttttataacgaaatggaattaatcactctttcttggccacgaagatttgctacccctaaaggtgaggttggggaaatttctgttgccgacgaaccacactacaaccttagtatgagctccccttttatccgtaattttcccgtttataaactcccggctattatgttaaaaaccaattgtttgtattttaatttttttaaaccccttttaaagatcccggttttggattaaaaaattaattgaaaccca

SEQ ID NO: 605996 - DNA, 512 bp, Homo sapiens
  misc_feature (4)..(4): n is a, c, g, or t
  misc_feature (18)..(18): n is a, c, g, or t
  misc_feature (26)..(26): n is a, c, g, or t
  misc_feature (71)..(71): n is a, c, g, or t
  misc_feature (212)..(212): n is a, c, g, or t
tccnttttaatggctggngtaatatnctttggtatggatatatccccaattggtttattcactcacctgtngatagccattggggtcgtttcccagttttggctattatgaataaagttgttatgaacatttacatgccagctttgtgaggacatgttaccatttcctaaaagtggaattgctgggtcatatggtaaatatacgtttacctncataagaaactgctaaactgtttccaaaatgactatgacattttgcatcctgtttggcaaagctgcaggatacaaggtcaacatataaaaatcaattctatttctatatgatagctatgaactgtctatttcagaaatagaatttttaaaagcaccatttatagaagcataaaaatatgcaatagggtgaaatttagcaaaatatgtgtatgctctgaacactgaaaacgacaaaatactactgagaaaaattttagaagacctaaataaatggagagaaatatactgtgctcacaaaaa

SEQ ID NO: 605997 - DNA, 141 bp, Homo sapiens
gccactgccgccgcctcgggagagaggaagcgggagaggagcccacgtcgcctgtcacctagatccacgccgcgccgccaggaagaaagatgttcgcctgcgccaagctcgcccgcacccccgctctgatcctagctggat

SEQ ID NO: 605998 - DNA, 674 bp, Homo sapiens
  misc_feature (334)..(334): n is a, c, g, or t
agctcgtgggcagggttggcgaactctgagctggggtgtgcttgtgagccagggatcactgggtgccggccacagtaggaagtgtccctgagtgacacagtaccgacagtctgatcccagaggagcgaaggaaggtggggccggggagaaggtctgcagtgcaggggagtggtccagggagtggaggactgagaagctagcgaaggatgtgctgcgatggtcgtgccagtaggactccttccatggcgcttgaagcttctactcgctttcacccgcactcctacgagggggcgatggcggaggccaggcgtctgctgagcttcttgtgctgtgngaacgtcgttcaatgcgcttatcactaccattctcttatagtatatcatagtgcgataatgagactacgaaatagattgtgagaactaggttcgtttttcgcgtctttgagcgtggatgtcccacgaggagaaagatggaagtaaagtgtcatttggacgtgaggggtggtattgtgatagtgtgtcatagaatttgagaatgtttgttggcttaacatacatatatcgattgcctaagtagaagtgtataaaaattgtgtgaaggtaagaggcccaggggagctagtgagcagcgagagggttcatgacgtttgtagaaattcctggttgtgatatagg

SEQ ID NO: 605999 - DNA, 261 bp, Homo sapiens
ttttttttttttggagacacagtctcactctgtcacacaggctggagtgcaggggtgcaaacacggctcactgcagtctctaccttctgggctcaagcgaccctctcacctcactctcccatgcagctgggactacaggcaaatgcaactactcaggaggctgaggcaggagaatcacttgaacccaggaggcagaggctgcagtaagccaagactgcgccactgcattccagcctggatgacacagcgagaccttgtctc

SEQ ID NO: 606000 - DNA, 100 bp, Homo sapiens
ttggaagccctccagcaagacaactagtgatgtcaataaagcatagtggcagtccattcacgtttaatctccaaaagattaatgtgaatatccacactgt

SEQ ID NO: 606001 - DNA, 563 bp, Homo sapiens
  misc_feature (356)..(356): n is a, c, g, or t
  misc_feature (396)..(397): n is a, c, g, or t
  misc_feature (408)..(408): n is a, c, g, or t
ctgaccaaccttccatgtatctccatcctcccctgctccagccagggaggactgagggagtgccccgagacccacgcacatgttggggcttctgggccaagagtactttttatataactaatttctaaatccaaaagctcaaggaatagacagtgttctgtgacatggattggtttgaaggagttacccaccatcccagcacgataatgtcatctcccaagttggatggcagcacgatctggccctagggagcttcctgttcccagaagtcattgtcctgggctatccagatgtccctagtaaatcttgcttccttctgcaatgttagtaatgccttaagctttttgggggggggngggaaaaaaacccccccggaaaaaggggttttttttgggnngccctttgaanttttttttttgttgcagaacagttttcctctttgcttagctagtaacttgcctctgagcctgggctgatctgagaaacaggtgtgacaagagcatgaaccagaggtgcacctggggcagttccctaataaaactggtttgtacagtcaaaaaaaa

SEQ ID NO: 606002 - DNA, 609 bp, Homo sapiens
acgcgatcacaggtgccgtcgtttacaccccggaaacctgttttgccccattaatacggattcccagggcggatggttataccacgaggaaaccagttatcccgtttatccgggttccctgggcggccgtatatccctgagaacacagtgagtagcgtgtataccggttgcctagggcgctcgttacatccgaaaaagcagtgcaaggactgacactccgatggccgaggggcagcgcgagtcccacaccagccacagttttagcaccgtgctgtcgtggtatagaattaccttgcaggtcatggaggctaaggtgatggtacacaaaaggcatcatacagcagccagatgttcatgagactaaatggaaaatatgactcaggtgatccacccgcctcggcctcccaaagtgttgggattacaggcgtgagccaacatgcccagctcaggagtagatatataaaatactcccctcttctatagtaacaaaattatttcaataattaagaaatacatcatacatgatgatgataatggccagaacataatttcagacagttaaccttttctatactgaatctgtgaatctgatgccgcactagaaagggg

SEQ ID NO: 606003 - DNA, 386 bp, Homo sapiens
ctcatattagccaggttagggggatgtttggtattttgtgtgttcagtgaccttgtttttttcctctgggcttagacacccgcctactcgtcttcccctcccgcaccccctctccaccctctacctcacccactctctccttctctctcccctctctctcatccctctcccccctcccctctcccttctctctcctccttctccccatctccacctcccctcccttcccctcctacgttcctcttctccttcccttccttccacacgacttccctctccctccacttcttccccttttctctctctccctctctctcttctacccctcctctctcctctctctctcaccctctcccgtcctctcctccccccctcctgtcactccc

SEQ ID NO: 606004 - DNA, 1290 bp, Homo sapiens
  misc_feature (373)..(373): n is a, c, g, or t
  misc_feature (415)..(415): n is a, c, g, or t
  misc_feature (577)..(577): n is a, c, g, or t
cgatctgctgctcgtctcaggctcgtatattctgccttcaagatgccggacaccaggcgaagtccgctcccgcgcccaaggaagggctcgaagaaagccggtgactaaggcgcattaagaaggaacgagcaagaatgctgcaacgcgcagacgaaaggaagagcctaactccgtgatacgtgtatcgcagggttgcttgttaatactaggtccacaccacagaaaacggctactctcctcgtaagggccaatggggaaactcaatgacacgtcgctttctgtcggaagcggacatcttcggtaaagcggcactccggtcggaggatgacggcgtttcctcggctcttgggtcggcaatatatctcaccgaaangcagctcgtatccatgtcatactcgcacgggtaggactccangaacagtgccgagtgtcgactcgtgtcgtagcctcgcctcagggggaagtttaggaccataaggcagaaagacacagtgatacccagagggtagacacctgatagtgtgcctctgtgctagacctcatgtgtatccattcccatgtacaggccttagagagntataaaacttatggaccctattaagggtagggcgtactacttttatcatttcatggggaaaacttttttcccttggaattttttggaacccaaaaagaaacacacgccttttacctattaatttccagaaaaacgcgaaaaggccacccaaaagtttttggagccccatattgccgaggctttaaacccccttccaagttttacgtttccttaaacctgtggccaaggaaaaagagaacggaacaaacgcaaccggggaaggaacaagttgggccaaaagaccaaattaagccccctatagaagttggggaacccttttgtttcctcaaaccaaaagggcctttataaaaggccttggaggcccactccctttggaaattccttccaatttttcaacggaaatttcccagaagagggagagaaaacttccaattttttaagccacaacaggttttaacacgttttttcctggattccttcccatatttgaggttccccaaaattcttcccgttttttcctcccgttcctatagaaattaaagttccacgttgttttaaccgtggggtttccccgttccaaacaaggaaacactttgtggtcccattaaccaagttttaaacgccgcaaattgcgttacccaatacctctttatgtgggcccatttccttggaacggcaacacacggaaaggttacattaacttaaaacagtgc

SEQ ID NO: 606005 - DNA, 284 bp, Homo sapiens
cccgactagcccgacagctgtcaccttcaccgttccagtttttaaatcctgagtcaagccaaaaaaaaaaaaacccaaaacaaaccaaaaaaccaattaaaggccatgcaattctcattgggtttcctggcccagttaaggttgggccaaaaaggggtgtaccgcacttaaattcatagtcggccaaaaagcttgggggggggccagatgagggggcgcgagcctcgtcatctctccgtgtgtgttggttcccacttttggtcggaggggggcgcaggcagatg

SEQ ID NO: 606006 - DNA, 468 bp, Homo sapiens
  misc_feature (34)..(34): n is a, c, g, or t
gagtgtctcaatgtttgaacactcttcacctatngtatgaccaaataaaggttatacaataggtgaagagtgtctcaatgtttgaacactaatgagataagcagttgacttactagattacaacttggcagttcaaagtcttgttgaagactttgaggaaaaagattggaaaaatgttgactttcggccgggcatgatggctcacgcctgtaatcccagcacttgggaggccgaggtggcggatcacctgaggtcaggagttcgagaccagcctggccaacatggtgaaatcccgtctctactaaaaatacaaaaattagccaggcgtggtggtgggcgcctgtaatcccagctatgcgagaggctgaggcaggagaatcagttgaacccgggaggcggggattgcagtgagccgagaccatgccattgcactccagcctgggcaacaggagcaaatctccgtctcaa

SEQ ID NO: 606007 - DNA, 615 bp, Homo sapiens
gggttttttccccctcgttttgccccctggtgtgggccccccgtcccgttaacctctccctctttttgtccccctcccgcgggtttccgtccccccgggggtgcccccccgttgttttatttgggacaccccccgcggcccccatgttattgctccgcccccggttttctttgccacctgtgtttcgggggtgtctctattgtttatcgccccctccgcgcacgcgtccctcctcggtggattttcacaggttctccccctctctcccacctcttttcgcggcggacctttggtcggggtgccacacacacgttctgttgtagcacccccgcggtgttccccgcggatcttcgccctccgctttttgggctcacccctgttcctccccactatgttcgttgtccatcctcccgcccccctctcatttgttcctcgctctcttgcagcctccccaccagcgcacgcactctctggtggtttggaaccccggccgccctgtaattgtgcgcgtttctgttggagaatggtggtttgtacatatattgtctgtaagagttctctctccactctctttgtgtgatgaggggcgtgttataacaaataacaaaacaacac

SEQ ID NO: 606008 - DNA, 131 bp, Homo sapiens
tgatgacagactgatgaaaatagagctgatcaccgttccagccccaacgtagcaaatcagcctcctagtcctggagggaaaagtgcatatgcctctggaccacagcgagataacatctgtctctactggaa

SEQ ID NO: 606009 - DNA, 201 bp, Homo sapiens
  misc_feature (12)..(12): n is a, c, g, or t
  misc_feature (154)..(154): n is a, c, g, or t
  misc_feature (172)..(172): n is a, c, g, or t
  misc_feature (193)..(193): n is a, c, g, or t
tccttaccatangtatgtactctaaactttgacatagatttaggttgttgtctattagagtcagataatcttaaattgcctaaataaagctctaagctatttcaaagcgccccctctatcagttaagagttgcaaatactctgactcatgaatnggggggcgagacacgagnacgaacttggaaaagactcgnttggagaa

SEQ ID NO: 606010 - DNA, 686 bp, Homo sapiens
  misc_feature (5)..(5): n is a, c, g, or t
  misc_feature (160)..(160): n is a, c, g, or t
  misc_feature (195)..(195): n is a, c, g, or t
  misc_feature (201)..(202): n is a, c, g, or t
  misc_feature (299)..(300): n is a, c, g, or t
  misc_feature (312)..(312): n is a, c, g, or t
  misc_feature (314)..(314): n is a, c, g, or t
  misc_feature (318)..(318): n is a, c, g, or t
  misc_feature (328)..(328): n is a, c, g, or t
  misc_feature (331)..(331): n is a, c, g, or t
  misc_feature (342)..(342): n is a, c, g, or t
  misc_feature (370)..(371): n is a, c, g, or t
  misc_feature (386)..(386): n is a, c, g, or t
  misc_feature (411)..(411): n is a, c, g, or t
  misc_feature (446)..(446): n is a, c, g, or t
  misc_feature (562)..(562): n is a, c, g, or t
  misc_feature (678)..(678): n is a, c, g, or t
ttgtncatattctataaagataatttattaaagagtcagagagaaagacagttctttacctctaggctattgataaaaccatctgggagtgggaacagcttcagggatgttacagggggattgggggggggcgagggagggtttgataaaatgggggaanatgttctactctcctttctttcctggggccttaanattaannatctgggattgaaaaatatactttcacacacatatctgtttcaatgggtgctgtctttctcaattttgggggggggtcgctggttggtggtcggggnngggggttgcgantnggtncccggttttngtntgggttgggtngctctggttattcatgggggcgtggtgnnctcggggctcgggcnggagctgctgctacttgtgcttaangctggggcgcgggcgcgatatcatttactgggganctgaagatgctgcgcaatgctaacagcccctctcagaagttctgtgtggctctgagtccttacagtgcagttgttgtgttagcccatcatccagtgagctggccagtagttcagcncctccacttgctgcagctgccgcgagacacattcaccaggcagttgcccaggcctctcacccatggggggaacacatctggccactttttttttctgtaaacctcaaatgaaacanaatctcac

SEQ ID NO: 606011 - DNA, 951 bp, Homo sapiens
cactacatgataccttcatcacatcggtcgaagacgagtcccgcgaactatcgcaaacacattggtggaccgaccttgcctgagtcgaagcactgaaggaatttagctggaggctctatcgtacatagtaatcagtaccctttatgtgaggttggcacaagggaagaatcttgtccatgatagctgaaatgtggatttgaacacgtatcgtcttgacaattagattgttgcactcttccagagagagtataagacttcgcttcctagatttgccttaggatgcgcttacatagattactcaggaatagcttggcgattgtattgcgtctgtgtaccagaataacttctcaagtctgacgatgggcatctagagagatatgaaacttctaggatgacatcaagagtaataaaagcgtcgaatttaacaaggtccaagaaggattccgtaaagaggggactcaagattcctcgtgactgaattagactcgggttgccatcaagtacatgcaagtagcgagaattgtgattgttgcctcatccgtacattggggcagatttctacatgaggcataatattgttgctcgatgtaacctatgtgcttagtagcaattttaccttcattgttgccaaaatctggtattagatgagggacgatgactagctgggcactagttgctcctgccaagattgacaggtgccggaaaattggtgctatttgttcctacatataatactttagatatcttaaaatcctaggtagtgccgtttgaagcccttttttttcactttgtgggtctgcaattacctacttctaatagcctttgcagctttgcttggttgcaccacaagtgtccacgtaacattgcagagggttattgcgtcctgtgcacagggtttctcgagcggctggctggacacctgggcctttgcctctctaatagagcagccac

SEQ ID NO: 606012 - DNA, 209 bp, Homo sapiens
aaccgatgcagacacggcaaagggaatgccatcggatgctggagacctgtgagcactacaggaggaaacgcgagcgtggtgagactgactccaggcacacaggcgaagggcaagagggttggacacagaagccacaaagctacttgggttcctccattcttctcgtttgcactttatctgcttcatgatgcatgatctccgagtccctc

SEQ ID NO: 606013 - DNA, 269 bp, Homo sapiens
actgcaacatctgcctcccgagttcaagggattctcctggctcagcctcccgggtagctgggattacaggcgtgcaccacaacgcctggctaatttttgtagttctagtagagatggggtttctccatgttgggcaaggctggtctcgaactcctgacctcaggtgatctgcccaccttgacctcccaaagtgctgggattacaggcgtgagccatcgtgcccagccagatctggtaactttagattccgagagtctccgtcgaactgg

SEQ ID NO: 606014 - DNA, 301 bp, Homo sapiens
cccctagagcgctggacactgaccatcgcagcacgaatgggcttgtagtaagtgctctctagcacttaggctgggctctgacactctctcgagaattcagacatcagagaagaagtccccttcagaggaccccagtcatcaccgtgatcccgtcctgactcccgtcctcaccgtgataccgtcatgactcccgtcctcaccgggatcctgtcctgactcccgttctcaccgcgatacagtgctcactcccatcctaagcgctatacagtcctcactctacgcctcaccgtaatcccatctt

SEQ ID NO: 606015 - DNA, 2076 bp, Homo sapiens
  misc_feature (1)..(1): n is a, c, g, or t
nagaggaccactcagggggggtagggcaggagcagcggggcggggtcagaagagggggtgcagcgcggaggtgaggtgaggcggacgacgaggcaggtaggaggcgcgagtgagagtggagggagcgagcagcaagggaggagaaggtaggggcacaggcggcagtgggcgagcggacggagaagagaggaacaggtgggggggagtcaggcgcggggggcggcgggaaggaggaggcttggcagggaggggcgcgcgggagagggcgcagccgcgaagcgggtgggggggcggacgcagcagaaggggggggtgtgctatgggtgttgtatcttcatgattgccgtcgagggagtgggtgtgcgctggtggtgctgtggtgaggttgggttgtgtggccccgtgtgcggtgggtgggggaggcgggggttggatgagagtaagtgatgggcggatggggggcgccaggccggtgttgatggggagtgggagggcagcgtcgcgttgatgagtggaggagaggaggtgttgggaaggggggagggacttgggtgtatgagtcgcgagctcgcagatgatgggtggtcgcggatgggtggctggcgctgtgagggaggaggagaggggggggtggggggacaggagaggggtgcggcgagaggacaacaacagtgagtgtggggagggcagcagagggagaggcacacagaagagggggggtgggggggcggaacgcgcagcagggagaggggtggaggggcgcgacggagcagagcgacagcagcggggggggtaggagggggagagatggaagaggggggggggtggggagacgccccgcgcactgggggggggagggagacacacagagaggggggggggcgacaggaggactcgtggggcgaggaagagagaggtgtgtcgtggggcagcgcgggggggggcgcaagatgagaggaggtgtgtaaaggagtggggtgggtgggtggggggggtggtgggggggggaggggagggggagggggggcgaaggacgagggggggggggcgcggcgcgggttgtggtggtgtgttgtatttgtggtttgatggtgggcaccgctggggagggggcgccactcgtgctgtgggtgagtgttgtggtgggggcggcgcctctggtggtgttgtgttgacacagcacaggatagacgccacgtcgtgggcgacgagcggctctgtgtgtgttggtctcgtccgcgcgcagagtaggggggacgtctggtgggtgggtggggaagacaacactcttttgagtgggcgcgtctacttctctgagcaacagtggtgttgtgtggtgttcgtcagcatctccgcctgcggggagagtagaaggagactactcttctcttcgtctcgcgcacaccacagcgctgctggtgtgggttggtggggggctctccgcaggggagggtgttggggtctcactgctgtggtggggagggagatagtgagcggctcatgtatgaggagatagtagtatataaacactactctctctctcacagcagttgtctctctagtgtgtggtgagacgcctcgcactcagcagcagatagtagtagagaagtgtgtgtgatgagaggtggttccttctcgcagcagggctgctgtatgagataggattgtctcataacagcgtgtagtgtagagactctctcacccccgccctggcgctctctcctcccactcctctgttctctcttgttgtgtgtctctctcggggggagaattcacagcgagagcacgccacgcgcgggtgttcgccctctgtctccccactcggagacacactggtggtgtgtgtggtgtggatgaggaaagcccccgcctgtggagattgttttgtggtggggcactctatatgtggggccatatgagagagggagaaatattatagaagagagagaggggagactgtgtgtgtctctctgtattgtgtgtatataaagagataaataataagttgtgtatgatgtagatgtgtataattgtacaccacgcaccacccccgaacaagatatataaatatataaa

SEQ ID NO: 606016 - DNA, 846 bp, Homo sapiens
tcgtccccaactcgcgcgtctgtccccaactcccgctctcggcgtgcgggcagtgtggcgctgagcgtccaggcgctccaagggggcgggcccgggtcggggcggggccggccgggcttccaggcctgggctctggccgcccgcgccaccgggccgctccggggacaggccggggcggggcgcggctggcaggaaacggggcggggacttgcggaggcgttggggacgagagagggcgcggccaactccaggggggacggcaggccgagagcgcggcgccctgggcctggcgcggagcctgagcccgccggactgggaggcggccccgccgctgggctcggccccgtgcccagccccgcacagacatggcctggccggacttgtacgggccggagaccctggagcctgggccaacgcatgacgatcaagcaacggtgatggcgaccgatcgcagaaggtccggagcatgggacgaagcgatggcgtgactgtgggcgcacacgttcccattcgatatctttcaagtgtggtgccacgtggtgggatccccaaggagcgaggcagcgaagggcggggcagagtgcgcggggaccagagaagaatcccgtgagccgaggagacgtacggcggccaggcggcgccagatccccagacgggggttgcgccctctcaatactggctggcatcttactgatgagacacagcaaccagaggtatccaattcgggaaggggttcactgcgacaaagggcaacaggagcccaggccatggggggcaacccaccgagcccaggccggccatggaggtcaccttgccggaacgccccaagacagggggttcccgtgg

SEQ ID NO: 606017 - DNA, 402 bp, Homo sapiens
  misc_feature (34)..(34): n is a, c, g, or t
  misc_feature (140)..(140): n is a, c, g, or t
  misc_feature (143)..(143): n is a, c, g, or t
caggttcactaccctccagagtcccagcaagggnatgtggggtggagagggcttgattttaggctacagatacgccaacaacgacaagctctccaagagggtgaagaaggtgtggaagccacagctgttcactcgggagnatncatagtgaaatcctggacaagaagttcaccgtgactgtgaccatgaggaccctggatctcatcgatgaggcctatggatttgacttctatattctcaagacccctaaggaggacctgggctccaagtttggcatggacctgaagcgagggatgctgcttgaggcttgctcgccaggacccccatctccaccctgaagaacccttggagccggagagcaagcccatctatgacaagtacaggagcttttgtcatcccccg

SEQ ID NO: 606018 - DNA, 314 bp, Homo sapiens
gttgacagagcgggagcatctccatcttgaacaaacaccaccattctaagttccccttgattaaaaaaccacctaaatccagccctaaaacatcagcctaatagctaatgtcagcataaccagaaacattccaaccctaagataaacccctatccaaccagaaacatgccaaccccgagacagcctaccctccaaccagagacattccaaccccgcaattaagtttccctcacatagaaacattctagacctacgataagaccctcattccaaagcccttaaatatccacagtatgaaagagagaaggctcctg

SEQ ID NO: 606019 - DNA, 340 bp, Homo sapiens
tctagagcatccccgcaagacgaccttgttgccattcctaactgcaaaagggattttataaccagaaccttcatttccttccatgggggactttcaaagagaagccatctgagtgtgcctgtaggtcacatgcctgcatccaaaaaaacatggagggtgggggcggtggctcacgcctataatcctaactctttgggggcccaaggtgaggggatcacttgagcttaggagttcaagattaccacggcccacatggcaaaactccatcactaccaaaaaaaaaacctcctccaaataaccaggatttggctggtcttggggcctaatccttgatttccca

SEQ ID NO: 606020 - DNA, 635 bp, Homo sapiens
agtgcgtcatataacaggtagctcacgcctataatcctggtactttgggaggccgagatgggtggatcacttgaggccaggagttacagaccagcctggtcaatatggcaaaactcccatctctactaaaaatacaaaaactagctgggctggtggtgtatgcctataatcccagttactcaggaggctgaggcagaggtcacagtgagctgagatcacaccactgcactccaggctggatgacagagtgagaccctgtctaacgtgacatcacatcacatcacatcacatcacatcgcatcgcatcgcatcgcatcgcatcgcatcgcatcgcatcgcattgcatcacatcacatcacaacataacataaattttcaaggcagaaatcttgtagtcagccttactgtttgttgacaaggacacggccctgagcacagaaatctcggcagttgataaagccaagaagaaggatactaacttaaagaaatttcagatttgcatctctggcattcagctaatagctctgagaggagatgcacttacagttgagaccggcagtatatattctgaaacattagtgaatgatgccccgagtgggagggtgatcgttagcccgtagtcatgcttggtccac

SEQ ID NO: 606021 - DNA, 183 bp, Homo sapiens
aatcaattatgcgaaagaatattataatatatgaaaagtagagcatgggaatcggctatcctagaaaagcaggtgacaggttaagagattcaatgattatctcatggctggtggtgtatatagaaacaaggctctgatcaaaaacacatcaaggatgaccgggcagctgagtggactgctcaa

SEQ ID NO: 606022 - DNA, 922 bp, Homo sapiens
gacacagtgagaaggcaccatctaccaagccagagagtgggtcctcagacagacactagaatctaccagtgccttgatcttggacttcctagacctccagaacctgtgagaagtaaagtttctgtttatggatgtcttgctctgtcacccaatgctggagtgcagtggtgcaatctctgctcactgcaacctctgcctcctgggttcaagtgattctcctgcctcagcctcccaagtggcagagactgcaggcatgcaccaccacaccctgactaatttttttgtatttttagtagagatggagtttcaccatgttggccaggctggtgttgaactcttgtgcctcaggtgatccaaccttcttggcctcccaaagtgctgggattacaggacgtagagcccaccgagcccgtgctagatctaacatggaaccgaacttcatgactactcgtcctatcatacacatgtgcaaccgaatttggactgcgcctagtgtggcaaccgtcaatcgccatcactacgactacatagtctcgctacaaactccacccacactcacgcagaacaggcatccttctggaccctatcaaactgcaaacccatactgttgtagatccaagtaatcccttgcttcaacgggacaagaaagctaccagaatatacgcaaatcggctggtcgacgaggaatattggtggaaaaacgagtaaatacgctaaaggccccggccacccacataaccccacaccgaaaccacacacaggccaaataaccccaccgacaaaggccaggggaacacaagctagcgaaaacacaagaacccacaaacaacagggctagaaaaactagagacagaacactcagaacgcactgcacgccaaccacgtagcacgcaagaccagccccacaaccacaacaaccact

SEQ ID NO: 606023 - DNA, 241 bp, Homo sapiens
gctgctcaagaggatcccctgccgagatgcatacagcacatgaaacatcgtatctatctgtaggctcgttgagtttctctgacatgctgtagtattaataattttcgatgatttgagaagccttcgcttcgaagcgactagtcctaatagtagaggaacgctccataaaactggagggattatatggatgccccccaccctaccacacatacgaggaacccgtatgcctcgtcgtgcaggg

SEQ ID NO: 606024 - DNA, 178 bp, Homo sapiens
  misc_feature (13)..(13): n is a, c, g, or t
  misc_feature (59)..(59): n is a, c, g, or t
tcggcaccgctcncgtgaactgattgggtctgatattaaagtgagagattaaacagaanatattcaacagaagcctcaccactgtcatcaatgttcatatcaaataatctgacactgtaaggagtttgaggaaattattgcactgtgtcaatggtgatgtgaaagtaatacaagttga

SEQ ID NO: 606025 - DNA, 933 bp, Homo sapiens
  misc_feature (933)..(933): n is a, c, g, or t
gtcgtaatgtctctttttaacactgaatatgttaggtggtttttcttgatggatttagggttaacctagttaataataaattgtttccaggtaattatcaagtttgtcattttataaatctgaagagttaatattgtcatcgatacaaataaagtgaaatctgactgaggctaaaatgtgtgatttttttcttaaaagactgactctatttagatctacttttttttttttttttttttttggaaaagagagtctcgctctggtcacccagggctgggagttgcagtgggcgccatctagggctcactggaaagctccgcctccggggtccatggccatgtcgccttcctctggcctcccagagtagctggggcaacgttattggtattcttagtaagaaaacggggttccaccgtgttgggccaggatgggtctcaatctctctgaccttgcccacctcagcctcccaaagtgcggggatacacgggcgtgagccacctcgcccagccaaaaatctacatcttcaaatgggattccaagaaaggttcaagtcctatatcggaggacctgaatttacccctcagctctctggttaaccccaggttcctgcaccaactcactctttaagaactgaccattttttctgtcgtattctcccatccacaattaatactaaatgtccacatttacacaaaacgaacacacgacgacaacaccagaagcaggggcgggccaaaaaaccccagggagacaaattacgcaccctctcggagaaggggcccaggaggggcaaaaccagcccggcggtaacaccccacggaaactcctgccggcgcccccgggggacacgacccacaaaacccgaaaaacagaggaccccgcgctccgcacccccactcgcaggccacgagaagcagcggcaccgacaccaan

SEQ ID NO: 606026 - DNA, 982 bp, Homo sapiens
gctcgcaattcggcggccccgctggttctgtctcttgcttctagcagtgtttggacggtaacagatccaggaggacttctcttccagccctccgatcgccctccagattgcctctccgattgcaaaacgctcctgggacccagtcttctcagtgcatcttcaccttgcgttcttgggaccgtgctcagccaccgctgtgtttgttggtatagctcccttcttgccgaacacaaccatcgagctcccagattcgtcggcaatgaataattccagctgacgtggagggcagacgtcgaacaggccctggtcccattcgtagccatggaggcctccatacaccataccgtcactcgtgggccttgtagtaggagcgcaatgatgtcggcgtctggacaggcgtgaggaccacttgcttccgcagaaactagggccgagggagaagcgcagagggctacgagcgtctcctgaagatgcacaaatccagggatggcaggcggggcttctcggtcctaggacggtcacagaatgcacgctgaggatgagtggggtagacagcccagacgccactgaataggctgcatgggcctggagaaaaagtggacaggcgctaggatctaaatgcctggggttctggcgaaaggagccccatctctgtgactccctgacaccgcagttcctagattaggaagtgagctatcagaacatggtaccactgaacaatcacagggtggtggcctgaggctggccgcggaatatctaacgaagggaatccaggccagcaaaaggttttgcgcaacgtatctaaagccctggagaaagggttccaacaccccagcaaagagagtaatacacaaagctgcaagaagaacttttcaagacagaaaaaaaacgcgcgccagtaaaacaggcccaagaagcagacagatacggtacaaagagaggcaacgccagacacacagatggatcagagagaagagcaagc

SEQ ID NO: 606027 - DNA, 372 bp, Homo sapiens
gcctgcacaaagcgatacccaatctagtggtttttagcatattcacaggctcgtgccatcatggcagataattttagatcatctttttcatcccataataaaactccatacccattagccgggtgtggtggtacctgcctgtaatctcggctactagggaggctaaggcaggagaattgcttgaacctgggaggcggaggttgcagtgagccaagaccacaccactgcactccagcctgggcaacgagagcaaaactccatctcaaaaaaaaaaagagagagagaatgaaggcctcttcccctactgaggttcttacagtcactgggacatgccagcccctctttggggtactacgcttgggcagggtaccg

SEQ ID NO: 606028 - DNA, 395 bp, Homo sapiens
gtgactatggtgttatgcagaggagctcagctgacgccctgtgaaacctcaggtctgaataagagttctctaggaacctggaatgagtacctgtctacctggagatgatggtctggggtgccaccctgttagaaacctacttacaccggtgaactccttaccctggggtaggtggttgagatgatcgaagttgaagctgggttgggtgagaagttgcctaactccctgcccgttcgtcctcctgcctgctggaaagagctaaagcagatgtcgagcaggggctggatggggtgtgctactcacattttgcaatctgatctttagagttccccgccttatgcgtacaggaggtctgatatcactcagctaatacgagtgtctctctctagtatagg

SEQ ID NO: 606029 - DNA, 225 bp, Homo sapiens
gcaccatagcatgagcccgtctcaggtccctacaactgtaggggcccaggtgacacgagaatgcacagagccctgtccggagggaagtgtgagatcagaccacaggcaggccctccagggtcgccactgcagcctgtgggctccagcaaactgagtctctcagcttctgaccctaccccagccctggcaatgctctcttcactcaggcgctacactgccttttta

SEQ ID NO: 606030 - DNA, 259 bp, Homo sapiens
gttacatcagctcgctaccgttaaggctgcagtgcacagaagctaatatttatgagatgtatgaaaacgcctggatattcaggcagaagtttgctgcagggtgtggggctctcatggagaacctctgctagggcagtgcagaaaagaaatgtggagttggagcccacacacagagtccctactggggcactgcctcatggacctgcgagaatagggccaccatccttcagaccccagaatggtagatctactgacagct

SEQ ID NO: 606031 - DNA, 179 bp, Homo sapiens
agcaaaagaaaacacagtgaagaggcgaatataccccaccttggaaatgctcaccaaaaagaaaagggaaaagtaattttctttagtgtcattttcaaaccacgattcagtttttaacaagatcgcatctacatcacacatagatgcaatcaaaagttttccagtgcatatgcaaacag

SEQ ID NO: 606032 - DNA, 804 bp, Homo sapiens
  misc_feature (195)..(195): n is a, c, g, or t
ggatcaaatccgaaccatcgaacggaatcaggaaatgcctcataaaggagcgtatgtgatctggtatggtcagatcctgaaggatgtgcgatacctgggactatcaggtccccgcagcgtagcaggtgtggtctatatcaggaagcaagatggtcacaggagtgatgtttgttgcactatcacaacagatcttanaaagctcatcgtgcagaggcaccatcagactagtgcacgaaggctataaaatttatgtttgatgagaagctggtgacaggtatggtctgctcctaattaccagcgtatcgttgtggaacatatggcttcgactcatggtcttgcaagagatgtacactacaagagaaccaaaaggttattcccgggcagctccagattcaagaacgtgttgattcctcccagaacgacgaacgccaataatttcctttgtgaggccttcgtccccatcctgctgacccatttttctgccctcttcttagcccaattttcttgttagttaccctctagaatataccttttggagttgaaggccactttagcatggtgaaatggcttgcctcattgccgtgatttgaaataagagttctacaattattcgtacattttattgtagggtagagcgcgtatagtagcacaagttgcctatcgaatttacccccccaattcgcatcacccacgtgttggtacttcatttgcgcagactagcggaagagagctaaaaatgaacacgtgctgagtagctctggacgataaacggacacgggaacaagagaggactcgtcagacaca

SEQ ID NO: 606033 - DNA, 902 bp, Homo sapiens
  misc_feature (892)..(892): n is a, c, g, or t
gcaatcaggcaggagaaagaaataaagggtattcaattaggaaaagaggaagtcaaatgtccctctttgcagatgacatgatgtatatctagaaaaccccattatctcagcccaaaatttccttaaactgataagcaacttcagcaaagtctcaggatacaaaatcaatgtgcaaaaatcacaagcattcttatacaccaataacagacagagagccaaatcatgagtgaactcccattcacaattgcttcaaagagaataaaatacctaggaatccaacttacaagggatgtgaaggacttcttcaaggagaactacaaaccactgctcaatgaaataaaacaggatacaaacaaatggaagaacattccatgctcatggataggaagaatcaatatcgtgaaaatggccataccgcccaaggtaatttatagattcaatgccatccccatcaagctaccaatgactttcttcacagaatggaaaaaactactttaaagttcatatggaaccaaaaaagagccacattgccaagtcagtcctaagccaaaagaacaaagtggaggcatcacgctacctgacttcaactatactaccaggatccagtaccaaacagcatggtaactggtacaaaacaggggttgaacaatggacagacagagactcagaaataaaccacatctacactatctgatttgcaccctggcaaatagatgggaagatcctattataatgggcggaaatggttccctttgaaggtgaggccctctaccttaattttcgagggcctttttcgtaccaactcgaacacgacacggagtgggggcttctacaagggcacagggttcgccgaacaggcgcacttcccaaaaacacagcgcggtgcgcgagnaccagcatcg

SEQ ID NO: 606034 - DNA, 1121 bp, Homo sapiens
gtataaagatagcactaagagtaagaagggccccatgagaaataccaacggttgagggcaaaatgacattctaggggtgcaatcagatgtggtatttagttgttaagtggaaccggggttccgtcacacatcctagtcccacgatagcacgagcacaccgcagacttagatggcctgcactgtacccctagaaggactgattgcatggaggtcagcacagtcccatgccgcatgtgccatcccaaggtactacgacttctcagctgcatattactaggatacctgcatagggctcacaagtttagcacgaggcctgccgagccatgcttagccgctcagcaacggactgggcttattatctctgtggccgacgggcccagtcatgatttagactaagagatagcacgtgagctacctgcactctcctccgaacgccaaagaatagtccagagccatagttgtggataaccaacgagatgaactggttacacaccacgggaccaactcctggggacccattcgcggccacagcggcggtacggactccatcggaatgcgcatcatggaccgtgaatctttggcgggaaacctgggccatacccgttgcctcagggggaaatgacctcacacaacatttgcccaccggactagtctagtaacataggctccaacattacccccccaggctagaaaaaacaccaaggccctgaacagccccaaagagggcggagcggaagaacacaagaacccaatagagcaccgcaaagacccgcacacggaggacaacaaggcaagctgtaaaagggccccgcgagcggcggcccttggccatagggggcatccccgacatggagaagttcaaaccttcgcaccccagaaacccaaacgcggggacccaacacgcatggcatccccacgctatcctaggacagagcgaaaccattctcggtggagagaggctattcaacagggggaaacataaggcgaaagtgcacgtggactaggcctttggacgtcctatccctgtgggcgtaccaaaaccacccccccaacagccatgttaaacccatatgtccttcaccagaccacacttccacgacattgttgaaattcgttcgcca

SEQ ID NO: 606035 - DNA, 178 bp, Homo sapiens
tacgcaggcagccaattcctataattagtagagacagggtaggcaggctgctgtaggactcctgacctcaggcgatccatctgtctcggacttccaaagtgctggaataacaggcgtgagccaccatgcccggcctctagaattttaattctatgaagaagacagattaggtgcctac

SEQ ID NO: 606036 - DNA, 767 bp, Homo sapiens
tcgcgctactgaccctgttgtgggcagtggtctccccccttggggcctcctttcgtcagtgccctagtctccatctcctcgtctaggtttctttagctccaggatcacctgtgtgtgtgtgacctccgctaggcgggctatcgggctcttgggagaccagccggcaggggcggacattccgtgcgtgcctgtgtccctgtgtgacgtgagagcgagagtcccttgcccctgctgtctgcccgagggctgccctggcgcctgtgtaaagggcaccctctgccctcgcgtaagcgaccaggtggagctcttgcgagacttgtgtgagctgcttggctcattttcagccatgagcagacggctgtggtccctgggactgaagcacggactcctagcaccagggtttggaggctgcgaccgaacccggagagcagcttcacactgttcgccagcagaagaggccccacgtgcactccctcggtctgcataccggcttgggtacacaggcccagaggactgggtgtgactcacggacctgtgctgtgatgttgagaagctgagaaataagctccataaggacctgagcacccatgcgcagccctgtcttggtcccaacaataccccagagctttggagtcttggggcccagacccagccctgtcttggtcctgaggctcagagcgtggaattgtgccctgtgaagactgcccgcggaaaaggaagtctgccctagcacatgaagacggcggggtcaaaaggtgaaatcctac

SEQ ID NO: 606037 - DNA, 359 bp, Homo sapiens
taggcggaccgtgatgtatccccaacacctccccaacacctgataaagatatcataaaacaagaaaactgtagactaatatccttcataaataagaacacaaaaatccttcacaaaatattagcaaatcaaattcagtactatagaaaaaggataatacagttaactcttgaatatgggtttgaactacatgagttcacttatatatgcacatttttttcaacaaatgtattggtgttgggcgataacatcactgatgttatcgcccaacacacacatggttgggaggccaggcaggaggatccctcgagcccgagtccagacccagacccagaccacctggcacgtccggtccggcca

SEQ ID NO: 606038 - DNA, 220 bp, Homo sapiens
ctctagaggatccatgggtgctcatcccccggcacctgcctctgcgagcagacccccccaccgagccagcatagcaggctggctcccatccatgctctgtccgaggccatggcagtgcgtgcagatgagggccgaatgcaggagacgtcacaacacagggatgttgctggaactctcaaagccaagctgcgcctctaggcccatgccagacagcacccat

SEQ ID NO: 606039 - DNA, 429 bp, Homo sapiens
tgatgttatcccccacactatgttgaataggagcggtgagagagggcatccctgtctcgtgccagttttcaaagggaatgcttccagttttgcccattcagtatgatattggctgtgtgttggggataacatcacaactgtagactaatatccttcataaataagaacacaaaaatccttcacaaaatattagcaaatcaaattcagtactatagaaaaaggataatacagttaactcttgaatatgggtttgaactacatgagttcacttatatatgcacatttttttcaacaaatgtattggtgttgggcgataacatcactgatgttatcgcccaacacacacatggttgggaggccaggcaggaggatccctcgagcccgagtccagacccagacccagaccacctggcacgtccggtccggcca

SEQ ID NO: 606040 - DNA, 164 bp, Homo sapiens
agagtagcaatgtctaaacaaaatactagcaaaccaagttcaacagctacattaaaattgtcatccaccataatcaagtggaatacatcccagtgatgcaggcaatgatttatttggaagtaaagacaatatatgatgatacacgcacatctaacatgacaaaa

SEQ ID NO: 606041 - DNA, 269 bp, Homo sapiens
atagaggatccctccggtgtctcatggattagcacccgtcaagaccatgacatctacttctaagaggcaacaactctacgtggcgtccgcggtgggtgtcacacatctgagcctgcaccggatgacaggcgtatggggctgcctgtgctgactgctgccttgccggggacccttactgtgcctgggcatggcaggccttgctcgcgttatacagaatcctccaagaggcggacctgcctggaagaacgtcgggcagggaaaaccccatc

SEQ ID NO: 606042 - DNA, 696 bp, Homo sapiens
cttcatcttgcccgttcagttgattgcagcctctagcgagcagctccgactctcgcgtatgtctttgcatcgaatatcgggatgcagaacagacctcgccgtaggaatcagcctcccattccgataagaatctaccttgccagcccgttagcgtatcagcaagtgcttatagagcgccctcggcttacttctcttcctgtctctgccttaatgagtatgtaacactattctcagccagagcctccctaggcgacccagactaatgtataccctagccaaccccttaaacacccctccccacatcaagcccgaatgatatttcctattcgcctacacaattctccgatgccgtccctaacataactaggaggcgtccttgccctattactatccatcctcatcctagcaataatccccatcctccatatatccggaacaacaaagcataatattgtcgcccacgtaagccaatcacgtttattgactcctagccgcagaccgtccgtcagttctaacctgaatcggaggacaaccagtaagctacccttttaccatcattggacaagtagcatccgtactatacttcacaacaatcctaatcctataccactaactccgttatgaacaaactggggtggggggggcgtggggggggggggggtggggggggggggaggggggggggggggtggggtg

SEQ ID NO: 606043 - DNA, 929 bp, Homo sapiens
ggcacccccgcccctagcgtgacatttatcctctagcgctcaggcccctgccgcatcgccgagatccagtgcccagagagaacagagaacccagcatggccccccttggagcccttggcttctgcatccgtgtggttgctgtggttgatagccccaagaaggccttgcacttgtgttccacccacacagagaatgtgctttctgcaaataccagacctcgtaacatcagggcccaagtacggtggggaccaccaagaagtcaatcagaacaaacttttatttaccaagcgtaagggagggtcacgattgacccaaatgatggtataaaagcgggcgttccaaacgccttaaggggggaattgccggcttgacacattcgggggtagcggtctaaccaacccactcctgccaatgggaagacagttggtctggcgcgatacacttttcgcaatcggggtttccccaacaaaccggcacggcgacagagcagttcccctcaatgtgcggggaaaacactttgcaggtgatgggacctctttggccacaatccacttaccgtggacagattgggaggcgctccccctttgagaatcgagctctttgaggcttaaagcattccagcacgcaggagggattttccacacagaggacctataacacttgtatgggactggccgacggactcgcacaggtgttaccccgtggtatatattcaatttccgcctgtgaaacgtgactacagtggccctcaattgtgcgtttggtagcacaggaccaaagttcctacaaaggtctctgaacaagggggcttccaggacccgggtcactttgcatgcactgacttcgggaacccagtggtttgcccgtggaaggtcctgcgggcacaaatatgctaatctggccggatgaactgtgaacctgcactgtga

SEQ ID NO: 606044 - DNA, 224 bp, Homo sapiens
gggacgagcggagctgcgagttccggcgggcgggggccgggaggggccgggggccgggggccgcgcccggaccgcatctccccccaggggggtcggggccgggggatccggtccgcatccacggcaacatcacggagtcatacccggcggtgccccccatcgggtcgggggagtctgatgaccctaagtggggggcggtctaagagagccgggcaagggtaccg

SEQ ID NO: 606045 - DNA, 218 bp, Homo sapiens
gagatctcatagaggatccccatcatggggtctgaatctgagcctgcagctcctggatttcctcttcgtggagtttcttcaacaaaggcaatctcttcttgcaaaatgattccatctttgcgttcaaggtcaatgacgtgccagagcacgcattgtctcacatcctagtctgaaatgattgcatgggtgttattcgtgcttccatctctctgatagca

SEQ ID NO: 606046 - DNA, 444 bp, Homo sapiens
caacaccattcctgtagcagcaacatttgttcacaaatctgactgcatcttgacattgtgtaccagtacattgcgttggcttgggtcacatgacagcgtcatgtcacttgtccgtagtactgtgttggtcatcagatgtttcgggcgattgtacataccaacatccactttaaaaaaaaacaccctggaacatgtatattaacaccactgctacagatattatagtaccgtttcataaacacacacagttggcagttgtatatttggactcagtttttgatagttgcatttttcttagatgcttcatctaaagacatggaaaaccttttagagcattaagtgtttttagtttgacatcctcgacattcatttgagttcatgttgtggtttggaaaaaatgtataagacgttctttgtttgaaaaatcaataaaaaatgtatgca

SEQ ID NO: 606047 - DNA, 452 bp, Homo sapiens
  misc_feature (2)..(2): n is a, c, g, or t
gngcgcactttatcgtgccccgcggatggtgtatcaatgtggatgtaatcgtagaatatataaataataataatataagaagaaatataaacaataaagagaaaacaaaatataaaacaaaagaataaataaacaataaacaaacaataaataataaaagaaaataaataacaaataaaaacaaaaataacaaaaacaaaaaacaaaaagaaataaaattattgggccaaataaagcaaaggaaccattataaaaaaaacctttctcccccgttcctccctattattatttcatttctcactgttttaccttgggggccgcatttgcctttaaccggcccttgccccccaacgtgccggctttttaatgcttatgtcccatctggcccttcctttttccccggttcctgcttattaataagggccccacccgatggggtttttcccaatttt

SEQ ID NO: 606048 - DNA, 231 bp, Homo sapiens
acgatctaacactgtcgtgacctctatacatgtaacactgcatctgtagtcaaatagatcacccagttattcctctcacatacgattcaccgcacaggggacaggttttttttcctcagaccagaaacatccaacgcgcacagctggtccagctgctgatactacaagtcttctgtggggtgaactgagcacacatcacataatggttgtgccctgtttaaacaaccacaa

SEQ ID NO: 606049 - DNA, 220 bp, Homo sapiens
accctgtgatcagaagaggcactccatctagtcttaactttgtctgttttatgcgatggtcctttactcagctagccagctctctcttccttcttattccatcgataaccttgatccaagaatggttcctttaccccccagtcaatacctgcctttcctccagtcatcccctcacatcagcaggaacccttcactttcttcttccattcctttcttcctc

SEQ ID NO: 606050 - DNA, 666 bp, Homo sapiens
tgatggcgcgatgtaacacgagaaagcacataccaaggccaccacacgagctcaccgtgtccaaaaaggccttcgatacgggataatcctatttattacctcagaagtttttttcttcgcaggattattctgagcctttgtaccactccagcctagcccctaccccccaattaggagggcgactggcccccaacaggtatcaccccgctaaatccccgtagaagtcccactcctaagcacatccgtattactcgcatcaggatgtatcaatcagcctgagtctcaccatagtctaatagaaagacaaccgaaacgcaagagtaattcaaggcggctgctgtattatcaattttactgggtctctatttgtaccctcgctacaaggcctcagagtacttcgagctctcccttcaccagttttccgagggccagtctacgagctcaacattttctcgtagccacaggcttccacggacttcacgtcattatggctcaactttcctcactatctgcttcatccgccaactaatatttcactttacatccaaacatcactttggcttcgaagccgcgcctgatactggcatttgtagaattgtggtccgaccttattttctggtattgtcttccattctaattggattcgaggggtcttacccaaacacc

SEQ ID NO: 606051 - DNA, 110 bp, Homo sapiens
agtccgtggccctgacggcaggatgcatggcaacaaatgtgccctgtgtgctgaaattttcaagcggcgtttttcagaggaaaacagtaaaacagatcaaaatttgggaa

SEQ ID NO: 606052 - DNA, 131 bp, Homo sapiens
gggagccaggtaaaggaacagggaaggtcttataaggcaaaactgtggagtcctagaggtgtgtgtgttaacggcaggtgtctgcagcagtggccagagggtcaggacacgctaggctgggctagtcgggg

SEQ ID NO: 606053 - DNA, 345 bp, Homo sapiens
tttaacggccggggtcccctgcccgtgcaaaggtagcataatcccttgttccttaaatagggccctgtatgaagggctccccgagggttcagttgttttttatttttaaccagtgaaattgccctgcccgtgaaaaggggggcataccccagcaagacgagaagcccctttgggggctttaattttttaatgcaaccggtccctaacaaacccccgggtcttaaactaccaaccctgcattaaaaatttgggttggggggccctgggggcagaaccccccctccgggcgggacatgttaagatttccccggtcaaagggaactattatattcatttgttccaata

SEQ ID NO: 606054 - DNA, 625 bp, Homo sapiens
cttcccttctcctggcctacactggccagaggaaccttagatcacagctcgatgcgcgcgctgggatgtgcactggaggatagtgaggggggcagttctgggatacgcacattagagctgcgcgcagccctggaggcctgtcgaaagcattattctaggcctgtgcagtgggactggattgccgtggcgtgtcggggcacagctgtgtcctgcagtcagaccataatccagggggctacccctggactctctgtggccagtggtcatcatcgcagtgggtgtctgtccgtcttccctggatggccttctcgtggcgctgctgcggggcctgcataggagtaactatcgtcttatgatcacgtttgccatctttctgtctcttatcatgttggtggaggtggccgcagtccatttgcgtggcctatgtgttcagacgataaggtgatgtcaggatgtttagatacatcataccttccggcagcagatggagaattacccgaaaaacaaccagatctgcttcgatcctggaccggatgcaggcggattttaagtgctgtggggctgctaactactcagatgggacgaacgatcccttccatgtcgaataaccgagtccccgactccg

SEQ ID NO: 606055 - DNA, 481 bp, Homo sapiens
gcttaaactgaagcaagttcggtggacgccggcgggccccttgatctaaagaaccgactcagggactgcggcgcttgcaccgtcaaccggcgagggtgtgagcccaacagacactgggacgtcggtcatcacgaatactgaagacagaaagcgagaagcaaggagaaacaacagggaaccaccggtagaacggtgtcctcttcgagacagtacttcaagcatacgtacgaacattacaaggcccgaactagacacgggaggacaggcaaatcaaggatcaggagtgtcaaagattcatgggacccagaagatcgtacagccctcgatacgcacaatttcctacactgaattaggaaagacggccaggccattcggcattcaaagcaccagaaagcgtccttccttaatgggcttcaagaaagggaaacacgaaaagttgcacggtcggttccaagggggtcggaggggaacatcgtataga

SEQ ID NO: 606056 - DNA, 768 bp, Homo sapiens
ttctttaaaaaggcgtcaatacttgagtgacttatgacttgggacctgtgatggcgcacttaacatttccggacagttaaatctgttgtacctggaacttattaattttggagagaacagccttgtaccatatgatctagaagtaatgctctctcacgtgctatttttttgggtgataatggatgacatacgggaggaataaactatcgtgggagctaggtccagggtggcatctatcatgaagactggtgcatgggtctatactggatagttctcaccaacatgtggtacattatattattgccacattgtagacatttttcattgactcctcaatgttaggtactcttatcatatgcctatttggttcgccttgccgaggcactctgatttaggaagcttatcatttacggtactctagctatttgggcatttgccgtaaatgagcctattacaattgattgccgacgtttaaacggctgaggtgggaaaaccttgcatttaccaacttgttgcttttaaacaattcccctttcccaagggggggttttgcggacatggccccaccgaacgcttttctcaaaaatgcttaacctgaatggggaatggaaaatcttggggcaatatttcctaaaaaacgggtaaaattttggctagccaggttatttttaaccaaagagccgggaatcgtagggccctctatatttaaaagatttacccgataagggttgggggtgtgccttttagaagggccatttagacgtggct

SEQ ID NO: 606057 - DNA, 117 bp, Homo sapiens
gagctcggtaccaaaatacccgattcatgagaggcactaatgataacctcctcgccattgctgccttcgtctccgcggcctcgttgtcccacggcccggccacgcgcgcaggtttgg

SEQ ID NO: 606058 - DNA, 102 bp, Homo sapiens
ttaccgaccgggcgtgacggactgtgacccgaccggtgggggacgacactaactgactggggaacgggactgtggtgtacgacgtgacggaacgactactga

SEQ ID NO: 606059 - DNA, 116 bp, Homo sapiens
catgatcttactgtagactcttgactcagatgttcactctgactggaagagtggagagtactggattgacccaacaaggctgcaactggatgccatcaaagtcttctgcaacatgg

SEQ ID NO: 606060 - DNA, 375 bp, Homo sapiens
  misc_feature (258)..(258): n is a, c, g, or t
cagcagcagcactagaagcagcagcagcgaggggtgcctcccggatctcatggccatatgggattacccaaggcagacccagaacgctgtcagttgttgaccattcctccaagctggtggtttaaccgcgagcgcacagcatctacctttctcagccagcatctctcttctctctaaagtttttacagatattggctgaggcacggtttcgtcatgcccacgacccacagcgcatatgctatatctcacagatatatngcgcggccctatttatctagagtgctttcgcactgcaaaggcacactcagcagcagtaaacagacaccccacagggtgaagtatttcttacatcattctatcgtcttcacaagaggt

SEQ ID NO: 606061 - DNA, 833 bp, Homo sapiens
gctttctgctgcgacgaacgacatcggacatagtgcgcgtgggcgatgtgcagcggggtggcggctatcgtgggcgccggcgaggaggcgcggtgcgccgggcgagctgcactgcatcctcatttcgaaccccaacgaggacgcctggaagggatcccgccttggagatagctcagcctgcttttgcgaggagagccgcagcgttaacgagctggtgtgcccagcactcaccctccccgagtgacagcccggcggggactttggtctgatcgacgtggtgacgccccggggcggcctatgagcgcggctggcgtctgtggaaggggccctccgatggtgtgcccgtagttgcggcgtggagactggcatggcggcggggttgcgcctgtgagagcgaggacggcgcggcctcccgaggaggggcccggtggtcggcgagggccatggctggtccgatctgaggactctgcaagatgtctggagacggcgtgttcagccctaggaaggcgcgtaggatagagacgtaggcctcagggccaggaaggacagactggccgggcgggcgtgactcagcagcctgagctcggcaggaaggagcgggccctggacttggtacagtttgcaggagcgtgaaggagttagccgagtgtgctgcttgttcaaaacggatccgggcaatgctccgtttgctagaggatgctgctgttgaatgcgtttgaattttacaataaacgtttagatgacaaataagaaccgaactgagactcaattgctagacagaaggaggggaagcgccacgggaaaccccagagagggcccaaaaaaaagtaccg

SEQ ID NO: 606062 - DNA, 732 bp, Homo sapiens
gtattagcttcatatcctgtacaagtaaagcttattagtctaatgttttgttcctttcccatcctacaccccgtacctcttcctgtataacgtctggttatctgcccttaatgtcacttacattcttattttctagctttaaagaacactgtcatgcggtagttgttgctgtataatttacagatcatatttattggactgagttttccgtagaataattattcaactatcgattgtatgtttgtatatcaaaagctgtcttcgattgtgtgtttccctgaaatattcatatagactgtcctaggaagtatgacttgtggcggacataaaaagtacgtttaataatccacaattattttggttaagaaggaagcattcagcattatatatattatgtgtatggaaaaccacttgaatgattttatcccttgtcgcatctggcgtagctacagagcctctcctcaaagatgctagaataatctatgaaatataatcacgaatttgggaatggctgattaaccatcgcatactagtgttgtgatgtgcatatacctagtgtctagactgtttgttttcacctataactcagtgtataccttttgtcaatgcaagacttgtatctttgcttcatctgcagtattttgcgagattttatccacagctgtcattttctaactgtcagaaatgataccgccttttgtcattgcacactattttttaaagtccagaaat

SEQ ID NO: 606063 - DNA, 227 bp, Homo sapiens
cgcggatgagctctgcgctcgacgagcacgggcattcgccgatggcaggcccatccgacgatatagtggtcagccttctatatgagcgctagccaaccagcagagacctaatacttgagcattatcgctattctaggttgacctaggagatacatgttgtcccccgcgattcatcatgacaacccatactccctaggactctacagactcagtcgtcagcgacagac

SEQ ID NO: 606064 - DNA, 634 bp, Homo sapiens
ggactcaagcgaagtagcaggttcgtgggttccgtgaatgtttcatgtgctgtttatttgccttcgtcatgctgcgacctgggccttttctgcttcttcgacgagcttccattgaccatatctgcagtgactattaacattctgtggcactttagcttgctcttttagcttcttctaacaacatctcagctctggcaatgtcagcagcagtatgctgaagcaataacctcgtacttgaggaaaggctttcaactcgtctcacgtatagtctctctgtcatgtcctgtatcctgctgtggggtgctaggcatctccattttcaatacttcattagcaactgcttcaatgctgtccgaatcagcactatcctgggtcaaaaagtttctgatttgcttgattagatttctcagctcctcattgctcttgtccattttttctttggtagcatttgtcttcaacagaatgtcttcagcactttgttttgcctcatctgccctcagttttgcttcagagaccatcttggagagctgttccacttcagccagggcactcaggacatcttggtccaagtccatggctttctgccaggggttgtgtgcaaaggtagccagaccacaaaggcaaccccccacat

SEQ ID NO: 606065 - DNA, 1013 bp, Homo sapiens
  misc_feature (1)..(1): n is a, c, g, or t
  misc_feature (20)..(20): n is a, c, g, or t
  misc_feature (28)..(28): n is a, c, g, or t
  misc_feature (42)..(42): n is a, c, g, or t
  misc_feature (59)..(59): n is a, c, g, or t
  misc_feature (65)..(65): n is a, c, g, or t
  misc_feature (71)..(71): n is a, c, g, or t
  misc_feature (195)..(195): n is a, c, g, or t
  misc_feature (229)..(229): n is a, c, g, or t
  misc_feature (248)..(248): n is a, c, g, or t
  misc_feature (326)..(327): n is a, c, g, or t
  misc_feature (392)..(392): n is a, c, g, or t
  misc_feature (397)..(397): n is a, c, g, or t
  misc_feature (456)..(457): n is a, c, g, or t
  misc_feature (464)..(465): n is a, c, g, or t
  misc_feature (496)..(497): n is a, c, g, or t
  misc_feature (511)..(512): n is a, c, g, or t
  misc_feature (519)..(520): n is a, c, g, or t
  misc_feature (608)..(608): n is a, c, g, or t
  misc_feature (697)..(697): n is a, c, g, or t
  misc_feature (702)..(702): n is a, c, g, or t
  misc_feature (718)..(718): n is a, c, g, or t
  misc_feature (780)..(780): n is a, c, g, or t
  misc_feature (894)..(894): n is a, c, g, or t
  misc_feature (900)..(900): n is a, c, g, or t
  misc_feature (936)..(936): n is a, c, g, or t
  misc_feature (1011)..(1011): n is a, c, g, or t
nttgtaacctttacaggaangcatgatnaaaaattgtaaaanatatcagtaagcatatnaaattncagcantcttttggacagtaattggtgttgcatgagggactaagcatctatgtagaacagacatgtcttggaatacacagtttacagattgaatcacaaagccatttcctaagtgattttcttcatatanagataaaaatatctttacatttaaaaagtatgcngtatagcacattttcagtnatgtacacagtttaaaagtaaaactatatccatgccagtgtctgttttaaatgcaaaaagtcaaagtaggtaacaggnnggtaattaaagtgtcaggcagactggaagaggcaaaaatcaagcagaggtccaataagtgtatgnaaaanaaatcgtaactgaaggtttaagaaaagtccccacacgcagaatcacaatatgccgccgnnggcatannaagcttttggatataccaggcagctttctgnnacgactcaggtttnncgggtgnnattcctcattttgagttcgagaagaattgtgaactttattccagcaaaaatacttcaattcttttttattaactgccctcctcccccnatctttcttttctggggcaaaggggattgcttgggattagggtccaaaagcttcctgggcagggggggagggggcccatgtggtcacangcatnaacaagacggtttgcnaagttcctttaactcgaggcaggggggtcagggttttgcaagcaaactcttgattagggctncacacaaatgggcctcccattttcacagccccctcccttgggagggccccactggatccagctgaaaatggggaacacaaatgttggagccaactaaaaccaccctgggtgatnggattnagtttgggattcagggaaagcgtgatttattcttgnaaaataaacgaagctgaaatagacatgctgatctcattcagttggatgagaggcagggaaagctggcttccaggnct

SEQ ID NO: 606066 - DNA, 400 bp, Homo sapiens
  misc_feature (23)..(23): n is a, c, g, or t
  misc_feature (327)..(327): n is a, c, g, or t
  misc_feature (368)..(368): n is a, c, g, or t
ggcacgagcttggctctgctctntcgtcgtgtcctccccactgacccccggctaccactggtcttttcactgtctccgtaagtttttcctttttcagaacgccatatagttggaatcataaagtatatatagccttttcacattggtttctttcactggataatatgcatttgtttcctctatgtcttttcacagtttgatagctcatttctttttagcatcgagtaatactccattgtctgggtgtacaacagtttatccattcacctgctgaaggacatcttggttgattgcttccaagttttgggcaattatgaataaaattgnctataggattatccatgtgtagggttttttgtgtccatttnaaggcttttcaactcctttggggtttaaataa

SEQ ID NO: 606067 - DNA, 894 bp, Homo sapiens
gggccagggcggtcgccgtcatggtgttgctctgtttcgggctgctagaagcagagtcctgctggtcagcgggagcagtgcacaaggccatcctgatatttgattgcacgttgcgtgacaagctgaggtgaggtccagatgaggatcgcccagtcatctggaattgtcggcggagcgcgtcccctgtgctccaggtcggacttagcatgcggggatctggtcaccggcaatgggataacgaggacacaagctgcgtgctcaaagaagagatcgataccagggagcagctcttggacattgacggagataccagtatcagacagcctggtaggccatggttctaagagtattgagttctaagcccagagtcgaaatgaacaggtgatggagggggctggcagtttgcggaagatgagtgtcctagaacataggattgcacgatggttgatcgttcattggaccagaggtcggagatggatgcgtggaggagacgacatcgcaggtcgctggagtaaccaagaggaagatcaaaatgaaggtccattgggcaggatggattcaccgtctagggaggatggaaagcgggctctattcattggacggaacgttgatgcgccaatcttctctgcgattgcaaaaattagaagcctggacaagacggggttcgccatccagaggccacctgttcctttgaggaagcatccacacgatgaagtgatcgcctgggcaatgaggcaacgggacccctgtgcacaggctggaggtcgccgatggaaagctctcgttcaacgttggtcctctgctgtgtgtggaactccacgggcggattgccctggggacttgtgtccccacagaagagttcgggtcactggcacgccccatgacggtgtcctg

SEQ ID NO: 606068 - DNA, 104 bp, Homo sapiens
  misc_feature (48)..(48): n is a, c, g, or t
  misc_feature (72)..(72): n is a, c, g, or t
  misc_feature (78)..(79): n is a, c, g, or t
  misc_feature (104)..(104): n is a, c, g, or t
gatctacctgcatataacagtctctaagtttttttttcaatcttgcantttgataattttgattttggccanattagnntaatttgggactatcctgaaacagn

SEQ ID NO: 606069 - DNA, 466 bp, Homo sapiens
  misc_feature (6)..(6): n is a, c, g, or t
  misc_feature (66)..(66): n is a, c, g, or t
  misc_feature (85)..(85): n is a, c, g, or t
  misc_feature (97)..(97): n is a, c, g, or t
  misc_feature (179)..(179): n is a, c, g, or t
  misc_feature (184)..(184): n is a, c, g, or t
  misc_feature (218)..(218): n is a, c, g, or t
  misc_feature (228)..(228): n is a, c, g, or t
  misc_feature (240)..(240): n is a, c, g, or t
  misc_feature (242)..(242): n is a, c, g, or t
  misc_feature (250)..(250): n is a, c, g, or t
  misc_feature (264)..(264): n is a, c, g, or t
  misc_feature (296)..(297): n is a, c, g, or t
  misc_feature (299)..(299): n is a, c, g, or t
  misc_feature (309)..(309): n is a, c, g, or t
  misc_feature (349)..(350): n is a, c, g, or t
  misc_feature (384)..(385): n is a, c, g, or t
  misc_feature (387)..(388): n is a, c, g, or t
  misc_feature (453)..(453): n is a, c, g, or t
gctagnagctggtgggcaaacactctgccctgctggagagctgccaggccatgcccgggcacaggntaatggggctcctggctcngtcctgctagcngtgcccgggaggcgtagaagatgcacacatgcggcacctgggcctgacgactcaccagcccacgtgggagcgtgtcctcccncaacnataagacacaataatccaacaagaacccaaccantgatccttcnccccaaatatancncaaaaaanagaggaaaaagaanaaaataataagatcataacaaaaaacacatannanaaaaaaagangaacaacaaaaataaaaaaaaaaaaaaaaaaaaaaaaaannaaaaaaatacgaccgcggcttgtgctgcgatatnnannaaaaataaataaaagaccccacagcaggatagacccaagaactagcaaataacaacacccaaatnccagcagaaccac

SEQ ID NO: 606070 - DNA, 134 bp, Homo sapiens
tccacggtctacggctccacggacaggcaatgacggacaaactccgtgcagtagcgaacgctacatgtgaagtccacaggactgcacctgcgggctactataatcagagctagcttcctcaaacacccgcggaa

SEQ ID NO: 606071 - DNA, 1344 bp, Homo sapiens
  misc_feature (104)..(104): n is a, c, g, or t
tggtcaccagaaaatattagtgactttaaccagggttttcaaaatctcggggcctttacctttaacagggtttcaacaacaagaatgtggcatctcaaataganggcaagaagtttagacattgtgttttaaaaattacacacatgtgcacacacacacacaaacatttttatagccattatattagcgtgtctcgtgaaatctccttctcaatataagaagaggagaaggccaccacacaatattaccaacacactctccacacacaaactctcaaacaacccatataaacacacacccttgcgtgtgttctatataacaaggggcgacgacaatttacaattttatactctactatttcaaaatctccgagtggaaaactctcgtgcgataaggggcccaggggacattattattataaatagatcacccattttatttcaaaagtgggtgaaatcattctgcgttgcaaccacatatatgtgcaaccgcgtggaggcgcggcttcaacttatcaacacaatgtgtgtgtgtgggcatcaccctattaaaaagacacacaacaagatgtggaacatctttctccacacacgaagtctatcaccttgtggtggggtctcctctccaaagagaaaatattattggtgtcttacaaatcatccaatagtggtggcgcgggagcacactcttacaaactaatacacctttcttcctggtggggtagtgagaaccccaaaagaacacatcatcaccacagaacaaaacaccacaccacacccagacaaaggactacaacactataacacaccacgacgacaacacataacgaaacagagcataataaacacgagagcagaaagcgaaaagacgaacacagacgaacaaaaaacagaaaagaaaacaagaccaacgaacagacgggggagtggcggagaggaacagcaacaagtgagaaacaaaaaaatcacaccagccgcggagctaggagagggagggagacaaacacaaaaaacaacaaaagaggagaaggctgaacactcaacaacgaggaacctaaagtagtacttcgagagaacacaggagaaacacagagtggggagcagcgccccccatactcaaatgaggagcgtagggagcagcagacacgaaagataacaaagcaagtagaccgcagccagcgaacgacggagacggcaggtgcagggagcgtcgtgtaggtgtagactacagaagaaaaaaacgaaggagaagaaaagaaagaaggacggcgcagccacacacgccgtatgagagataagacaagaagtgggagagctgaaataagcatatgaagagagaagacaa

SEQ ID NO: 606072 - DNA, 356 bp, Homo sapiens
tgttgtctgtggttctgcaattttccaaagttattcaaaagtatcaggcatgggcgatgtgaaagtgacctgacctctaagatgtgttccacttcttcctcgtgagattttgaactctgagacgtcatatccgtgaatgttgtgaatacccgtggtgtgaaacacaaattcagtgaaagcgatccctgcctcaagaaatgactcttccctatcagtgcttctatggtgtcattctcaaggtgtttcttcatgaggtgcacttccacagtgtttcttatgtgccaataccaccagtggcctctgcacaaagaaccccaccactgaataaaagcgcaatataaattgtgatgtgttaa

SEQ ID NO: 606073 - DNA, 186 bp, Homo sapiens
cgtgagacaaaagcagacccataatttggaatatatagtagaccttatacaggatgaaggaggagcatcccgtggcatgccaatgaatcttatctgatgggagacatgtacagatatagtgcatttatgtaactgaatgcaagatcaacaatactgatctagagtttaaaagtgcatgtacattag

SEQ ID NO: 606074 - DNA, 514 bp, Homo sapiens
  misc_feature (72)..(72): n is a, c, g, or t
tgatagggctatgtgtcgccaggctgctgagtgagtggtgtatctcggctcactgcgactctgctccctgancaagcgattctcctgctcagcctcccgagtagctgggactgcgggtgcctgcaccacacctggctagtttttgtattttagtggagacggggttcactatgttggtggggctggtcttgaactcctgaccttaggtgatccacccagcttggcctcccaaagtgctgggattacaccatgcccgacctgcaagaccagataaatatttggcctgctccctgcaaggagggcctaaacacacaccaaggagcaagtgacacacagatacaagcttgggtcagagttcattctgctgggacccacagtgatatccaatgtgcactgccagtggtgtggtgcctgaacggggctgctcagtgcctctccttcctgcctgtattctgagcctggccccagcctgacagacaattctccaagccaaccagcattcttccagtagagt

SEQ ID NO: 606075 - DNA, 907 bp, Homo sapiens
ggaccttttcgcaaaccgttactggaaaccttaagtaagccagtggctaacacagaaaagccggttgcccacctgcattaatggaatctggcataaaggaaaagaaaaaggtacaaaagagagcacggaaagaaaggcaacgaaaaacagggaacaaacgaagaaagaacaacagaaaagagacggagaaacaacaaaggaaaaacagaaaaagaaaaaacaaagaaaaaagagaaacacaaagagaaaaaggagcaaagaagagcgaaaagaaaggggaaagagaagaggacaaacagagccgagaaggaaaaaacagagacaaagaaaaaaaggaagaacaaagaagcaagaaaaaaaaaagaacaggaaaggaagaaaaaaaaagagaacagaaaaaacaaaaaagagcaaaaaaaaagaaaaaaaaagaaaaaacaaaagaaagacgaaacaaaagaaagaagcgaagagaaaaagaaaaaaagaaaagaaaagaaagaaaacagagaagaacggaagaagaaaaggaaagaaggcaccaagacgaggaagggacgaagagggacggaaaaggagaaaaacgagaagacacacaagacaacaagaaaagaggaaggaaggacgaagaagacaagggagagacgagaaagagaaacgagagagagaaacgcagaagaaaagaaaggaacagagaaaggaagagagaaaagcaagagagaaggcaaagaggaagaaagcaaagagcaagaaggccaggaagaagcaaagaaaacgaaagaaaggaaaagaagaagaagaaaaagaaagaggaaaaaggagcgggaaagaagaagaggaaaagaggggaagaagagagggggagaaagagagaaagaagaagggagagaaaagagggagaaaaaga

SEQ ID NO: 606076 - DNA, 112 bp, Homo sapiens
tgacaggcggtatctaaccgactgaactacgtccagctttcttaccctcaccggcaggacgtcggttacgttcctgcacgcgtgcgacacttctacgaaacgccgctgaatc

SEQ ID NO: 606077 - DNA, 959 bp, Homo sapiens
gtataagcaaatcatcctgtcgagtgtaaccagtgtccacgtacttgaagcttctgggatcacgaaaagtctattgaaattggatgcccattcataactgggttggggcacatctagacatcatactgtgaaaagacgacgatctacacaatctacgcttgcttgctgattacactggacctggggtcgtctgctcttctccccttaccctcccgcctcccaccctcgcgtgcatagaacaagcgccatctagcctggggggcttgtgtagagtacatgtgagggttgcgcggtctgcatggcgggtgggacttagcgtgctagggttgtgtgggggctgtatcagtctggcatactcgctggtatactcttacttcttaaaggttgactgcccctttctcctaaccatcattcttggtcctccagcgctccttcgcaagttccccgtccctgtgtctctgaggtcttgatagtgtgtgaactctccctccatctctcctctcgggccgtagttgggcgggagcgcgggtatgcgcaattcttcaccggattgttcctcccactgatgctttcgggctcggccccacgctgtgatcccttggggcgttgaatctcccctaagcgctcgctctcgtgcggatatcgcctggttttggcttcccggggctattagacacggagaaactatggcacatagacacacttaccggtgtcttaatggaccaagaaaagccaatcagggtaacaggttgggaaaaggagccttcttgaacgctccccattgtaaaaggttgtggggaaacccatatgtcacttcaggttctcccaccagggcttggggacacctgaattaatttggggtccctacaggccctagagcaacgctcatgcttgtcaatcagagtggaatgcatttgagttttaaaggtcaagggctgtagaaaagggggggaagagtg

SEQ ID NO: 606078 - DNA, 186 bp, Homo sapiens
gaccccagaggccactagcctcatcatctgcctttcatagatcggaactcgtcagtggggctggccataggcaggtctcctcttactggggaggttgaggtgggaggatcccttgaggccaggagttagaggctgcagtgtgttatgattgcgcctgtgaatggccactgcaccacagcctgggcg

SEQ ID NO: 606079 - DNA, 200 bp, Homo sapiens
caaaaaaaaaaaccaaataaaaaaacttataatcaaattaacttacatccggtagcagttacttggtatagggtataaggaaatcaagggaggatggagagtatgcaggaggatgcgtgtaggttatatgcaaataaatggccatttaatataaggggatctggagcatcctcgggaatatgaaggggtagggggcaggg

SEQ ID NO: 606080 - DNA, 152 bp, Homo sapiens
  misc_feature (116)..(116): n is a, c, g, or t
  misc_feature (118)..(118): n is a, c, g, or t
  misc_feature (132)..(132): n is a, c, g, or t
gagctccacgctgatctgaagatacaggagagggacgctgcctaagaaactaacttgacggttggacgaagatggggaaaggacgagactcatacgcaacctcaatgtcatgcttntnggggtacacgatancgcttacccaaagagatagg

SEQ ID NO: 606081 - DNA, 598 bp, Homo sapiens
  misc_feature (19)..(19): n is a, c, g, or t
  misc_feature (80)..(80): n is a, c, g, or t
  misc_feature (111)..(112): n is a, c, g, or t
  misc_feature (115)..(115): n is a, c, g, or t
  misc_feature (120)..(120): n is a, c, g, or t
  misc_feature (135)..(135): n is a, c, g, or t
  misc_feature (155)..(156): n is a, c, g, or t
  misc_feature (201)..(201): n is a, c, g, or t
  misc_feature (247)..(247): n is a, c, g, or t
  misc_feature (252)..(253): n is a, c, g, or t
  misc_feature (304)..(304): n is a, c, g, or t
  misc_feature (306)..(306): n is a, c, g, or t
  misc_feature (369)..(369): n is a, c, g, or t
  misc_feature (411)..(411): n is a, c, g, or t
  misc_feature (573)..(573): n is a, c, g, or t
gccaggaggagggggcagncccaggtaggccaaggggaggcccaggcaggaagaggtaagccaaggcaagcagacccacnaagggtccctgaaggccagcccttgagaagnngtntaagncaaagggtgagtgcncagaccaaagcctaacccanngaggcagggttgagacccggttgggggcacttgaagcctaagggntggcatcactgggggccaccccgaaccactgccggaacaccaagcntatcnnccggttagactccaacagcccctagaaacaggcatggaggtggtcaatctncncctccaggtggtccagacaggagtagaactgagatccagcatggagtaagatggcagcgtatnctcaagccctttgaacatgcagcagtctctgcctagaaagtnctgggtcctcccaactcccttcccttcatctcctcctggaagagtcccacacatccatcaagtctcagtatggatgtcaccaccgggagcccacccaatgccccagactggatcaggcctcaatacagagccccaagccctcctcagacctccacgaccttntctccaagattaactgcagtgctta

SEQ ID NO: 606082 - DNA, 126 bp, Homo sapiens
cgcatagagtaccggttgcggcgcgagcgcaacaacatcgcggtgcgcaagagccgtgacaatggtccaagcagctgcaacgtgagagacgcagcagataggtgctggcagctgaccacgtgacaa

SEQ ID NO: 606083 - DNA, 284 bp, Homo sapiens
catgtgtcagtattttccggttgatagttccctcaacgaccgttgctctgcagcaatcagtgtaaatgcgcttcgagcaatgttgcatgatgatgcatatagaatagtggctttggtagcacagaggatgccccaagaaactcatggcgttgaaaccacacagtactcattactgtaattaattagctgtagcattctctgtctcctctctctcctcctttgaccttctcctcgaccagccatcatgacatttaccatgaatttacttcctctcaagagtttgg

SEQ ID NO: 606084 - DNA, 216 bp, Homo sapiens
ccgaaatatggtagtgccacattagagtgttctcattgaaatacttgcagcttatattcatccaaaagaaaggtactcttgatagggtgatcaaaggggtacttggacctatgagtgtctagaagctcgaggcgcctgtctcagcattcatccagtgaccatccattcgaggagcaaggagatagacgactatttgtcatcctctcttccggctct

SEQ ID NO: 606085 - DNA, 540 bp, Homo sapiens
  misc_feature (57)..(57): n is a, c, g, or t
  misc_feature (65)..(65): n is a, c, g, or t
  misc_feature (142)..(142): n is a, c, g, or t
  misc_feature (153)..(153): n is a, c, g, or t
  misc_feature (218)..(218): n is a, c, g, or t
  misc_feature (236)..(237): n is a, c, g, or t
  misc_feature (256)..(256): n is a, c, g, or t
  misc_feature (380)..(380): n is a, c, g, or t
aaaggctccttaaggcctaagtaactgaagctgtggaatgtttgctgtcccctgaangctgagtntaaagaaaaagactgggaagacttatgtacctggccaagcccccagcatcgcagaactcacattcaaaaccctgtcnagtaatgctcnagcctgctggagcggagaaaacccagaagccaaaagtgctatttgacagagtggcttgtcaaggngaagtagttcgaaaaacnntaaagctgaaaaaggcctnttaaggatcaaagtggattcggcggtacaagaacttcttcagctgaaggcacagtacaagtcgctgacaggaatcgagtataagcctgtgtctgctactggggcagaagacaaagataaaaagnagaaagaaaaagaaaataaatctgaaaagcagaacaagcctcagaaacaaaatgatggccaagggaaagactcttccaaaagccaaggcagtggcctgtcatcaggtggagcaggagaagggcaggggcctaagaaacagaccagattgggtcttgaagc

SEQ ID NO: 606086 - DNA, 684 bp, Homo sapiens
  misc_feature (401)..(401): n is a, c, g, or t
agtccttcaatcatgcatcaggctctcaggctgtcacatgtcaatcatgcctagtgtgagcatcgcatagtatgaaggtatactcgcttgtggctcacccgcatagatgcacataaagttcagtgcccgtactaatctctctagcggatctggagtgcactatagcactgccatcaggaaagaccatgttcatgtcttcatagaatttcaccctcacttaagtgtccgccagtggtagtgcattccggcctttgcagcatggacagctaccgtatcaatgagcatgtggatgcttggatgacagctcgcttactcagatacgcagatcattagaatgttagtctcaagctgttcgtgatggaaggactcccaggtaggacaggtttcataaaaaattgtgntacttcaagagtgaggcgtggtgcggtgtctcatgcctggaatcgcagctcttccaaaggattaggtgggcagatgtctaggtcgaaatagtcaggccagcatggccaacatggtgaaggcatgtatctgcaaaaaatagacagtaatagtctaagtgtgaaggtgcaggcctatagtccgagcggtaaggcaggctgaggcaacagcatggcttgaaccgggaaaccataggttgcagtgagccgagactgcaaagtgtacgccagcctgggtgtcgcaaca

SEQ ID NO: 606087 - DNA, 325 bp, Homo sapiens
aggcctccaaccctgcttgcaggggcaagcttgccaaacaaggtgtaccttcccggtaggcacccagccaggcgtggggaggggtcccctttttaggtggaacgcctaaaaatggagcctcccaaaggggtggtggtccgcttcccccacggggcctgatttaagcctgaaaaggacccaaaacccttttcctttccttcccaggccctttgggttttgattttttttttttttaaaaacaaacaaacaaactggtggagattatgggtgaaccccccaaaagggggttttttgccttcaaaaaaaagtccccccgggaggggga

SEQ ID NO: 606088 - DNA, 220 bp, Homo sapiens
ctgtgtggtgtatgaggagaaggcatgcaagtatccctgagagggtgcttgagcgacatgtagatgaggagcttttaactcctaaggttaatgggcctcatattgatgtggagtagccacatgcaagggttcatagagtggagtcatccattcaggaagagtcttccaaagagggaagaaagcacactatgaacccttgcatgtggctacaccacacaat

SEQ ID NO: 606089 - DNA, 133 bp, Homo sapiens
cgaggatctccatcacccctaaatttattatgctgttgaatatgatactttggaggagagagtgtgctcagaacttagacgggattgggtaggccaatgtatgctaggtgtacaatatattttatgaatttat

SEQ ID NO: 606090 - DNA, 157 bp, Homo sapiens
tccctacctcacgaccaacgttgacccgtgacgggtaactactgactgtggttgactgtatatatgggctgttactgtcagttcagtgttttaatctgcacgcaggcttatgcggaggagaatgttttcatgttcacttatactaacattagtcctt

SEQ ID NO: 606091 - DNA, 365 bp, Homo sapiens
ccagtgagggctcccaggtcaaggcgcaggcagggtcccgtgctcccctggggtgccccacccctcacaccgtgtggtaccccgcaggcacggcgcggctgcccgaagcctcccagagcacgctggtgctgaagcaggcggtacgcaagccgctggaagccgtgcttcggtatcttggtgagcagccaggcgtgctggggggctccactacattgctgcaggcagcttctcacccaagctcgtgcactggtgtcccagccttctctagctgggagctcctggacacgccccagggcctggaactgtcatgttgcggttctctgcaccgtgccaggctcaggcagaaccactgggacccaggctgc

SEQ ID NO: 606092 - DNA, 253 bp, Homo sapiens
  misc_feature (113)..(113): n is a, c, g, or t
cccacaaagaacgtggggtccaggttctttttgccccttcccagcacatgcagaatgactccagtggttccattgtcccctcctgccctgggtacctgcttgcctttttcagntgccccccctcccctggggtggcccactcacccccagtggaagggcccgggatttgcacttcctcccctttcacctacctgtacccctaacctggccttagactgagctttatttaaaaataaaatcgtggtggtggtca

SEQ ID NO: 606093 - DNA, 364 bp, Homo sapiens
gacggatcccggagttccctttgtcggtcttagctatgaagctatggttttaacatcgtaaggcaaagaatctggctttcaattagcaacaaatagaatggtgctgtaaatgtagcagcattaaaaaatagagtaccgtatttctgtaacacttactctctagtaaggacttagggataacgataataactaaagggctaataagcaagagcacatcaattcagaacttggatgatagcacatcaggcaacatggggcaaatgcaaaagcctccataaaagaaaagggctaggcactatcaatttagcaaagggagatactcaaagaccgatcatatggaaaagtttatagacaaagggaaaca

SEQ ID NO: 606094 - DNA, 313 bp, Homo sapiens
  misc_feature (46)..(46): n is a, c, g, or t
  misc_feature (52)..(52): n is a, c, g, or t
  misc_feature (93)..(93): n is a, c, g, or t
  misc_feature (249)..(249): n is a, c, g, or t
tggctaaacagtacatcactgcactgaacatcatccactacatgcncgacangtacagctacgaagcctctctgatggcgctgcacgaccgtnacgttatccgcaccatggcgtgtggtatcgctggtctgtccgttgctgctgactccctgtctgcaatcaaatatgcgaaagttaaaccgattcgtgacgaagacggtctggctatcgacttcgaaatcgaaggcgaatacccgcagtttggtacantgatccgcgtgtagatgacctggctgttgacctggtagacgtttatgaggaaattcagaaactg

SEQ ID NO: 606095 - DNA, 295 bp, Homo sapiens
ccccaaaagaggggggggggggggggggggggggttttttttaccaccgctttttttttttccccccctttttggggggggccccccccccctttttttttccccctttaaaaacccggggggggccccccccccccctttttttttttggcgggggggggggggatttttttttcccggggaccctttttcccctttggcccttttttggggccccttaaaacaattttttttcaaaaaagggggggggggggggcggggttttcccgggttttttttcccccccgggccccga

SEQ ID NO: 606096 - DNA, 103 bp, Homo sapiens
tcagctcggcccttctttgccggcgcattttagtattttggacatactggtgagtcacgcccatggccaggttgcggtcgcagcggtaggtgtcgaagccctc

SEQ ID NO: 606097 - DNA, 137 bp, Homo sapiens
cccgactagcccgacaggtccgctagcccgacagcccgactcccgactagcccgacaggctgccttctgggtgatgagaatgttctggaatcagatgggatggctgtcgggcgtcggggctgtcgggctagtcgggg

SEQ ID NO: 606098 - DNA, 301 bp, Homo sapiens
tgcgtgcagatgaggagagggaaggaggatgaggtggtgtagacagcggagtcagcaggacttggtcttgtccagtgggtgagtgagagaggtggcccaatgctttccagtgctgagcatacgagagaccacaggcaattgaagccttgtggcagtggtgggtgcccatgcatgcacctgccttcttgtttcatgtggctccatacctcacaccaatggtgccccatcagccatgaacttggacacacttgccatgagaactccagtgggtcatcttggtctggctcattgcctacctcct

SEQ ID NO: 606099 - DNA, 344 bp, Homo sapiens
gccaattccgtcttgcgaggtctttacagtatcggcaacacagttaccacttcttctcttagttgatctaccttgccaatacacatgaagttcctttataccctgatcggagttagaccggaagtattgttcgttctaagcttagcattttaattcatttggaatatcacatgtaaacgtggatctcatctttatcacagtgacatctagctagtctctccatcagcagatattaatatctctttctttccattggcttattaatgccagataaactttctacttggcaccacactatattcaggaaggttgtttcatagcatgtttttagtattaggatagcg

SEQ ID NO: 606100 - DNA, 263 bp, Homo sapiens
cacgagggagacaccaatccccaaaccatgaaaagattacttaatattgtttctgagacatgacgattactgacagacaatcagattagtttcaaatgggacaggcttgctagctggttcaaccttactgagcaatggccataccggacttcatggctcatattatatttgcaagagactgaaggaattccacatcaaatgacattaaaaaccatctatgactcaacatcaaagaatattccaacacctaaggatgttgagcc

SEQ ID NO: 606101 - DNA, 395 bp, Homo sapiens
tgaggccagcgcacgcggtggcgcagccagatggctgacagcagcaagacgatggtggggttcagatacaggatcgcgcgctccaggctggcgctgatgtgcttcaagcccatgaagtccagcgtgctggccaggtagtagcccgaaaaaccaagcccgacaatctgccagcgctgtgtacggctcagcagggcggcttcgcccagcgcctctcgatgctggcgcccagcccaccaggccatcgccaggaacatcgggaaggccatcaccatgcgcatgccaaccacggcaaacgggtcggctcccaggcggtacatcagcttggccacgatggccttgccggaaaacgccacagccccggccacagcgaacaacagaccgtggtaacgctgctt

SEQ ID NO: 606102 - DNA, 264 bp, Homo sapiens
  misc_feature (222)..(222): n is a, c, g, or t
  misc_feature (249)..(249): n is a, c, g, or t
gaattcggcacgaggtccatcagacgagctgtacctgcccccccatgcggaagatagacggcctgctgaatgagcacaagaagaaagttctgaagcggctgtcgctaagccagccctgcaggtgcctgggggtcttgacagagggtttcttggggccaagggtccacatgtggaggacatttacgtttcgcccccttttgcgcgcggttaacccttggaagnaaacctccttcttggctcagattgganacagttttaggccag

SEQ ID NO: 606103 - DNA, 1650 bp, Homo sapiens
cggccgcgcgacattttttttgtaagaatctttaaattgcacaaaggtaacctaaatattcttacaaacaaaacggaaacaaggagttgcccatgcagaacaggtatcataacaagataaagtaaaaggaatttaacatttactaaactagcatctttggtacttagaagtgttgcccaagaactgagtgaaacactgacaaaacagataaaaacaaaggaaaagcagtatttcaataaatatgatgccaaataatgtaactgtacttacccagtatcccacaatgaataaaacctgccactccatggtgcaatgtaacctgtataagtcaaatagatgacactaaggaacacagcacctgcagctagtgatacacccaaaaagaaaagggtctggaactcttgttttgttaatcggtctctcagatactgcaagaaagcataagcttgcagcaatgcaaagacacctgcagctgccatgtgttcacttgttctgattggctggaatcccacaaaaggtatctgcattgataatattaaacccacaatgtagaaagtgctatatgctatgtagactcttttgctgtatctctgcatcagtaacaacacaaatacatgcagtggaataagattgatgataaatacataaccaccccaagcagagaccatatagaaataggataagcagcagcacattgtccaaaaaactgacccagtttttacagattttacccataaatagtatgtgaactgaagtgcaaaaatagcaatgccttcattatcaaaggatccagctactgaccgagatatgtagcctggtacatagcaataaaacaagcagctaaaagtcctgctccttggttccaaagttctcttgtaagcaggaaagtagatatagatgtaaggccgctaaaagttggtgcaaggaacacacatacgtctcttatgtgaccagttatgtccaatgtatttaaaatccaatgaataaggccagcggttatcatcaaccctgggtaaacagtaccacctactattcttcctagtggataccatgctctttcatcaaaccaatttaaaaattcatagaacccatgagatgcaagatgatgtgttgatctatagttaaaccacgggtcgaactcgtggatgatgctttcgaagcggatgacggcgaagaggcgcgagctgaagccggcaagccaggccaggaagaggatggtgaaggagagaagcgactgccacccagccggctgcgacagccccccggacagccccgccggggccggcttcggcggcgccgcgccgcccgccgccttgtgcgcgcactgggccccgggcccgtggtggccgtgccggctgtttcccagggccatgaggccactccacggggacgagttgagggacgacttgtgcttgctctccggggccgagggctccgccatgttgtgccccggcggcgggtctagctctcctcctccgccgccgccgcctggtgcgaggggtgctgggcggggacccggaggaggaggaggaggaggaagaaaaaggaggagggaagagctctgcgcgctcccgccctcagcgccgcgaggccggcggactgggggtggaggaagcggcggcggggagtctccgcctcagcagcggccgc

SEQ ID NO: 606104 - DNA, 491 bp, Homo sapiens
cggccgcgcgacattttttttgtaagaatctttaaattgcacaaaggtaacctaaatattcttacaaacaaaacggaaacaaggagttgcccatgcagaacaggtatcataacaagataaagtaaaaggaatttaacatttactaaactagcatctttggtacttagaagtgttgcccaagaactgagtgaaacactgacaaaacagataaaaacaaaggaaaagcagtatttcaataaatatgatgccaaataatgtaactgtacttacccagtatcccacaatgaataaaacctgccactccatggtgcaatgtaaccttggaaggaaaaacatggatgaaattaatctgcctttttattattttgtaaatcttttattgcctttatgtttattgctaattatagatagacaaactaatgttcaaagaatttcagttttcatttataggtgtcaacctatttcagacagttggcagtcagaaaaaataa

SEQ ID NO: 606105 - DNA, 104 bp, Homo sapiens
ttggcttggtacacccgccgagccatgctgggctgcatctacaacacaacagagctggtgatgatgcaggagtcctctccagcacttgaggacacttggcgctt

SEQ ID NO: 606106 - DNA, 373 bp, Homo sapiens
cgttctggtcccccacttgctgtatttatccaaaagaaaggaaatcagtatattgaagagatatctgcactaacaagttcatgggaagactattcacaacagccaagatatggagtcaacctaagtgtccatcaacaggtgcatggataaagaaaatgtggtacacgtacacaatggaatattatttagccacaaaaaagaataaaatattttcattctcaacaaaatgaatggaactggaagatattatgttaagtgaaataagccaaacacaaaaagacaaatactgcatgttctcactcatatgtgagagctaaaaaaaagttgaactcatggtgaagacaagacaaagacatggggtgaggggtcaggc

SEQ ID NO: 606107 - DNA, 497 bp, Homo sapiens
aaagaccaccaaacaggctttgtgtgagcaacaaggctgtttatttcacctgggtgcagtcgggctgagtctggagagtcagcaaagggagataggggtggggccgttttataggatttgggtaggtaaaggtaaattacagtcaaagggggttgttctctggtgggcaggggtggggatcacaaggtgctcagtgggggagcttttgagccaggatgacccaggagaaggaatttcacaaggtaatgtcgtcagttaaggcaaggaccgtccattttcacttcttttgtggtgatatgtcctcagttaaggcaggaactggccatctggatgcgtacgtgctggtcacagtgtatatgatggtttagctttggctcatcatcttgacatttctttcttcttattattgtttaagtttttataaaatcatagatattgttgaagttttggggcttgctgtatatttttggggtgtcggtatggagagtgtatgggcg

SEQ ID NO: 606108 - DNA, 370 bp, Homo sapiens
gggaacccctggatcatgactttggggtggaaaggattagaagggttggaaatcggccttaattgtggggggtggccaaggggccggccaccatgtccagactggttaattttcctccattcctttattatcaaggtcagaacctgcccaagggttttgtcaagggggttccagttcttactcccacttttttggaggtttaaggtccaccagatcctccagaggaggtggatcttaagcctaaaactttgaaggttggttaagggggaaaagggttatggttttaatttaaaggcgattcggggtttgccaggttaattcttcaaggaggtccaagtgaatgggtggaatgtgctaaatgaaccttatg

SEQ ID NO: 606109 - DNA, 660 bp, Homo sapiens
tacatggcaaggccacattgcggcagtaaggtggctgtgcaggggccaggcacagtgctgaccgtgagagccatgatggcactcatgcctgtgtggatactgcgcccatggccttggtcagaatacagtgcacagaacgagctgagaatggcatcaactaccgtatgaagctgaattccgccatgctccataagcttactgcgctcagcaagagaaagaggtgcacaaccacacccaccccaactacagcgtattgagaactgagcagagagccttcccatgacagagacagacaacccaatggcagggcctgaatgagtcatacactcctgtgcacaagctgactgacgctgaatctacatatactgaggaaagcagttgaaggtaggcgcatactgaagaggacacgtggtgggttatgcataacctatgtcgtagacaacctaggatacactatgagtctggaactggagctggtccttcacaatgtcgatagtaccggaagcacactctggctgtgaactggcgctggccatgctttatcgatcatacaggacccggcaaactggccaaagatactgcattttatttccgtttgaaccatgcaggagctgttgatgatgcaatgagggcataccgggatccggagccccggtggtc

SEQ ID NO: 606110 - DNA, 369 bp, Homo sapiens
ttttccaaggatttatttaatggggatgtgttcaaggcaagaccgaattcaaaaggatatcgacgccgtgatccacaagtccaaagctgaggactgcctgtttgcaggtgagttcttgcttttccagaaccttggacccagcgccccctttttagttttccaaccgaaacgtgtgtggctggggcagctactaactttgaaggcaaaacccgagtggccctagcgggggtctaggccaaggggcaaggcccggtatttccagccccgcgtagagcccgaagcctgcaagcacccctcctgggttccacaagcggcggcaaaacggggttggttggaccccccaggtttgcgtaatgggcttatcggggg

SEQ ID NO: 606111 - DNA, 172 bp, Homo sapiens
tgtctaagcctgctgctgggttctagggtgatccttgagctttggctcaaaacatcgtgtacaggctgggtgtggtggctcatgcctgcaatcccagcaccttgggaaggccgaggcggggggatcacgaggtcaggagatcccagaacttacacatcagagcccatgtaaa

SEQ ID NO: 606112 - DNA, 405 bp, Homo sapiens
gcactctatcagagatccccgagtctgatctccgcggatcatgggaattcacgccgtccgtctatcgaccgagttcggcatgctttatggtcataactaggacgtttttctgatcatctgcgaacatccgattgtcgttcttcattagtgaacccgttctcgtgcaatgctttcactctgcttcgtcttgcgccgtctctgtacatcttgacaacccttgcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcgggccccgcgggacactcagcttag

SEQ ID NO: 606113 - DNA, 430 bp, Homo sapiens
  misc_feature (134)..(134): n is a, c, g, or t
actggttgggctcatgacgaggacttggactgttcctgctcaccaccagagaggccatcggaaagtcagtgtctgtcacgcctcagtacctcctcctgcgagcagactcacgcagctggctcccccctccaggncaaagccaccaactgaaggtgcagggtcccctgccaaagccagccaggcttccaagctgcgagcctccaaggaggagaaagaggactggctgagccatgccctgtctcggaagaagtcccaaggcctggccagaagagcagcatgctgggacctctgaggcgctgcatttggcggggacagcgggccatcccccttttgcagccaacctctcaccagcacacaagggcttgagcacgcagttgctggagggagtctggaacaactgcacgaaaagaccgtggtcaggcctgggtct

SEQ ID NO: 606114 - DNA, 186 bp, Homo sapiens
gattgatctagagatccccaagcagttatacagaccatgctagacgtgacgcaaaacgtcatgttcaggaaggtactgaacccccagtccaggagcatactccagggaccaggatacaggaaggttccagtggacaataatagagtacattgccatgacgaccagcataaccatggaaggggcttt

SEQ ID NO: 606115 - DNA, 464 bp, Homo sapiens
tacgaagtcgaggttaataccctctgatgacagctgaaactcaggccattgataccaagggctcgaaagagtccacagccactaacctggagttcccctctcgtgctcgcccaggggtgtgaggggtgtagtgaccttcaagggtgctaaggaaaggattgtcgagcaaataagcaaaggccacagacctgcggggggccagcctaaaggtcccccagccctttctgccatgtagggaggccagaggaggcggattcctccaagagagaaatcagaaccagagcactgtggggagaagccagggcaggggtgcgtggctcggacgatccactccggttctgtgtctccagtggcagagcccaaggatttggaccctcagaaagtctagagggtcccacaggttgaattgcacggggaggggccagggtgtcatccacttgcagggggtccgaagaggaccgtgg

SEQ ID NO: 606116 - DNA, 138 bp, Homo sapiens
ccttactgaccactcccttatgctgaactttccaatccaaatttctattgttttagtgacatacagtgaatcagtgatatgtggcttgctcaaaactaaaaaactaaagtggtattaggcagcattaaaaaaagcatc

SEQ ID NO: 606117 - DNA, 354 bp, Homo sapiens
tcctgcattacggtgatatccttctaactggttctgctgttttcactctggccctcccacttccacaccagactattcttaacagcagttagcatgatcccagtagaaacttaggccatactgtgtcactcctctcctaaatccacctcacccagagtaaaggccaaagttctttttatttttttaagatagagtctcactctgttgcccaggctggagtgcagtggcacgatagctcattgtagcctcaacctcccaggttcaaccgatcctcctacctcagcccctaagtagctgggactacaggcttgtgccactaatttttgtatttttttgtagagacaaagggaaaca

SEQ ID NO: 606118 - DNA, 267 bp, Homo sapiens
  misc_feature (41)..(41): n is a, c, g, or t
  misc_feature (45)..(45): n is a, c, g, or t
  misc_feature (67)..(67): n is a, c, g, or t
  misc_feature (69)..(69): n is a, c, g, or t
  misc_feature (71)..(72): n is a, c, g, or t
  misc_feature (75)..(75): n is a, c, g, or t
  misc_feature (78)..(78): n is a, c, g, or t
  misc_feature (115)..(115): n is a, c, g, or t
  misc_feature (123)..(123): n is a, c, g, or t
  misc_feature (214)..(214): n is a, c, g, or t
  misc_feature (216)..(216): n is a, c, g, or t
  misc_feature (225)..(225): n is a, c, g, or t
cgacagtctgcctgggccacagccctctcaccctggtactncatncacgcaatgctagctgcccctntncnnttnttnttacccccccgtctcccccgaccccgggtcccaggtnatgctccncacctccacctgccccacttaccacctctgctagttccagacacctccacgtcccacctgtgttcctctcccatcgtcccacaaaagtgtngntacgtaggntacgtagtcttagtctgtagtctgtgtgtagtgtagtcagtg

SEQ ID NO: 606119 - DNA, 147 bp, Homo sapiens
agaagggatacccatgtcggacttcactacagagtagcattttccctggtaccttcagaggtcgcctgggttacaccggacctgaggagcctgctatagcgcggagtaggaaggctcccatccagtattcagataatcctatagacc

SEQ ID NO: 606120 - DNA, 572 bp, Homo sapiens
attcatgcggtgagccatcttggccaggctggtcttgaactccttacctcgtgatccaaccaccttgccctcccaaaatgctgagattacaggcataagcctccacgccaggccaaatttttgtatttttagtagagacagtgtttcaccatgttggccaggatggtcttgaactcctgacctcaagtgatcgcctacctcccaaagtgctgtgattacaggcgtgagccatcgggtggccagatctgggttttgatgcctgcactctgatatcctctaggcacacaaagaatgcagacaccggtcagacgcattgatagtgagcttgtgagccagcctgtcctgccctggggctatcatcgctttcgtccacccttggcagcaggaaactgcccctggagagggccaggaatcagggggtgccttgtggaagaggtgatgtttgagctgggcctctaagagaaagctgaaattcaccctgtgggggcaggacaggaaaaccatagaagaaacactgcaaggcaagagagaggacataggaagggcgagtggtccaggggctcaaagaggct

SEQ ID NO: 606121 - DNA, 314 bp, Homo sapiens
ggatttggaggttacagtgagctatgactgcaccactgcactccagcctaggtgacagagtgagactctgtctgaaataaataaatagtatttgcatggcattcacattgtattaggttttattagtaaactaaagatgattaaaagtatacgggaggatatgaataaggttatatacaaatattatgccattttatataagggactggaacatctgtggattttgacatctgtgggggtcctggaactaatcccccacagatactgagggatggatgactatatgtgtgtctgtatatttatgtgagtccgtg

SEQ ID NO: 606122 - DNA, 162 bp, Homo sapiens
aaaacccccccggttttggggggggctttttgcccttttttccccccggttttttcccccggggttttaaactttgggtttgggggttttttttgtttgggtttttttttttccggggttttttttttggttttcccaaaaaaaccctttggccttggccta

SEQ ID NO: 606123 - DNA, 102 bp, Homo sapiens
ggatttgctggtgcagtacaactaggcttaatagggacatgactgaggtgcctcccaacgctccgcccacgctgacaataaagttgctctgagtttgtaaaa

SEQ ID NO: 606124 - DNA, 354 bp, Homo sapiens
gcttaggcagacagatcacttgaggtcaggagtttgagatcagcctggccaacatggtgaaaccccatctctactaaaaatacaaaaaacttagccagatgtggttgtgcacacctatagtcccagctactcgggaggccgaggcaggagaatcgcttgaacctgggagatggacgttgcagtgagccgagatcacgccactgcactccagcctgggcaacggagtgagactccatctcacaaaaaagagaaaagaaaagaaaactttgcttcactaagtttctcttgccattatctcattaattcagatctgtacctcattgctgctcacacatatatgtttcttaccttagc

SEQ ID NO: 606125 - DNA, 662 bp, Homo sapiens
  misc_feature (634)..(634): n is a, c, g, or t
gtatcctttgtggcatgtccttatatctattgggtcactgtggttacatctattcatcttcaaatgcaagatctttgaaccataaacaaatcaagtgaaaagaatttttcattacctactctgtcatactaggttaatttaagtaaactaaaacaacagttctggaagttggcaacactagaaatctggaccagggttagaagaaagagataattaatgtaggcttcccacgtcaaaagaaatggagaatccctctttatcgtctgttttccttgcttctttggaattttctcagttgtatctcctttgttcttagttaccctggttgatcctaggcttctgactgaccccttgtacttttcctagatagtggtatcttgtgttctacccatatcatgtaaaatactgtattcaccatatcgatcttataggtctttaatccctgtttgtggaaatctaagaggaggtggaaaaagggaaacaagtgcttcttgtgcctcgtttaccctatactgaaaagatagacagcaggcataacccacaaaggcccctctgtcaccttcagaggacagttgcctgcccttctttcatgtagcaacatggtcactttttcaaaaataaaggcagggattanggataagctgttcttggacaaactgtct

SEQ ID NO: 606126 - DNA, 299 bp, Homo sapiens
tctctgcctcccagaattcaatgcgtctcctgtctcagcctcccgagtagctgggattacaggtatgcaccaccatgccgtggtaattttgtatttttttgtagggacggggtttcaccatgttggccaggctggtttcaaactcctggcttcaggtgatccacccatctcggccccccgaagtgctgggattacagacgtgagccactatgcccagccgaaagaccagttttggcttgagctattagaaaagactgtagggaaatgtttgaacttggctgaaacttaaagaaataatg

SEQ ID NO: 606127 - DNA, 123 bp, Homo sapiens
ggccccagatataagatgtcagaactctagaaaacgggtggtggggatgctcctttatagcaggaaaggtattccatgatttgtacgaaatactcattaaatatcgagcttggttacttcaga

SEQ ID NO: 606128 - DNA, 851 bp, Homo sapiens
actcctactcctcatgtacccattctaatcgcaatggcgattcctaatgcttaccgaacgagaaaattctaggctatatacaactacgcaaaggccccaagcgtagtatggcccctacgggctactacgacccttcggctgagcgccataaaaactcttcaccaaagagcccctaaaacccgccagatcctaccgatcgaccctctacatcaccggcccgaccttagctctcaccatcgctcttctactatgaacccccttcgccatatgcaagcacgcacctggtgaaccgtcaagctagggctcgctattgattctaggcagctctagcctatgcgtgtagagtcaatcctcgtgatcagggtgagacatcgaaggtcaagactagtgccctgatcggcgcactgcgagcaggaggcgagagcaatctcatatgaagtcgaccctagaccaatcattcgtactactcaacagttgaactaaataaggtggcgtcctcgtagagccgtctccagcccgttatcacgaacaggaagaacacctcgtgaattactcctgagcatcatgaccctggccataatatgactttatctccaaactagcggagagcaagcgaagcccccttcgatcttgccgaacggggaggtccgaactaagtctcaggcttcaggcatctgaataccgtcgtaggccccttgagccctattcttcatagcccgaactacgacgaacattaattatagtagacaccctcaccatacaatcgttgctaggaagaaatgtgacgcatctcccctgaatctaagaagatatttggtgccaagacccttatttaagcccccggcttatga

SEQ ID NO: 606129 - DNA, 495 bp, Homo sapiens
cccagccccaaattttatatattcatctgcttaatgaagttttcatccacatgtcccacaggcaccaacaagatcagaagtgaacagaacataattttcttcaaaatttccctccatcctaaccgtcctcttctagctcagttaacaataccagcctgcatccacttgataaatcagaatcctagaaacgtaggagtcatctaccttcttccttctacctcactccccaagaactggataggattggtgatcagtcagtcatcagtcttattcagtctacctgtctttcagctctgtctcttttctttggtccctgccactgccttggttaggtactcatcatctcttgcatggctacatccaggagacacataacaggtctctttccctctgtccactgattcatatttcttattcctgccaacatgatcttgtttatacttaactctgattgttaacagcttccctgcccagagttttctaatagctgaagga

SEQ ID NO: 606130 - DNA, 1093 bp, Homo sapiens
cgcgcgctcccgttgaggcgcctgcgccctggtcccgagggcgctccgttctgcgccgtggccgtgcccgtgggcctgcttcaccctgctgtcagcccaccccgctgcggcagccgcgcctcgtggcgctgtcagatgccctgctgctgtgctgttgcgtgggccgtaggtgctgctgcctgccctgcggcgctgagtgcctgatggcctgaggcccgcgcatgttcttccagctggcaactgctgctctctgcctgtgtgcggcctgagcccgcctgctgcactgctacttgctgtgccaccaattctggccagttctgccgtggcagcttgggcgactgtgcctgcctgccatgtaccttgggcgaggtgtgcactggctgacctggctgagacgcttgggagctgcagctcaagtggcgcctgggcccacgcccttctccagtgtccccagccttcctcctgatacgctcgtggtggcgtggccagctttacgtcccagacagcctcgctctgcgacttgacttcagcggaggcctggcccttgacttcccttgcgtcgggcagccctattattaagccccgaacgtgagaacacgaatgattgcttgattatgctaacaacgcggatagaacctggaagggaccgtgtgtgcaagtgaacttaggctggctcacagagagacaaaataccttgtgttgatccccaactttacattgagacaggcccgacggtcgcaaatggttcctaacgggtcaaaggccatccggggaggtcactaattgcagctaaacggacatatgttaccacgctttggagaggatacgccaaccaaagacggggcgcgggcggccttgcgatacacgatcaaggaggtacaaagggttggtggaggcgtaaggatgttatctagttgattgggatatgggaatacctttatgaggaattttatataagggtcattgcaatggattgatgaaaaatatggggtgttgcaagtgtcaccaagtattgatggaaaggtaacggagaattagagattcgtagaatgaaaggaaaataatgttcatggaaggtgcattataagccgga

SEQ ID NO: 606131 - DNA, 782 bp, Homo sapiens
gctttgacaagagtgtgtcagtggagctggagctgtcgagttgaaagccggcttggagggagtttaagagaaaaaccatagagtcctcttactaaaggattcacaagggaatcaacttttatatatgatgataaaaagatttgcatttgcacaacttggagaatgagttaccatctcattccagtcccaaacagttgactgtgggaggctatgggtggaagaggtgttggaactgaaattcagattttaactccatctgagaagcttacaaggcatcccagtggagatgttgaataggcagtgggatctaagagactagaagttggaagaccacggtcgtgggactgacagatacgacactttgggcagtcatagacatacaggtggtatctaaggcttgagagtggactcgagatcagcatcgaagagggtgtatacaagaaggccaaggaataagcctatagtatcagctgccatgtattaagaagatcaggaagaggaggaggaatgaggtaagaagactgaggtggaaagtcagtgaggaaggaacgaagatcagaagagggtggtatctggaaggtcaagtgagggacgggtatcatagcataaatgccatcaggtgtgtcaacttgtgggctgcaagagcattcggagtacgatgagatctgaggcaggagaagtccgttgaagctgctaggcagagatcgcaggtgagccactgatcaaggccattgtactccagactgagataaccaacgagcgaaactctgtcgaagaacaaa

SEQ ID NO: 606132 - DNA, 177 bp, Homo sapiens
  misc_feature (95)..(95): n is a, c, g, or t
  misc_feature (98)..(98): n is a, c, g, or t
  misc_feature (101)..(102): n is a, c, g, or t
caatctgggcttcagtcttcaaggctccgggacatttgatccgttttctgatgctcacgctgcatctgcaccacaagcctacatgccagcgcagnctntcnntagaagactgccggctgacccctttgctgactctgccgcggtactgggaccttcggtgcatagacgaagcaaaag

SEQ ID NO: 606133 - DNA, 806 bp, Homo sapiens
atttgtggcttcaatctacgatgttaaaactcagttaataacacctaagtgactaccacttagttctaaatccgtcactatggttttgtggctgtgtgttcagaagtagctagtgacttcggtatcacatataataagattcttaggtgtcttttaaggatactgtctaagaataatgacgtattgtgaaattgtgttaatatatataatactgtaaaaatatgtgagcatgatactatgcaccttataaatactgagaatatgaaattttaccattttgcgatgtgttttattcacttgtgtttgtatataaatggtgagcacattcaaattaaacgttatctcattgcacaaatattttatttttatcccatctcactttaactaataaacaatcatgcttataagctaacatgaattaagaactgacacaagaggaccatacatactaaagttattaatagccatttgaagaaggaggaattttagaagaggtagagataaatggaacacttaacccgtacactcggaattccctgaagcaacactgccagaagtgtgttatggtatgcactggttcctcaagtggctgtgattaattatagaaagtggggtgttgaagacgccaatctaatattggagagtggtgtatttctcccagtcaatcctgtcaatgtttgctttatgtatatgttggggaactgattgttctgataagtgtatgtgtttataacctgttatacaatttgttaattgagccttttattaacatataattgttatttttgtctcgaaataatgttttt

SEQ ID NO: 606134 - DNA, 1083 bp, Homo sapiens
ggcctgaggttgcacactccgacgaagaagggtaccggcgcccgggatggacgcctcagcgagtctccgagatcaccaacgcctggttccgtgctatgctaacaaccatatcttggctcctgaaggttctgactagagtcgtgggagacatgggcgcctaagcgcgaggttcatgacgtccacttccctcaatatcgcagtcgatcacaggttctgactcgggcacacactcattacttgccatttggaactttggcttatctactgggcttcacgcgatcccggttgagccctgttggaaccccgtcaccacgtattcgagtaccgaacagtagttgggatcgacaagcaaggaagatcccgtatagcacgattgggatcattattaatcgctgaagaacacaggacgtagagcagaacacaggaagggagaagtcagggcgggatcagggaagtgcaacggattgaggtccactggagtcgtttccgtataggtaatgccgccgtgcccgatgacatgggcaacagcaattctgaaggtgcaggacaggtgtcaagactctgaggggctgacatgaatcttgtcctgcagaggagcagtatgtgtcactggactcatcgaaggcagtgcacggggcgggctcaccaggagtcatgcccgtcactccagagatggacggtcttggtccgtcgtgaacgaacagagtaaggcaggctaccgggaccagccggtgggctgggagttccctatgaacagttcccatggcaccatatgactgtgtccatgcacgagggactagggaggccagggccagatgcagaggacagtacgtctccgggtctctgcggagtcaggttgaaaacgaccagatgtgggcgacgtgagtaagaaccatccgttgactcatgacacgggctgctggaagctgcacctgcaggaaaccatgggctcgatttgcactcggctcaggaggcccaaggcagttgtgcctcccacgggaaacttcccaagaccagaccgcacagcaattggcgggaccaacaacccgcgcacacgacaggcacccaaccgaaaaaacagcc

SEQ ID NO: 606135 - DNA, 213 bp, Homo sapiens
cccccctttttttttttgggagggcggtccagttttgcccatttacatccagagctgttaacaggaagggtcattacctgggaaaaacatggagaagcttccttgacccccccagaaatcccctcaaatttggggatggtcattccttttgggaaaaattaaaacaattcaggggttttttaaaaattttaataaaaaaggaaattttttcca

SEQ ID NO: 606136 - DNA, 262 bp, Homo sapiens
tgggagcatggaggcattacatgagatgctatgtgtaatcgaccacctagcctactctactacccctacccgtcctcccccagaatcacttcctaggacacccgagctgcttgcccaggatcctgtaaccctgctaacaccagagaagcatcccagggcttagtggcagtctctactacagagtcaacaccagttttcttcaaaacggtttgacttcaacttttgcacttacgctgatataactgaagtcattctcttctgt

SEQ ID NO: 606137 - DNA, 362 bp, Homo sapiens
aaaaaaattttttaaaaaaaaaaaaagggggccccccccaaaatttcccgaaaaaaaaaaggggccctttttccccccccaaaaaaaaaaaaaataacccccccccgttttttttttttaaggggccaaaaattggggggcacacgggggaaaaaattttttttttttaaaaaaaaaaattttttttaaaaaaggggggtaaaaaaaaaattttttaacccaaaaaaaaaaagttttttttttttttaaaaaaatttttttaaaaaatttaaaaccaaaaaaatttttttttttcttttaaaagggttttccttttaaaaaaaaaaaaccccccccccaaaaaaaaatttttttttttttta

SEQ ID NO: 606138 - DNA, 347 bp, Homo sapiens
cctttatttgaaagctttttaatttttctttccagtaacccattttgatttcataaattaaccatttatgccccccttttgtgttgaccctgtagctcatcctggaaaagtcgatcaatgttttgcagtttattgaaagtagttctatatataccaatgttataagcctttctttaaaaatggttgaaaatgcttttaaaatgtgattatcgcccatggtatgcatgatcgttgtaattgttgccattccttttaaaagttgtgaaatgttccaacttgggcttatgtagacccatttttttgtctcagtccagaggccctgccttcaataaagtctttttttccta

SEQ ID NO: 606139 - DNA, 1824 bp, Homo sapiens
  misc_feature (1451)..(1451): n is a, c, g, or t
tccatccccaaaaaagttttataaccttgattaaaaacttttccttgtgaattacatcacacgagaaaagaatattccttacaactatgaaaagaatattatcgaggggttatcccctttaacacaccatttattgggaatatggacaagtggccgagcttatatgtgccagctctttcaaaaaaacatactccatgtgaagtgtggttctcccactgtaaaagctcggtgacacatattggctgtgggccgtggagacattaaagtctcccatagcgggcaatttacaggttttttcaacacaatatatctcttcccacatctcataataatgtgcgcgaggtgtggtgaccccgtgacatgtggggcaaaaagtggtgggcactccatgagaggtattaacgaggaagttgtgctgtatatacagaaattctccccaacaaaaaggaaagtgtggggcgtatcttggcgcgtgcccctttgtacacaacacaaacaactttctccctttttatacacacaccccatctaccccaagaaaaggaaacatctaactctctaacggataatctgatgtggggggccattatctattaaaaaaatctcccccatataaccgaagttgaacaacatatttatacacaaagagtgcggggcgccccctcccccaagaggggggtttccccctcccactatttcacagcgtttaacgtttgggtagaaacaccacaagaaaccccccttctatttacaccagaggggggcgcaatatttcccccgggaaagggggagcgcgacgagaacactctgcgtggaaaaaaaatcttttcgaaaacccctccccaaagagtgttgttttcaatctaccgcgtggggcttcttggacacgacaccacccataaaacagcgcgcagttatcactccccgaaaaaacacgggagtattacatacgccccaactaataatacaccagtttgtttccgccgcctttatcacccacccacagtgtattatgctgcggcaaccatctcgtggggctaaaaaagccctctccgaataatacccaaaccacccacctctttttcgtcgctgggacaacacgttgctcagccgggcggaaactattcctcgtgagtgattctcttcccccccgaggattctgccccccttgtgggtatcttccccccaacacttcttcgtcggaggtcggccttcccccccccccttgtggcccccctctcggtgctttgtcccccccactcatgcggccacctcacatagcgggcgggcgctaccagtgcgggcagtcgtaagttgagcacccagctgccctcattgaaaaggtgggcggccccccaaaaaaaacttctccgcataacattctgttttacacacaagacacagggacggagtaatcacaacaaggggtccttagctacatatctatccangctcagtggatacacatatattattgaagcaacgccgacgattcgtgacgccaactatattacacacgaggagcgacgatatcatattcatgatagagcagagaaatgaaatatgttatcagacaaccccggtggtgtacaatatccactgaaaagcacaaaccataattggtagcattcactccggctctccacacaaaaaaagtggatcagccgatgcacttaattcagcacagatggttgacagtaaacttaccctcacacgtatactgtaatataactcacaccattattacctcctgtgcttcgtttctgcttttttctcctcatatcatgtccgttctctctacatatcgcatgaggagggcgagga

SEQ ID NO: 606140 - DNA, 1210 bp, Homo sapiens
aggctgtaccccctggggtatggcagtgtcaatacgcgagcgagcgatgcaagcgagcgcggcggggaaagaatgcagagaatgtccgcgcatctaccctccgctcctgggcgcgctctcattcatagcagcctcttcatgaattacagcatgaggggtgggcggaggacggggggggtaccaccataataccccagctaaagctccgggacccccaggcatcggctagctctgtgtgccgatgcatggtgaggcttggtatctgtgggcaccgtgtccactgtgcagcgaataaataccaccgtgtgaggggcttcaacgcactactggatggtgtacgtacgcggtccaggagcacagtaacatacagcactttgtggcacgaacagtcgtcgttccacttgcactaaagctttcctaggcctaggaaagaggaccctagataggcagtattcataccagcagcagcgaggcagcgagcatgcagtagcgagcatgcatcgatgcagcgagacagcagcacgcgagtagcagcagcagcacagcgagcagcgagcagcagcagcagcagccgcaggagcagcagcagcagcaggaggtagtaacaggacgctcaaaagcgtctacaaattacatgaaggagcacggaagggcaacaagcgttctaaacgacgtcccagagcaacgtacagagtgccgtcggaagaaccttccagggatgcacagagagatgtcttccgaagacatcctctaaggaaacccagaagaaagactcaagcactggaacagaatgatgaaccatcggttccgtaagaatgagccatatcgaggcacagcgtaaacgccccatgtctagaaggacgcccaagaagacagaattggttaagcgttagcgtccaacagtcaaccacgtgtggcaatcgactatgacaggcttccctagtttaagacggggtccgtcaccaaatttcacgaaagttaccacggaagacaccattcttcaggagcgaaacaaagagagggcacgtaatagacgtttgcagtccaggccagggccctttagtcttcccaccagcgttagacttagggacacaccagcccactagggatacttacagtatggatcccgtccctcgaccaagcactcgacgagctgtagtgacacagcgcatgtactcttaaatgatatgcgcacaggcgtcaaccagcg

SEQ ID NO: 606141 - DNA, 243 bp, Homo sapiens
  misc_feature (217)..(217): n is a, c, g, or t
  misc_feature (227)..(227): n is a, c, g, or t
cgcaggaccctttatgtgacgtgcaggacaggttgaacagtctaccctcccttagcaggaactactccgcaccctgtgagaccgtccgtagaccgtaagcatcttctcattacgctagcacgggttgggtactcctctatcttaggggccatcaatttcatcacaacaattatcatataaaaccccctgcctaacccaattaccaaagcgccccccnttcttcgccntgatccgtcctcgcac

SEQ ID NO: 606142 - DNA, 290 bp, Homo sapiens
  misc_feature (121)..(121): n is a, c, g, or t
tccccctttttttcccccaaatttggccccccttttttaaggttttttttttttaaaaaaaaaaagggattttagggccggccggggtttttttttaaattttttccccaaccccccttanggccccgggggttttaaggcccggttttaaaacgaaagtttttttttttaaaccccaaaaaccttttttgggattttttttggggaaaaaaaagccctttatttttttgctttttttaccgggccccggttgtttttttttaataaacggggcgggggcttttttccca

SEQ ID NO: 606143 - DNA, 383 bp, Homo sapiens
cgtgctactgtactccagcctgggtgacagagcaagacgccatctcaaaaaaacaaaaaaaaaattcaaacagcatggaatagataaaaatgcaagactgggcgcatgtgtcacgcctgtgatcccagcactttgggagggtgaggtgggtggatcacttgaggtgaggagttcaagaccagcctggccaacatggtgaaaccctgtctttactaaaaagatactaaaattagcagggcgtggtggtgagtgcctataattccagccacttgggaggttaaggcaggagaatcacttgaacccgtgaggtggaggtttgcagtgagccgagatcgcgccactgcactccagcctgggtgacaagagtgaaactcggcctcagg

SEQ ID NO: 606144 - DNA, 507 bp, Homo sapiens
acgaaggcgcgtcctaggcctgttagttctccttgtttaccaagcagctgtttggctttccgaagccccacttatctgtctttaagaggtttaaagaaactaccagaccattttccaatgaatgtcttggtaccaccagacccgtagttcctatagattcatcagatttgcattggatattcgcatgcctggggttacacctaaacagtccgatacatacttctgcatgtctatgcgaataccagtggatgaggaagccttcgtgattgacttcaagcctcgagccagcatggatactgtccatcacatgttactttttggatgcaatatgccttcatccactgtaagttactggtttcgtgatgaaggaacctgtacagataaagccaatattctgtatgcctgggcgaggaatgctcccccttaccgggtccccaaaggtgttggattcagagttggaggcgagactggacctaaatactttgtactacaggtacactatgggga

SEQ ID NO: 606145 - DNA, 498 bp, Homo sapiens
cctgcacatgtttctgtgtatgggatacaggcgcgtgcccaggccttggctaatttttgtattttagtagagacgaggtttcaccatgtgggtcgtcaggctgggtctcgaactcctcacgctcaagtgatccacccgcactcggcctcccaaagtgctgggattacaggcgtgagccaccgtgattgggcctacacagctttcaatggctggatctatactttatcaaagagaggaagcacaaggagcagggatcactaaaatatacctaatatggcatgtgaaagtgatcataatccagatgatctacaccaacactgcattggcatatatctgaccaaattttatgcgagataggcaggtctcgggcacttcaacattgagtgtcacatagaaaataataactaatagctgatgagggtactcatttatttaatcagaatacgggattatatccataaaatttacttgcagagaagtactttctttgtgttgcaa

SEQ ID NO: 606146 - DNA, 395 bp, Homo sapiens
  misc_feature (212)..(212): n is a, c, g, or t
  misc_feature (240)..(240): n is a, c, g, or t
ctgagctctgtgatgtagccgcttgcggagactgcaagcagccgcggcgcgcccggccctccctcttccgctgccgccgtgggaatggaaacatctgccccacatgccggaagccaagtggtggcgacaactgcacaccactccgcagcctaccacacagatcctctacatatgtcctcacaagacaagctcaccaaaatggccacatccantcaaagaaactttaaaggaaattttaantcactggaccttgcaaaatttactaagaagcagccatagtaacataaactattcgaacaagaatctaaaccttcagcagaaaagtatagcataacaacccagctattcattaaaaatatcactaaataatacaccaatttcatattccagaaagt

SEQ ID NO: 606147 - DNA, 403 bp, Homo sapiens
gccacccctaagtgatgcggacgctacctctaccacgtacacgccacaatgatatgcacctcctggcactgactcgatgagagtaagggagccggatttagggcattcacagtctctaaagttagtttactagcttcctgcacctgtacggcagcggctgctagtgctttaagacaaggaggccatccaagtgcaacagaatctagttgcctggataaatatgccaccaggcgatgccatgaccttatggcttgagtcagaacccctatggcctacctttcacttgtgcacatacaagaagaaaagcttgattagttagatctggcagtcctaaagctgacgcgctgagcaaggcttctttgatttctttaaaatccttctcctctttgcctgctagaggagg

SEQ ID NO: 606148 - DNA, 299 bp, Homo sapiens
cagagacgggaggctcagatctaattagaagccaccggcatagatcaggagggatacttcaactcaggaaacgggctccctgctgggttcaaattcaagctctaccacttactatctgtatgactaacccttgtgttcctcaactataaaacagagatggtagtagataccatcttaaaatacctggcgcgttgtgtggatatgaacgatcatgcgggtcatgcatttatcacagactctgctacataagtgatcagcaaatttgaggtactattcaatgaatggctctattgttcgga

SEQ ID NO: 606149 - DNA, 153 bp, Homo sapiens
aaaaaggggaagattttagcttgtcctaaattttgctgtccccccctcccggaaaggggcattgtaaaagaataaaacattttccactccttttggatttttccccccaaaaacccttttatccctgtaataaatcagcctggttttttttga

SEQ ID NO: 606150 - DNA, 353 bp, Homo sapiens
ctaattttaacccttgtctctttgagccaaatcaaatacattaattattggatcaaggataacttttataaaagggtctgggacaaggattaacattccccctttcttggctggtgtcttttgtcctgaaatcttactttgtctcattcatagtaaaataggttatttttcacactcctctcttcctttcgcaaacgccaaagccgtaaatgcattgagatcagaggcttctcattatttgtaattatcccctcagccgaatgcaagagggccccgtgggtaaggcagggtgttcacgaatacgccggcgttttcatcaccatcgataccatctcggctctttgcccctactc

SEQ ID NO: 606151 - DNA, 358 bp, Homo sapiens
atattgccccctataaccttggtggtcctggtcaagaatttggggtgggcggtggccctgtttgctttttattaacccaacttttttgggaatccccacaaaaaaaatttaaccccatatgggttccttttgttttaattttgtcccccagggcaagtggccggcaaaattcccgttttttttttcccaaatgtttgggacccggattatttgccaaaggaaaatgatacttttctttttttgctgttcccccaaatcccattcaaatgctttttgttttttttttttccccattcccatttcaaaaggttcccagggggctataataaataaacttcccccctttttttggttccca

SEQ ID NO: 606152 - DNA, 378 bp, Homo sapiens
  misc_feature (285)..(285): n is a, c, g, or t
  misc_feature (352)..(352): n is a, c, g, or t
  misc_feature (356)..(356): n is a, c, g, or t
ccgctacggacgcacgggcgcctgactgccatcggcgacctgacagtcaatgccaccaccctgaacaactacggcaccctgggcggcgccggaaaagtccggctgaacgccacgcacctggtcaatgacaagggcttgctcttcagcggcaacgacatggcgttgcgcgtcaatgatttcagcaaccgctatggcgacgtctacagcctcggcgccctggacatcgcccgggatgatgcgagcgcgcgcagcagcctgatcgagaacgtctccggcagcctgganagtggcaccggcatgcgcttgctggcagacaccctgagcaaccgtcgtgaccagttcaccactgaantgangctggtgtcgcgtccgtagcgg

SEQ ID NO: 606153 - DNA, 369 bp, Homo sapiens
aggctatacccctagttttagaagtttcaatagcatcattcttaaggccctaagattttcagaatggtaaatgagcatgctttagcttaatgtcaccacctgcattagcccctaacaggagtcaccttgtcctttgaagcaaggtgtttttttcctttctagctatgaaggtcctagatggcatcttcttccaatagaagactgtcttgtctactttgaaaatatgttgtttagtgtagctactgtagttattgtagctagatcttctggataacttgctgtagcttctacatcagcatttactgccttaccttgcttttttttttgggtttcctttggctatggaaatttctaaaactaggggggatc

SEQ ID NO: 606154 - DNA, 265 bp, Homo sapiens
ggctatacattgtctgatgacagaacactcacgtaggcacatataagcaatctcaaaatcagaaggctctcaagcactgacttaatgaaaacaaagtcacgtagagaaatattacctcttcccttcctccctatagttaacgtgaagctctggggcttgggcaaagtatacagcaaaggaagagatacttacctctcagctactgacatgtcctagtgctagccatactctactaagatagcctcagtaagtctcatcaatagta

SEQ ID NO: 606155 - DNA, 105 bp, Homo sapiens
tccatggtagctctattgaccccctgacaagggctgttcgttaccaacttcgaatggtgacaccgaccggagtcaattcgcaatacagtcggatttgtaaacagg

SEQ ID NO: 606156 - DNA, 205 bp, Homo sapiens
  misc_feature (9)..(9): n is a, c, g, or t
  misc_feature (53)..(53): n is a, c, g, or t
  misc_feature (58)..(58): n is a, c, g, or t
  misc_feature (68)..(68): n is a, c, g, or t
  misc_feature (87)..(87): n is a, c, g, or t
  misc_feature (95)..(95): n is a, c, g, or t
  misc_feature (109)..(109): n is a, c, g, or t
  misc_feature (166)..(166): n is a, c, g, or t
ggtgtggcnggaagagaatgtacgtataattcaggtccgaaatgctaacttgncgccnaaaacgtgtntatgttttctccctttttntgctcacnggctggctatgccntagtttcatataagatatatagatgttttggtttctgttttgagaaggttggtcttnaataatgagtgagtgcagacacccgccaccctgccacaa

SEQ ID NO: 606157 - DNA, 912 bp, Homo sapiens
ggggacactcggctgtggtgacgagaggcgaggtcctctgaatgatgcgaatcccggcgtgcgtactcagagtccatcacgaacctgcctaccatgtacggtgtgtgctactagcagctaagatgcttgcttgcctattgattacaggatgaggtgcatcctgcatgatcggtcggatcttacaattgcgtcaccgtatcatggctttctgacaagccacatgcaagtttcgatcctctgtgaatgtgactagagttccgacacagatcatgccaatgatatctccatacaagccgaacgcggaaagagacagctgaggttctccggcctgtgtgcttgtgtgcgaacggggagaatcttgggtctccacataggaccacgtccgagggaccgtcgcgtcctcaaatagtattacttgggtcattttgcttcgtaggtttccccaatttaggcttgcgaggctagcccggggggggacccctagtcgggaatttccgcgcaggagggctttgcttggctacgggacgggacatttcccctatgccttgagtggtgtgatccgccattggccccccaggtggatttccctttggtttgaggcactttttggcctttcgggagccgtaacgttccgcggtgtccggtttagggctgggtggccccatacccataaaacaggggttggaattggaagccccccgaatgaaagtggaatagcacaggggtaccctgtgtgttttagacaggcgccgggcgttgaaccagcttctttggcttcgggtcctacacaagaggcacaggctaatatttgggccaggtagggggatattccccagaagaccgcacccatagtgataacccgcaaaccctttggttgcctggttaggcaagagaatactcattacgacagcg

SEQ ID NO: 606158 - DNA, 128 bp, Homo sapiens
aggggggggggccggggttttattttggggccctcccgaaggggggaaaatgggaaaatttttttttttgaggaaaaggttagggggggtttttaaaaacttaaaaaaaaaattttttttctggggga

SEQ ID NO: 606159 - DNA, 981 bp, Homo sapiens
  misc_feature (234)..(234): n is a, c, g, or t
tggaaattggcacaaggcccctgttccgcctgtatttgacaccctgcaaaccgggattaggcaccttggaggttcaccagtggagaagtttataattataggaggaaatattatgggactggtaaaaattttgactgaaatcttccttggttgtggtggccacaaagaaaaggtattctgctcgtgaaatggtgcccggtgataagggccttttcaccctggctcaaaccttangtacatcctaggaaaaatactccgtgaattaactaaggtatcatccgtacccttctctttgtctcaccccgaaatatgatggggggaattacctgccctatacccctccctccataataccttactgtactctggaaatttaggccaaaccttaaatctccaggctttttaaagccccaaatataaattaaagctgggaaagttaaccccaaattctttccagattgttccctccatgaatatccccccttcctcttcgccaattttcccagagtggtacaccagatgggttagagcgccagctccaggtgaattaccccagcttgcctctctccaattccattcctcctctttcctcttcccaaggctgaaggccagggccctttcccagtccctccaccaaccctgtcccttccacctagtcccctcctgaccccagggatggaggctttggagtccccccagttgtggtgatacaccagagccacttagttgtccactcgcctggctttattttaaaggaactcgccagtaggcgttcctcttgttagagctcttgaaaaaggttgactataataagaggtctttgtatagtttttacattggtccaagtatttctccaaatcttttgttatccagagtacccattcccatcttcttaacttcgccagttgtgtgggaaactgttttgtaatgaaagattttcattgggggattgagcagcatttaataaagtttatgtttgta

SEQ ID NO: 606160 - DNA, 496 bp, Homo sapiens
aacgataaataaggacaaatctccaccttctcctcacaggtcgttgaaaggatcagaaaatgacacagcagagacgactggcacatagtaagcacttaacacacgtatctattactattgtcgttggtattaataacaaataacttgaacttgacgcctagtgtggatgcaggagtccacatggttattccaatttcctcacttgcccaagaagctaggtcacttaaatgacggctgggacgatggagaataccagatgatgataataagccacattaactgggcacctgccatgtgccaagcgccactctatggactgtaacattttgttagagtctcccagcagccctataagaattcctgtcattggccgggcgcagtggctcacgcctgtaatcccagcactttggaggctgagacaggagaatcgcttgaacccaggaggtagaggttgcagtgagccgagtttgtgccactgcactcccgactaggcgat

SEQ ID NO: 606161 - DNA, 655 bp, Homo sapiens
  misc_feature (36)..(36): n is a, c, g, or t
  misc_feature (270)..(270): n is a, c, g, or t
  misc_feature (325)..(325): n is a, c, g, or t
  misc_feature (337)..(337): n is a, c, g, or t
  misc_feature (345)..(345): n is a, c, g, or t
  misc_feature (370)..(370): n is a, c, g, or t
  misc_feature (373)..(373): n is a, c, g, or t
  misc_feature (402)..(402): n is a, c, g, or t
  misc_feature (421)..(421): n is a, c, g, or t
  misc_feature (439)..(439): n is a, c, g, or t
  misc_feature (446)..(446): n is a, c, g, or t
  misc_feature (449)..(450): n is a, c, g, or t
  misc_feature (453)..(454): n is a, c, g, or t
  misc_feature (456)..(457): n is a, c, g, or t
  misc_feature (464)..(464): n is a, c, g, or t
  misc_feature (473)..(473): n is a, c, g, or t
  misc_feature (484)..(484): n is a, c, g, or t
  misc_feature (492)..(492): n is a, c, g, or t
  misc_feature (496)..(496): n is a, c, g, or t
  misc_feature (499)..(499): n is a, c, g, or t
  misc_feature (509)..(509): n is a, c, g, or t
  misc_feature (526)..(526): n is a, c, g, or t
  misc_feature (535)..(535): n is a, c, g, or t
  misc_feature (562)..(562): n is a, c, g, or t
  misc_feature (573)..(573): n is a, c, g, or t
  misc_feature (578)..(578): n is a, c, g, or t
  misc_feature (581)..(581): n is a, c, g, or t
  misc_feature (587)..(587): n is a, c, g, or t
  misc_feature (652)..(652): n is a, c, g, or t
agttgattttttccccgggaccgtcttgcatactgntttttttgggttttaacatccgcaaaatcttggcatattaatttagttgggttgtagaattctgggtttaggaacaaaaaaaaattaggtggggatggttgacctatgctccctactctgtagcttttgtttttttaaaaactaagttttaaatcccgttttctgtcctgtcttctttaaaagcaaaacaaaacattttaagtttcttaactttttcctggggcaggggacggngcaaactcaaagctacagtattcttggaaagaagaggcaaccccctcccttggcncctttaggggcnggtggcgncatttattattgggactggaatggngtnaacaattctctctctttttttcccttgtnaacagcaactttcattgtngggggggggggggggggngaggccntgnnggnngnngtcactngggtcatgnggccttcgccnagaggtgnggcngcngggccgaccntgggggagtcctctccngcttcaatntgctgctggataggaactaatcagagngagagaagcgntaganggngaaggngggcgtcgcaggctttcccgctcacaaatctcacctccactacaactctctttatacttttcttncag

SEQ ID NO: 606162 - DNA, 341 bp, Homo sapiens
tgccatgcgacagttatttaagccagacaaacccattggaattcagatggaataagttcggtctttgacatcttccagctttgcaaagaagttgtggtatatgaagtattgcgagaagtatgagttttccccacgaaagaattgcttgatagtcttaatggtgaaaaacactcctactactgcaaggcatgctttgatgtcccttcatcattgctgggtcctcaatgcagggggccatttcatagatgaaaatggctctcgccttccagcaattccccgcagtgctacaaagtgggaagtcagagaccatcacagctgatgtcaatcacaacttgaaggat

SEQ ID NO: 606163 - DNA, 231 bp, Homo sapiens
tcggatcacgaggtaggagttgaagacagcctggccacgtggcgaaaccctactaaagatacaaaaaaaaaaaaatttagccgggcgttggtggtggttgcctgttgaccccaggtacttgaaaggctgaggcaggaaaatctcttaaccccaaaaggcaaagtttgcagtgacccgaaatcatgcctttgtccttctagcccgtgggtgacatgagcaagactccatctc

SEQ ID NO: 606164 - DNA, 495 bp, Homo sapiens
ggccaaagtgggtggatcacttgaggccaagggtttgagaccagcccggccaacatggtgaaaccctgtctctaccaaaaaaatagaaaaattaggtgggcgtggtggtgtactcctgtaatcctaggtactcaggagactgaggcatgagaatttcttgaacccaggaggcagaggttgcagtgagctgagatcacaccactgctctccaacctgggcaacagagcgagactctgtcttccaaaaaaaaaaaaattaggatatgtacttgggttaactaaacataatgctatggcacacttaatagactatagtatagtgaaaacataacttttacatgcatgggaaaccaacatactcgcattgactcaggtgacattggctttattgcagtggcccggaactgattgcacattatctttgaggtatgcctgtgttttccccttctggttgactttcttcacttggcttacaggacaccgtgcttatctcaat

SEQ ID NO: 606165 - DNA, 212 bp, Homo sapiens
tacgtggtgttaccgtgagggtgattgatgatggattcttttcagttcccttcagaatctagttaaatggagaagaaaacaatcatcataaatcacacatgatgtcttgagatttaacatttttcatataactcaagctactctgataatgacacttgaaagacagacaataataagggatatggatctccaactattaaatcagggcacgg

SEQ ID NO: 606166 - DNA, 440 bp, Homo sapiens
agcccaggctgtggccaaggtgtaacttgtaaacctgagttggaggcctatatttcacaataaaattggccccctgtgccctctggacatattactggtgcctttacttttaataaagcttggggccccctttacttttttatagcttaactaatttgaatgggggtacttccccctgtaggggaacggaaaagttgtttttaaagggatgggggggatatttttaaaaactccttttggttttcctgggggtcccattgatggatatgtttataaactgggttcttgttttataaacctgggtttttcttttttaatatgggtttctgaaggggatggggggttttgaaaatttttcttccctagggccttctgcatgttagcccagtcatggggaatttgctgcatagctttttttttaagtaaaagtttccccccca

SEQ ID NO: 606167 - DNA, 309 bp, Homo sapiens
ggtatcgtccagtatccagtgaggaagtggtcaggacccaccatgggtacttaaagcaagaagagctcgagtctttgatatacgaggtagtattggcatgtaagcttttacatcatctcagattacttataatacctacgtgcaccgtaaatgccatgtcaaaactggttatattatgtggttgacaaaataatgacgaaaaaaactcaatacatgttcagtatagatgcaaccatcctttctctagtcttatcctgagatctggtttaataagattaaagactaaggataagacaaggtagagccgag

SEQ ID NO: 606168 - DNA, 312 bp, Homo sapiens
tatcaactcatagtataaaaaaatgtaaattaaaattctataagagaaaatttttcacctgcctggttggcaaaaatccggaaatttggctctgtgggtgaggctatggggaattcttatatattgcttgtaatattcttataaattgtaaccattactattgaaagacaatttgacaatacctaaaagaaatgatgaatgcacttatttattgatacagcatttctgctttagggaaattattctgtagttattatacctggcactaatatggataccaacatatgtgcaaaggttattccattatagcag

SEQ ID NO: 606169 - DNA, 288 bp, Homo sapiens
aagtgcagtaagtaccagagtcctgctccacactaagtaccagagtcctgctccacaccgagcggcacgaagtcgacaataaataatgaatgaatgcattttttcagtggggtcaaagatttactattgcttccaagactgattagcagaaaatacattaaatgttaacatgatctcacgcttggcatgattactatgttgtgggattttgtaagtttctgtgattttaaacaaaataaagtagaagattatttctcttgtagtgacagaaaaaccactaaaatgcaa

SEQ ID NO: 606170 - DNA, 400 bp, Homo sapiens
  misc_feature (124)..(126): n is a, c, g, or t
  misc_feature (128)..(128): n is a, c, g, or t
ataggtgaagatgacatttggcggggccttcagccgcttccctccttccttaaggccaaggtgtccgtgccaagggcacaggcaaaaccaagggttcgggttttgtcagcttcaaggaccccannnantacgggggccccatgggtgaaataaatgggaagtatgtgggctcgccccccatcaagcttcgcaaaagcatgtggaaggcccggaatttggagggggtccccaaaaaccaaaaggaaaaaaaaaagcggggccttaaatagggtttgtggccaggcacccgctccccccgggggggggggggggtcctccctcagttttttttggaaaacccccagcgggccccccatccccggccccaaaaccggtttcaataaatttaggttcttttcca

SEQ ID NO: 606171 - DNA, 129 bp, Homo sapiens
gctggagctcgcgaggaatggcttctggggagcccatccaggacactgggagcacatagagattcacccatgttttttgaccttagagtaattctaatgcttttcttataattacacatatatccagga

SEQ ID NO: 606172 - DNA, 379 bp, Homo sapiens
ctatatatcacttgaccaagaaattggaatttctcaatgttcgtgcgggtatataccagatgagtacagtgagtagttttatgtatctccagagtgggttattgccaagttatacatctcccaaagctgtatgcccgaaggtttgtgttaccctggtttaccaaatgatcccagtagtatgactttgatatctatgaggatatcaattctactttaagtatcatttgattcgattcagaaagtactttgatatctttcagtgcttcagtgctatcattgtgagcagtcgtcttttatatacggtgcgtgtagccatcctaggcctgtctgtggcattctctagatgtttcttttcttcacaataaattccttatatcaa

SEQ ID NO: 606173 - DNA, 593 bp, Homo sapiens
attgaaaaaaaaccctcatcatagagaggtttcatgcgcatccataatgacatctgatatacattccatcggatggccaacggccctgaaggtacgccaaacacccgactgtcattcccgacagaattgccctcatagagaaaaccgacttaagccaggtgcagatgctaacatctgacctcacggccccttgtgtgtccgcagcatacatattacgatggcaggtgaacaagaacatcctgtccaacacctcgcagcactctctctactaaaaatacaaacatatccccacgcgttgtggcggagcctgtaggtgcagatactcgcgaggctacaagcatgagaacgtcgtgaacctgagaggacgtggctaggctgagccaaaactatgccattacactccaggccggcctacttggcaggactgcgccccctcagacacgatggtgcattgactgcatgaacactaacgctggcgaagcacttgtccagagagatctgctgcatatgaaactactgctcttgctgctgtttcaagaacaattgcatatttgctgcaatgctcataaattgatttctgtgtagacagagct

SEQ ID NO: 606174 - DNA, 186 bp, Homo sapiens
cgtggatgttatgttctgtctcttagccatcttgtgaattagggttcctgcgagaagtgatggagggtgctgagaaccagtgatgcaggagaacaaggtagaccagtgacgcagtatatgtatcggggatatagaccacgattcagcaggggccctcctcgccacagcacagcctagagaggacgg

SEQ ID NO: 606175 - DNA, 839 bp, Homo sapiens
  misc_feature (195)..(195): n is a, c, g, or t
  misc_feature (482)..(482): n is a, c, g, or t
ggacggcgcgtgtggtttgaggacgagaatgggccttgttgctaataagatggcatagttcgtagcgtgtgccgttccttagtgctctaatgttgcccaaccctgaagcttgcgagagaagtcgtactctggcttgagcatcactgtgcacgtctgctccactgtactgttgttatgtctcctcggtggttcggnagttcttcgactgtctgctcatacacaacggatgggaataactgttacgtgatgataaatcagttgccacgaaccttccaagatgtacgggtatctaatgtagcgtgaatagaagcagtgaggtcagtcagaaggagcgacatagactttgcttggagcatacagcaggtcatatgggagcaatgattatttagtaggggaaaggatcggtgggcagtccgagacgtgtcccgtaaactatagcagagttgggaaggatttaaggattgtacagtaaagtgcctggngagccagagtacggaaatgacggcacagaaataatcgcgctagaatggtcgaagtgagattcgcttgctgtctgttgcattgaggaattcgttctggtcgtgccttatgtggacgttgtctggtgcatggggcgtaagatgtgattacagtgagaaaagtgagataccgtgtcacgcgagacgtaatctgaatggagctgtagaagtgccgtattgtagacagacaaatcaagctgggaactacgtgtgattcttgctccatgatcagagtgcagagttttttacccagggtctgttaaccacaaatccttcctcaagatattcgaaaatggttgggaaccgatgcaactgaccgga

SEQ ID NO: 606176 - DNA, 305 bp, Homo sapiens
gtcagatagaggggagtatatactggggaggagatcgaacagggcagatgaaatcacgaggcaacagaaaggccgaggaggcagaaaagaagccgtccctttcttctgcctcgtggccctctccttcctgttatcccagcaatcctacccaagaactctcccaccgagaaagcttcgctatacagcaaggagcctcctttcaaggggactggatagtcaaaaatcaaaagctcgtcctcccctaagagcagaccaaagaaattctgacatctcttcaccaatccttccatatcagtgtgcggctg

SEQ ID NO: 606177 - DNA, 142 bp, Homo sapiens
tggatagtcctgaccacgacaaaataactacttctaattgctgcgggcacatttactatcaattgtatctgctcttcacttacacttccttctcctaccttgcctcccacttaacatatgtgggagacaaggtagagccgag

SEQ ID NO: 606178 - DNA, 215 bp, Homo sapiens
agcggatgcatgtgttgtagattcatgggttggcttttccgtgatagaggaagcctgtttgtctctttggggtcttgcccatgcatgggaaataccattctgatgtgctgtttgcttctaaggtaagactataggaaacccaggaaagttgtcgagtggagtgatatttaaggctgttactaaaaatagatggacagtgtttggccgcttttgtg

SEQ ID NO: 606179 - DNA, 697 bp, Homo sapiens
aaactggattatttaattattttctatggagtttggtcgctttgtattcggcttatcaatcgcttgtcggatgtgtagcttgcacatattttctctcttatctcttttttcttttggacgacagagtctcctctcatcacccagcctagtgtgcagtggcacagatctcagctcactgcaaacctctggcctcccagattcaaagcgattctcctgcctcagcctcccaagtagctgggattacaaggcgtgttgtcacttgcgcccagctagatttggtattttccagtagaaacagggtttctccatgctggccaggctgtcttaaactcctgacctcaggtgattcaccttacctcggctcgcatagtgctgggattacaggcataagccacatgcccagcttattttctgctcatttaaggaatggtctcttcatttgttgattgtttcctttggtggtgcagaaagtttgtggtatgatgtgatctcattgtgtacatttgatctcattcccgtgtgctttgaaacgattatttaaaaatcttgtgctcagatcaataacctgcagtgttgtctaaggtttttaggggcaagttaatacgtttcaagtattcgattttacggtattgaatccatttctatttggattggataggagggagagacaaggggctaggttaaatactaaggaatg

SEQ ID NO: 606180 - DNA, 640 bp, Homo sapiens
  misc_feature (166)..(166): n is a, c, g, or t
  misc_feature (381)..(381): n is a, c, g, or t
  misc_feature (439)..(439): n is a, c, g, or t
  misc_feature (458)..(458): n is a, c, g, or t
gctaactggttggccttttgaagacgccaaccgtgtgctaaccaccccaacgtgtaccaatatgccccaaggacatcccgcttgcccgccgcatacgctggaggacgtgcttaaggatcccctatgatggggaaccttttcattgttcccagaaaaaaaaaaaaanttctcttcttcctgttattggtagttctgaacgttagatattttttttccctggggtccaaaggtacctaagtatatgattgcgagtggaaaaataggggaccgaaatccggtattggccgtttttcccttttcatttgtgtgtgaatttttaatataaatgcggagacgtaaagccttaatgccaggtaaaatgtttccagtgaaccagtttcngcggttccactttataataattataaataaacctgttaaatttttctggaccatgccngcctttggatttttttaanaccagtaaatttcttattgatggccactaaatggtgtttgtagcatttttatcataccgtagattccatcccttcactatacttttctaactgagttgtcctacatgccagtacatgtttttaatgttgtctgtcttctgtgctgttcctgtaagtttgctattaaaatacccttaactata

SEQ ID NO: 606181 - DNA, 882 bp, Homo sapiens
caagaatgaagagccagtcagaagtgcagaaagaagagatagaagaagcgtcagctaatgctcgaaagaggaaatattcgccttcgctccccctccgaaccaacagaatcacggacacaagagtggcaagaaaggccaacgctagcctgtcaatgggaagcgcgagaagtcagaaagacggaggatgagccacacgaagatgctaaccaaggaatatggaagacccaaagctgtacccaatatagcaagaagtagttacttccccaaaaatgtgacagctaaaagaaggatcgggcaaaactacaaccatgtcaaacggacggaaacctggtaggcggatctacgactgcagcaggatggagagaacatctggcacagcgatggagggaacaggcaacgaatgaaagatcctgcccaaaagggtgacatcacgaggtccgatcagatggatcctctgggggaaagaataaactgtccaccacgagcagaagccaatccacatacatcaatgcccagtaatgccgctcacgggcacgatgatagacggtaacacacgctggaagccacggcgggcctcccacccgggagctgcgggcaacggcaacgaaaccacagtccaaaggaagacagaaactagcacctggactatcgaacaatagatgcactggaacggtagcggctaaaagccacaaagaagtatcaaacaagcaacggcctggccgcaagaacctgacggggcatcgccggcggcgagactgagcgccagccggaccgaccacggggagacggaaaacaccaggagaccggacagcaacccagcaagggaccgccaacccacgcagggcgagaaaccggaggccacgacgaacacggcggcaaacg

SEQ ID NO: 606182 - DNA, 177 bp, Homo sapiens
tgcagctgttccagaggatccctgcactgtagatcgctcggggttgcggcgcgcaggaacaccagctcctgctgctgccggccacaggccgcgcagcactcccggtcaccttgatgactcggaagcctgagtgtggcgccggttgagcatgatgatcttgtactcgtcggagcatca

SEQ ID NO: 606183 - DNA, 294 bp, Homo sapiens
  misc_feature (209)..(209): n is a, c, g, or t
tctggtgctctagatttatcccggtcgctcggacgaatgctcggattgttttaagaaaactggcagaacaaaaccagacatgggggaaaatcgcagcttcgataggccaagcttgaaggaaaacggagacgcaggggaaggaaaaagaaacaccctgcgcgaaccaaaagagacatgagcggagaagcggagtgaatcctagatctggnagggattgtccttaccccacgtccttcttcccgagaccccgagggtcgtgatgtggaggaaaggagccaccctgcaagatggccg

SEQ ID NO: 606184 - DNA, 705 bp, Homo sapiens
caccccattcctccccacactcatcggcgccacggtggtaccacggctactcctacctatctccccttttatactaataatcgttgtataaagaaaagaaaaaaaaaaaagaaaaacaaaacaaaaaagaaaaaaaacaaaaaacaaacaacaaaacaaaacaagaaagaggggccgcgcgcgcgcgcgccgacaaaccgctctctccctcccacgagggggcgcgccccacagaagacgctcccacgtcgcgcgccacgacaccacaccacaccgaaaaggctcatcatagacgggagggggcacgcgacaacacacgacggggggccgcccggccggcagccaccaccataccaagcagaggaggcgacggaaggccgcaggcggaaagcaagcactcactatccactcaaccgacaccaccgccccacccaccgcaagcggggcgcacgccccggcccggccaggccggggcccgcccccgcgccgaggccacgccagcccccaacccacgcgccgcgcatgcacccctccgccgcacacaacacgaccccacaaccccgcaccacaccaaagccaggccacgcccaccacacgccacgcccacgcccgaccggccggccgcggcgggaccggggccgcgcaccgcgacacgacaaccacacgagacgcacggcgggccgggcccgccggccacgacccccc

SEQ ID NO: 606185 - DNA, 238 bp, Homo sapiens
ccatatcacagtcgcacattgacatacagattcatactagtaggtcgacgcgtggaaatgtccacgtggtacatttccacgtagtcacaacagtgctaataggtagaggattaaaaactgcatcaaacaggtgctagagaataaatactacctacggacaaggaggtgagagccctcgtgtggggttagtttgcagaccccttgagtgtgtgtggggggtgactcgtggaaatgtcca

SEQ ID NO: 606186 - DNA, 235 bp, Homo sapiens
gtgcaggtagaggcttactagaagtgtgaaaacgtaggcttggattaaggcgacagcgatttctaggatagtcagtagaattagaattcgtgaagcatatatagtgtagatcggaaggttatatggttgatacttgctagggctggcgcttccaacttagcgtgcatgcagtaggctcgcctgcacgctaatgtttacgcgtgttacgcgcgtacgtgccagggcctcattggtt

SEQ ID NO: 606187 - DNA, 338 bp, Homo sapiens
  misc_feature (27)..(27): n is a, c, g, or t
  misc_feature (30)..(30): n is a, c, g, or t
  misc_feature (325)..(325): n is a, c, g, or t
cttagagtgagatgaagacccactggngtntttaaaatgttctagaaggccataagcaatctccctgtctagatggtagttataacttgaaaaacttccccagcattatcagagcaaggaaaccttttcttatgtacccagcagtcatttgtgagataacaacatatattttatattaaaatgtaaatgctaaaattccatttggattaagtatgtgataatacatctagacatactgatagttgtcatgatttattgctcagtggggaaatcaaaagatgtagtcattaaatttttgtattcccgggcacataaccagtatatnaggtcttccaaag

SEQ ID NO: 606188 - DNA, 216 bp, Homo sapiens
aaagataatttatctagccctaagtaaaccaagtctccaggcagctgctgaagagccaccacaaggtgaacaaaacagtactctaaccacagccttctgagtagctagaactacaggcacatgccaccactccctgaacgcaggagtttgaggctgcagtgagctatgatcgcatcactgcactccagcctgggtgacagagtgagatcctgtctt

SEQ ID NO: 606189 - DNA, 197 bp, Homo sapiens
ggggtgtaacttttccttgccgaaggcgcgaatcaggctctgggcgatctgatcgagcaccgccggattcggccatcattttgccgagcatcgtgcccagcgcgaggatgatgccgacaaagccgagtactccgccgaaaccgtcctggaacgccttgatgatcttgtccacgggcatacccgaggtcaggccgagg

SEQ ID NO: 606190 - DNA, 470 bp, Homo sapiens
tacgagtttcagcacgagggaacagctcgcgcaatttttcgttgcagaaagaagttcggcgctatctgatgatgtcgagaaagacatcgtcctttataactacactcatagagttatcagtgcagatctggcccatgtaatagtgtgtcgacatgagtccttctgggcctcccttcaacagagaagtccaacagccagtgaaagagaagacatggcagaactgtgcgagattcatccttctaacattctcagggttctcttggaggacagacccaggcccaaagacagaagttaccgggagggaggcttcaactccatctaaggaagacctttctaacagttagagctgctcaacaactgaatggactgcttggtgaggtagagtcacttggaagtgttcaaggtggaaagatcacccttgtagaagggactcctgcatttgttaagaggttagagactggatgaacctc

SEQ ID NO: 606191 - DNA, 372 bp, Homo sapiens
  misc_feature (38)..(38): n is a, c, g, or t
  misc_feature (40)..(40): n is a, c, g, or t
  misc_feature (156)..(156): n is a, c, g, or t
  misc_feature (293)..(293): n is a, c, g, or t
  misc_feature (319)..(319): n is a, c, g, or t
  misc_feature (362)..(362): n is a, c, g, or t
ctcaactgccactcacctatctaccatccactacccantnaccacccaccatgacccaccatttgccatctacccatccatccattctataaataattagtaagcacttaatgcatgctaggtattattttaggcaccagtaagacaatcatgggnaaaaaagacagacaacccccgaccctcccatcctcagggagctctattccagtgagaacaatcaatgtgctagattgtgaaggtcatcagtgcttgctgcccgtgtaagactgaggttcccaggcccgaggaccagnctgggccagggcttcccaggggtctnctggtgggggactctcaggagtccagctgctgccccttagctnagcacctggg

SEQ ID NO: 606192 - DNA, 120 bp, Homo sapiens
cttttgctgattggtctggtatggtcccgatgccaggaccgtcattgacggcgctgaccttccccggccgcgcggagagccgggacactgctcgcctgttgtcgcggcgttggatgcagt

SEQ ID NO: 606193 - DNA, 290 bp, Homo sapiens
ccccacccttgagtttagttgcaggcccaggccctttgttttgctcccgggttaggaggtggccctctgtttgggggaacagccccctcctccccgccccccgtgcaaaagttgagccggcaaagcaaggggggcggccccagggccctgggccccctttgcacacccgctttccggcccgcgcccctgtttacagggtccctgtgtatgttggactgactgtaataaatctgtttatatcgacttgtccatgtacgtttattaaaaccatagtccgagcgtgttaacca

SEQ ID NO: 606194 - DNA, 743 bp, Homo sapiens
  misc_feature (1)..(1): n is a, c, g, or t
nggggtcccattctcccccttcccatgttttgttctaccgccgggaaggggccaccttctctttgggacctccagttcgttggaatcttagtaccagggctgcaaacaggtagtatccacggaggcccccctcaatccagcccgtgctcctgggttcccgggccggggcagtgtcccacctagcctgctcagttttggggtcgccagtgctaggcacgctttactaaagcagctggtgtgaggtcctggtctcctgaaagacggtagtcagacctccgcctccatccagaacaagcttggggcgccatgcccagtagggaataagccatccacagccttctctgtccacggctcctctgtcctgcctacactggtcctggcggggcttctctatttgacttggtttcctatcacaaattcttggctcagggcctgggttgatgtagcttagggaagcacgtccgtttgagtgcatttcctccagtctgccgattggcttctccgtctacccgcagtggcctcacaaagaggtcctcctgccccccatgctcatgtggtgtcccctccgcccacgtgttttatgtccctggctgtatacatggatttatattcttgatattttctgcccactctacaatgtttgctccatgaaggcgcagacttttcatgttctcttctctatccctagagtaagacccacttggcccaggcatatagtagctgcttaattaatacttgtctgt

SEQ ID NO: 606195 - DNA, 456 bp, Homo sapiens
  misc_feature (47)..(47): n is a, c, g, or t
gggttttgaccaatacccgaccgtaaggcctttccccaccaaatacnacgcctcttaaccaaactatggctgtccccggaccccctggtataatagaaattgtttaccctttaatacccaaagaaggttgggaaacgcccccaaaatctgcaatgtggtgtgtgccccgcgcacgacttcgaaggggttcgctgctgtaagacctataagtttttaatgagattgtcccaaaccacaaagaaaccacagtcacgcccgggcctattggtggttccacatgtgtggctaaaatgtgttcgtgacccggatccagcgtgctttccttatcgaggacgcccgaaaatcgttgtgaaagtgttgaaggccaccagccccgagtccagaaagctaaattaaaaaatgaaacttttttgagtaattaaaatgaaaagaccctagttaacaaagaaaaaaata

SEQ ID NO: 606196 - DNA, 556 bp, Homo sapiens
ggtgatcggcgcggtgacctagaggatccccgtcgcgagtgtatcctagcatcattcttaagggccttaggattcttggaatggtaaatgagcatggcttcaacttaaagtcactagctgcactagcccctcacaagagagtcagcctgtcctttgaagccagacactgacttttctgtagctatgaaagtcctagagccatcttcttccactataaagctgttctgtttacactgaaaatctgttgtttaatggagtgaccttcatcgatgctcttggctagatgttctggagaacttgctgcagcttctccagcaacacttgctgcttcaccttgcactgctatgttatggagggtggcttctttccttagttctcatggattgacctctgctagtttccagcttttcttctgcagctccctcacctctcgggcttcataacatggaagagagttagagtcttgccctggattaggttttggcttaagcgaggatagtggctgttttgatctgttcttggccattaaactttctgcttatcagcgacagtgcag

SEQ ID NO: 606197 - DNA, 1174 bp, Homo sapiens
  misc_feature (334)..(334): n is a, c, g, or t
gccaacccagcatgagcgccgcaaccacttcgcccatgatgcatgtggcgtccggcaactgtgaccgcgagcctttgccccccggatgggacgatcaagatcgacccagcagaccggcctggcccttcttcgtggaccacaaacagccgcaccacatacgtggaacgatctcgcagcgtgccacatcatgagaggcgctccaaggagactccgagtcctcgtgccaatggcccttcccgtgcatggtgctctaggcctgccgttctggctagtgcgaagtgcgcacacctgatgtaacccccatgggctccgaaccagtgctacattacccatntccttgtgctccattgacacagcgcatgagaatcctggcatggtgcaacccttttccatgtctatgccccagcctgggatgcacgtcgagttccgaactgagcgcgagcagtcagcagtgctccatcacgagagtcccaaggtcaccatctgcgtggcgccatgccagaaaccacgtcagccaggactaaaccacgtgttggacaagagtggcatgcgggctggcgggcacgccccaggcgcccacagccttcacccagggagaccttgaggcgagtcccaggtcctcacaggcatgcctccttgacctgcatcagtcgcttcatacctccatctgtgaccaagccatgacctttccttcctgtgccagggagcaaggcacagggccgaggtcactcaagggcttccctcgggagggcgtaacaatcatcccaattcccggggtggattaacagcgagaaggcatgcaaacggtttaccccgagcccatgcaggcaccaatgccctttcctttccaagcaagggcacatgaaagaaggctaggtacaccaaagcgcaggcacagtgcgaacagtacccaagatcccaaccaaggccttgatgatacacaccagacgaaatgccaaggggggaactgcgcttgggaaaggccccagagacccccagtccggggcagggacaccccccagtacacaaggaccaaccatcgacccaggggctgcacaactcagacggcgcgagaaagagcatacacaccaacgccaaaagaaacaagcaaagcccaaatccaacgtcccacaatgggcccacccggtagggccacaccggcgagacaaccagg

SEQ ID NO: 606198 - DNA, 160 bp, Homo sapiens
ccatgtggggcatacgtttgaagaaatctctatttcaatctattcctatacgttagttatgaaaaagaatagacaatcacaaaaacaagtggaccatttggtgttcccgtgagcccagttcacgaaatgccctagtgatgggacctcgggcccaacatgg

SEQ ID NO: 606199 - DNA, 251 bp, Homo sapiens
agtacacaggatcaagatgggaagattgcttgagcccaggaggtcaaggctgcagtgagccatgatccctccactgcactccagcctgggtgacagagcaagaccctgtccaaaaaaaaaaaaaaaaaaattattatttaaaatttttcatacccttcctggggggtcgtttccttccctgtattttactactgaataagatttggggggaccattatttttgcgtgctcccttattttgcgttgcacgca

SEQ ID NO: 606200 - DNA, 772 bp, Homo sapiens
acgggtaaaatatttatttggtttatgtaccttccaaatgaagaacactcagtatgaagcaaaaactattctctgacaaagatgtgaaaggggggagtgaattactgtccaggtgcatatcaacctctccatgcaattacatcggtatcttatgcaatggagaaactgggtttacacagctccgtaactggcagtatttttaaacaccccattgttggcagtcttcagaatactttccaattaaacgggtcgacatgtttaaagatgagaagataagatgtttcgctattggtaaagttgagtaatagctaatacgatgcacacttccttccattaatataatatctgggaacaactttagtggtaaacaaaaactctatcgcgcgttatcagataactctaacagcggcatacttttcactgagacacttccgtggtgagccaggcctcgtagtaacacatctgaacatgcaatttcacattccaggggtggacataagacggtgtcaataggatcgcggtgtattcaccaacgtgacttatgatgaccatgcatgacagcgtgcactaagcgcggttgtccaaccaaccctttaccgggcatttaaagccagcaagacccgcttgctatggcagccgtacacgggtgccccgctggcaccattcttagaattggtcacttgaataactcaggctgaataacctttccccttccaaaaaacaacaaacagaaacaggttagccttaatactcaaaaaacatctgtaaaacc

SEQ ID NO: 606201 - DNA, 268 bp, Homo sapiens
gcgtcgacggggaagagcaagaactcactggaaacgaactagacaccactggcacccctcgtggcttctaaccatgaccaccttcagagacaatggctattgctgcaaatgtgccttccatgtcccagatacatttcccttttgccaacttcaacctgaaactacacagggagggggattctggaaaacagccaattggacatgaaaaccttctaccggaagacatcttgggctcttaaaataaaaagatttccctgccgggcacagt

SEQ ID NO: 606202 - DNA, 260 bp, Homo sapiens
  misc_feature (77)..(77): n is a, c, g, or t
  misc_feature (96)..(97): n is a, c, g, or t
  misc_feature (115)..(115): n is a, c, g, or t
  misc_feature (134)..(134): n is a, c, g, or t
  misc_feature (153)..(153): n is a, c, g, or t
  misc_feature (237)..(237): n is a, c, g, or t
  misc_feature (244)..(244): n is a, c, g, or t
ccccaaatcctctatattgccgttgccttccacacacacctttaaaaagaggatcaaccagggtggtgaagatcagncggaatgcttctttggaanntccactggcatcatctancagaacaatggtgtgagcntgaagaggcacagacaggnctccaaaatagatgttaggatttgggtgctacctgacacagaagtaggtctaaccctccaagttactggggatgataggattantcaatgnaggtattatatatgat

SEQ ID NO: 606203 - DNA, 1171 bp, Homo sapiens
tacagggcttccttctctttctcttcctagccacccaaattttaagggtggttaattctcacaccttaataaaagcaagtgtggtgggtggcctcagtgccgtgttaatcccgagaatttggggaaggctgtgaggcagacacgagattcattgggagcctcgaggatagttcgaaaaccagccgtgggcacacatgtgggtgaaaccctgtggtctctcttaccaaaacaccacaaagaaaactttagcggggcaaagtgggtggcctgtgaaatcgtggtcccaagattacttggggaaggctgtgagggcttggaagccccgagaggggcgcccagaagaggttgtgcgagaggaacccggaagaatcgagtgcccattatcacacctccgcacgcgtgggtggtgaacgtggggtggagaaccccaaatcctcaaaaaaaaacaacaaaacaaaaaaacacccagaggcgaactaaaagtgccggggtgcgcgcgagcaacaaagggggacacaggaacagggcgcccacgggggccacaaacgcggtgttcccagtacacacacaaacttcaccctctgggcccccccagaggggggggaaaactactcgcgcgggggcatccccccccctatataagcgagagaagacgagagaaatctacaaaattctccgagaaactaagcccccgagggttaacccccgtgggcaaaaaaggaaccgcgagcgcacacaacaacagaaaaaccacaacacacaacaaaccacgacccccgaccaacccacagaaccaacagaccaacacgagggctcacacacaaacaacaaatcacagaatcagcccacgtcaagaccgctcaccaaaacgacacaacacaaaagagacaaaaatatatacaaaccaaaacacccaaacactaaaccagctccaacctataaacacaggagcacatggcttgaaaaaagaaacgggcggaccagaaagaacacaaacggagcgcggagagcagcagtgcaaagaagcacgagcacgatggagacctacacaccaccggccgaacccccgactacgaaggcaaggaaacacaacagtgtgaggcgcaaatactgcgtacatacgatagagaataggtgcctggagcaggcagagaatacgcgcgggcacgac

SEQ ID NO: 606204 - DNA, 208 bp, Homo sapiens
ctgcttcggtcgctctgcggatccccccggatattaatactgtgggttgggtgacgggagatgacgtccggttcttgacgctggtgcgtaggctttggacacgtagagcaggaggtggcacgagagaagggtggttacgcgcgaatgaagaacgcctgaatacttaggaatctcagaccatttctcacacagttctctacgtatccgg

SEQ ID NO: 606205 - DNA, 351 bp, Homo sapiens
  misc_feature (34)..(34): n is a, c, g, or t
gacgctcccctttttaaaggcatggaaaataaanaccctggctctgcggcttgccgtggaaaagctgcttttctctttgcccttgtggccgcaagaggaagaggacgtggaatgtgacgtggaaacatctttcaaaagcgacgataattttctatgttgaacagaactttgtccttttttctttcttgttatctgcgttcattggtgtgtgtgcttgtgcatatatgctcggtatcttttgccctctttctctttcgatcaggggaaatgtttaagctaaataaatctggtttgttttttgttctgttttgttttgttttctttgagaaaataaggtctttgtgttcattt

SEQ ID NO: 606206 - DNA, 141 bp, Homo sapiens
aactccatgtagctgtcaaaaacgcttgggcatggcttcctctctgccttctgacatgtggacacgtggccttcctcccctctctcctccggggaatgccgttgttttgggcgccatcttgggaagacagagatcaggcct

SEQ ID NO: 606207 - DNA, 354 bp, Homo sapiens
ggctccctagtgccccacagaatatgcttctgtctgccattttcaaagactagaataatctgccctgaattagtctatccaacatcccccagtgaatggtccctcccccaattatggcccctcatgggccataacagtaacaaccatcagtaacttatttatcattagcagcttagaagctgtgttctcttgttttttactcacagcaagtctgtaatatcaatgtaattactattattgttgctgttttaatgattgggatttaagcagggtataaagtacatctactgtcttcatcaagcccccatgcaaatgttgaaatggctagtttgcattttgttttgattagtttgg

SEQ ID NO: 606208 - DNA, 258 bp, Homo sapiens
gtttcaagaaaaccctttaaaaaatttccatgttccttaatttgcacgaatttttctcccacaagatgtgccttgccttccgagaatatgtattacctttaaacaatatcagcgcacacacatcgctgcatgttcttgtcgtgtagtttaaaaaaaaaaggacaaagcagtgacactgaactaaaaagtaaaaattgaaaagggatgtatttctatttgtaaaaaaaataaaataaaaaataagaaagtggggatcta

SEQ ID NO: 606209 - DNA, 575 bp, Homo sapiens
ttagaagtctaatgacactaggaagcaaaccaaggctgacttcagacttgtatgtagtacctgtgggtttattacctatgggtttatatcctcaaatacgacattctagtcaaagtcttggtaatataaccaatgttttcaaatgtattctgtcatacaaagagcagatttttattgaacttgtgcaataactatattaccatacaatataaatattcatgaatagtttcccaagtctggagcgaccacatagggagaaaatgtaaatgtctcaattttggttcacaaaagtatattttatcaaattgctgtaagctgtggatagcttaaaagaaaaaaagtttcctgaaatctgggaaacaagacatttaaagaatcagcaaaatttcaaataaaaaattatgaaaatattatcctcattagttcatttagtcccatgaaattaattattttctctgcttgatcttggtggacagtttcatgaagctgtcagttagttcattaaagttttggaaattctcagacagtgcagtggtatcagaaacttgtattcaaaagtacaaggccatccgtct

SEQ ID NO: 606210 - DNA, 225 bp, Homo sapiens
ggagccccgtgtccccacggcggcagcaagcggcggggggggtgaacgcggagggggcggaggagcccggggcggaggtacaggaattgcggaaaacggtgtttgacacccggtgggtgatcacccaaaggccgcagaacctgaaattgaacgcctaaggggaccccccaagaaaatttccctccgaggatcgatgtgaggcaaccccggccaaacgggtgggag

SEQ ID NO: 606211 - DNA, 400 bp, Homo sapiens
  misc_feature (64)..(64): n is a, c, g, or t
aggaaaattcccttgtttattcgccgaaagtttgggcaaacattttaagcggcaacagcatcancaacgcactggtttccctcgaaatccctcgcttggtggagcgcctccgcagggcgttcaaggaggacggagacaagaagcctctgactcgccgcaccggctggaagatcctgtgggatgtcaggcgctccaaggtcgtgattacggagaaggacggcagcgtctgggagcaaaaggtcagcgagctgcctcctagcgtgcaggagattatcgccgtcaagggtctcgagaactgggtcaagtccaagcttcaggctttggaatccgaatcatgatgtgggatgaaaatgtttatagtcagctagataaaaatgtgaaataaagaaagggcatagaa

SEQ ID NO: 606212 - DNA, 338 bp, Homo sapiens
atcactatcatggcggcttacagtcaaattcatgacaagttgtcatcgtaataccttctgtcgtacataacctccatccactctgcttgtgtcctgtcaggaatgtcggtaagtaggcagtcaatactcgatattaatatagatcgcatgtaacacttgagtagccagctgtgccaaacctcgtcatctatgccatgtatagcctagaccgtaaagtgtctaatcctccccggacatggaggacccagtggcccaacagcagcgccaacaatagtctgcatcactgtgcgtgttttccgagggttcgacacttctcctgagggtgtccgcaatgagac

SEQ ID NO: 606213 - DNA, 405 bp, Homo sapiens
  misc_feature (398)..(398): n is a, c, g, or t
tggtcctcaaaaacctcccccatggtaagggccccccatatttaattgtggattccaattatgccccctagaacaattttatgccccccggcattgttgaaaatagtagaacaataatcctggcccattagttcctgggtatgatcatgaagccctaacttctgaatatgatcacagagaaagatagtaaaaaagaacctttcccaaaccattgtcattccccaggtgactgtggacatactcaaagctgtgctccctgaggaacaacttcagagcctgtacactacaggggtgatggtgaggaatggacttcactaaaatagttgagtcattcactagcaaaatgaacaagcaaacaacaaaaacaatccccaaaagtggggcaccagtacccagantttcaaa

SEQ ID NO: 606214 - DNA, 238 bp, Homo sapiens
caggatcttacccgtacgcccaacacaggcccgcattatatcaacactccgcgaacacacaaaactgacaggccagacgggggagcacacatcggatacaaagatcgggctctcgagagacgcggcctgttggtctcccatgttagctccaagtgactaagcgcagggtgggaaataacgccactatgccggcaaatctcccgcctgggccctgagttcggcagccttttcacgggga

SEQ ID NO: 606215 - DNA, 429 bp, Homo sapiens
gataaagagcatccccgtatacagaggctaattaatttattgaaacacagataaatgagcagagagagagaatgggagaggcagagacaggcagatagccgatgtgcaaggttctggtcctggcccttcctgctcctaaggccccttcctataggtgccagcggaacttctttctagaggtggcctttcccatcgtgtgggtgtggcagagtcccagaagtgggtggatcacacagtagaaatgtgatgccaggagttgggaggggtctttcaaagtgcaggagaagtagctgagcacttgctccaggcgcctggactgcatgggccaagcaaggcagggcaggacagatgcctggggcctgggacttgagttggggtgcctaacatttccggcagctgctgccgcaagaccccacacccagggagctg

SEQ ID NO: 606216 - DNA, 489 bp, Homo sapiens
tcccaggctcaagtgattctcatacctcagccttccaagtagctggggttacaggcgcctcaatcatatctggccaattttttgtattcccagtacagacagggtttcgccatgttggccaggctggtttcaaactcctgaactcagatgatctgcctgcctcgaactcccaaagcgctgggattctaggcacgaaccacattgcacccggcctcaaacttttcatttttaacagactgtagctccgacgtaactactcagtgtgtgggcccgcatcggaaggaatgtctgcaagcttccttccctttcagcaaatgctcagaatagctccattagcgtccatggaccttctgcacatgcattcaaggagaaaacagccacaaataacacagcctgctttccaaatctccaaagcacaatctctgcactcattctactttccaactatcaccactgacggcttacagccagagagcaatttgttttcaa

SEQ ID NO: 606217 - DNA, 700 bp, Homo sapiens
ctcccaggaccacccccaaaaagaaaagctctcacgttgctccaccaataaacgtttcgatctttaaaatataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcgcgcccccaattaattttcttctgttaatacgtagaaccaaaaactcacgccgccccactatttattataataaatatagagagagcgcgcgcgcccactaatcgatgtagtgcttgttacaaatatatgtagaacagcgcacgcctcttattttaagttaggaattagctaaatatgtgtggagacacaccacttctctaccgagcgagttatacgaagccgacaccacgctctctcttcttatcgcggggggcagcaaagataataacgggcaggcacacaaactacctaagatatgattgtcatcctctgatgagaagaaaaacattatcctgctctatctgagcgcgacgttacctgttgtggagagacacaacacatcaccccccaagctcatcatcgtctaatcaacaaactaccgcatcgtcctcatcttcgatagcagacgatatatcttcataacatacaaacatattatttctatccatacgagcgccgag

SEQ ID NO: 606218 - DNA, 199 bp, Homo sapiens
gcacggtgtgtcacgcgcgtagctgtggcggaacgtgttgagcgggatggatggcaagcggcggccagcccagggcgcggggtgccccaaagctggcccgtgggcgcctctgggatgatgatgatgccactcggccatcccaattcggaggaggccctgcactgatggaggagatggaggcagaaccacaggctgcaag

SEQ ID NO: 606219 - DNA, 125 bp, Homo sapiens
ccctgcaccgcgaatctccacactgcacacgccgaagcacatactttaacaacccattatcgccgatcttcacgtgcacacgccgaggaaccatactgagcaaaccattatcgccgatcttcacg

SEQ ID NO: 606220 - DNA, 356 bp, Homo sapiens
gggtgaaaaagctttatttataaacccactcacagggcccgatttgggccacgggccgtaattgccaacccggctttaactggtgggcctcacgttagtctcactgcctcctgcagggggggcatgtgggtgtcgtgttcacccagcccctttcttcaccccacaaacaccctgggggctgtcctggagcgcgacacactgggcattcgggaggggcgggtgttcaatgcccttggccgctggtccgaggcccagtgtcaacggcagcagctgcaggtgacccccaaaaacaggcggaagggtttgggcaaggccctgggcctcattcgcttcccgctcatgaccattgaggagtt

SEQ ID NO: 606221 - DNA, 819 bp, Homo sapiens
  misc_feature (119)..(119): n is a, c, g, or t
ttttacgtcggcttcggagcgttgggcgggtggtaggaacaatggcgctgtcttaagtggcacagtggagcagctctgaagatgcaaagatacacgaaaaaacttccagaacatcttgngagaatattaatgaaaatcgttggttaaacctgacacttttaacagtgaacagcgttctgagtgtggacgagtagccagtgaagataatgaatgtcgaatgtgactgactagcagttcatttggactgagggtcgctgtctgcccatgggatagaggccagatgtgtctgtgggagttccaaagttgcaacgatttctggctagtgccagaggtttacttgactgtttgtgtgaaaagtgataagaaaacatccagaaaaaaaggctcttcgctttttaacccaaaccatggaacaattaacacccatgggttaattcttggctcaaccccaaacaccacacccaacaccacaacacccaccaccccgacaccccaccacaccacaagaacgccccacataactcacaccacaccaacaaaagcgctgggcgccgcccccccaccacaaattaaacacaccgggggggccccgccccaaaagacaatacgtctagcctgcctccaggaccaccgcagcaacatcgtcggttcccccacaaaacaccggcgcggcacgtgtcgccaacctacggccggcggatctgtacacaccccccccgatacccccccggtgtatcaacaacacaacagagcaagagcgaggcacacgcgcggccgccacagcaccgacccgacccagccacagcacccggagaacac

SEQ ID NO: 606222 - DNA, 283 bp, Homo sapiens
ggggtttttaaaaaaaaaaacccccccccccccaaaaattgttttttttgttgggccaccccaacccgtttcccaaaaaaggccgggggttaaaaaaagttttaaaaatcgggggggttttaaccccccccccccccccaaaggggaggggggttggggtttggttttcccttgggggcccgttttggaacccccgccttttgggccaacgggggccaaaattttaaaaaccctttgcgggtttttaacccccccttttgtttccttttgtttttttttggga

SEQ ID NO: 606223 - DNA, 583 bp, Homo sapiens
agtctacctctgtcaccaaagatggaaaacagctgtgcgatcacagatcaaagcaaccttgacctactgagctcaggtgagcctcccacttcagcctccaaggtagctgggactataggcatgtaccaccacaccagactaatcttttgtagagacaggaattggccatgttgaccaggatgggctcgaactcctggactaccatgatctgtttgcctcggccttccaaagggttgggattccaggcttgagccaccacgcccgtgcagaatccgggttttagacaatacatcagaactaatgggaataacactggtacgccaggtgttgcgaccaagcaggatccttcacttggtgctatgaagagagagaggtgagccataggagtctgggcggcatgacgaactccaacacgtctgcctgatagcacgctccagcagctcattgactcattcagcacattagcagtgtgtgatgcgcttatcactatgctgagagtacggaacacagaaatcaaactgacgtgcttcctgcgcttgtgaggctgacagcccaagcttgattgaaaatcatgcaacacgcg

SEQ ID NO: 606224 - DNA, 334 bp, Homo sapiens
  misc_feature (154)..(154): n is a, c, g, or t
  misc_feature (169)..(169): n is a, c, g, or t
  misc_feature (173)..(173): n is a, c, g, or t
  misc_feature (309)..(309): n is a, c, g, or t
aacggcccgcgccctgtaaattgggggcccccaagaatgccaaagtgacaagaccatgggggaggagatgactctcaacaccttcttcagtgagacgggcgctggcaagcacgtggccccccgggctgtgttgtagactggaacccacagtcantttgactgacagttntccnggcactggcacctaccgccagtcttccaccctgagcagctcatcacaggcaaggaagatgctgccaataactatgcccgagggcactacaccattggcaaggagatcattgaccttgtgtggaccgaattcgcaangctcgggggctggaaccaagtgcac

SEQ ID NO: 606225 - DNA, 132 bp, Homo sapiens
tcctagatagtgtgatacctaaagcctgaaaaaggaggtcttctcgcggcccgagaccagcgttctgggctgcacagtgacttcacatggtggcaatggcacctagcacgggcagcagctcgcccctgagtt

SEQ ID NO: 606226 - DNA, 138 bp, Homo sapiens
ggacttagctcggtcaggaagactgcgcctatttggcatgctgtactccagaatataatcaaagaattttctgtacatatttcactaaagacaagtttttgggctggagtgtggtagcttacacctgtaatcccagca

SEQ ID NO: 606227 - DNA, 584 bp, Homo sapiens
tgcgactgaacgatgatcgactagctgtatcacggaccattggagagacaaggccggggtgacgtatgcatctgtgtctttggtgatatagggcagggggtcagtcagtctgatgtattgcttcttttggagaagaaaggcagccatactggtcgacgcagcactggaagaagagggtggtgatgtggtcagtatactgtgtcgctaagaaatgtatgtactgtgaatatagggcagtaggcaggatgacttagagaactaaggttgtgggtggtctgttcattgtgtctataaaagaagaggctgcaggatgagttgagaatcatgtccattggagaagtaaggctgcacagtggtctgtgtatcgcatcctttggagaaggagccctactgtcagagcaggatgcttctgttgggggcagggctcacagtgcagccctattgcagccagagggtaggagctgtagggaggggtagcagctccctggtcctcatggtcaggctatttctctgaccatcatcttctttgctgtcagagtgttacagaggctgcagggctgtcttggagccttctccctcaccaa

SEQ ID NO: 606228 - DNA, 431 bp, Homo sapiens
gggagccaagacgcaaggtggttgatccattatctaagaaagatagatatgatgtgaaaccacatgctatgtacaatcataagaaatattggaaagcacgctcgtaagcagagaccaaggaaccaaaattgcatctgatggtctcaagggtcgtgtgtttgaagtgagtcttgctgatttgcagaatgatgaagttgcatttagaaaattcaagctgattactgaagatgttcagagtaaaaactgcctgactaacttccatggcatggatcttacccgtgacaaaatgtgttccatggtcaaaaaatggcagacaatgattgaagctcacgttgatgtcaagactaccgatggttacttgctacgtctgtactgtgttggttttactaaaaaacgcaacaatcagatacggaagacctcttatgctcagc

SEQ ID NO: 606229 - DNA, 257 bp, Homo sapiens
  misc_feature (214)..(214): n is a, c, g, or t
atttttaatttgtgtcataagaatgttttcctctacagtatttgtcataccagtttataacccacagaaatgcagagattttatttctattggaaacattactacagctatgttttacttttgaacagaatttttacttgtatagggtgcttactaatgttaaatagtttggagtatataacatttacattaaggactcatggtaggttaaaancctaaagggtaaggggtttaaaggaaataaatattcaaactga

SEQ ID NO: 606230 - DNA, 118 bp, Homo sapiens
acacaatggggctcactcacccaccacatccacaacactacaccctcattcacacgagagtaccaccctcatgttcatacacctatccgccattctcctcctatccctcaacccccac

SEQ ID NO: 606231 - DNA, 322 bp, Homo sapiens
tgtccatccccctttgttgactctcttttcagcctctgacctttgtaacaatctaatttccttcaaaagatcattgtttgggcctgtggccacctaaccttctgatgctctttccccacccttggaggaggaggaaaggaaaaaaatgggccctgagcgatcaccacataccacgccctgggggtctagtggcgaaggaggcaagtaaggtctcttgctttcatggagcttttagtcaaagcgagacgcactaaacagttaagggacaaataggattactggaggtagccctaacttctgggacagaaacaagatggtaaga

SEQ ID NO: 606232 - DNA, 140 bp, Homo sapiens
ccactgtgtctccagtggtcttgcccccccccccactgaggggaggggcttgccagcattcctctcactggcttcatttctgttctctctagtttgagtcccccaactggcaacttctagatgtctgctggctgggaaac

SEQ ID NO: 606233 - DNA, 1492 bp, Homo sapiens
cgcccttttttctctatattatgcgggggcaaatacacttaatgacagaccgtgggcatcagacacgtgggggaagaaccgtgcggggggggccagggccccaaacacagagcagggcacccccaccccctcagcatacgacagacactcagtcctccaaagacaccacgagacacgagaggcacaatttctgtcaacctccacaattgacacgttgtatttttttctccagtgtggctactttttattgtggtgtggtgtggtagtggttatttcttctcaacacaaaacaaacacaaacacaaaagacaagagcggcacacacacacagaggtcccacaacaggccggagagacaccacacacacacgctatacacacgagcggagacgagagcgggaggcgagatgtggcccacagagcgaagcgagataccacccaaggaagggagaacacgacagccacgcgacgcgagacacacctcaggggggaacgcaggggggtcaacggaagaaagagaaaaacacagcgggggcccaccccgtctgtgaggatccccctgaagaaaacatatgcggcgagagcgagtagcagacacatagagaaacacgacgtgtgcaggtacacacacacacacgcgcgggagaagaggtgcgcgaccaccgcacacaagcccccagcgtcagcaacatcacaacgacaggagtagaaaaagagagaggacgcccccacaagtggagtggcagacgagtgaatggaggcaagacgaagagcaccagacagaaaggcgtagccatctggagaagcaggacagaagaccaacacgcaaaaacaactacatagagaggcgcgaaccactaacagcacacctaggggcgaggccacacacacacagacgcaacaaaacagggagagcacacaaagggggaacacaccccacagagggatgcggacccaccactcatgtgtacacgcggtgggaaaacaaaaccaacacagataacacctaccggagaacaacgaaacagcacacaggacgagcacacaaccaacacgaccaacaacaaaaccaacgacacagaggtggcgacacaacacaaccaccccaaagacgggaccacaaaacaacggaggcgaacacaaacgcaaaccatgaaaacacaagggggcaagacaacacacagacaagacacacgacacaacgatagctcaaacgccacgtggagcgaacccaacacataccagacaagaaaggatgagagaatcaactcgccaccccaaagcaacagacccagacaataggaaaccgaacaacaggaccagaagaaagactatacgtccatcgaaggacaactaacaaactacgatgtggccatgactgacaacccgcagcagcactacaacggcggcaccacacacaacccccacgtataataaacgacaccaacagacagaggagcctcacaaagaaagatataaacgccgcccggaag

SEQ ID NO: 606234 - DNA, 1144 bp, Homo sapiens
  misc_feature (6)..(6): n is a, c, g, or t
  misc_feature (8)..(9): n is a, c, g, or t
  misc_feature (11)..(11): n is a, c, g, or t
  misc_feature (14)..(16): n is a, c, g, or t
  misc_feature (18)..(18): n is a, c, g, or t
  misc_feature (28)..(28): n is a, c, g, or t
  misc_feature (64)..(64): n is a, c, g, or t
  misc_feature (287)..(287): n is a, c, g, or t
  misc_feature (818)..(818): n is a, c, g, or t
tctagncnntnccnnnantcatcgtgcncctccagcccgcttgaacgctccccgcagccaccgncacccattggaatggccaacaggggacctgcatatgcctgagccgggaggtgcagcagaagattgagaaacaatatgatgcagatctggagcagatcctgatccagtggatcaccacccagtgccgaaaggatgtgggccggccccagcctggacgcgagaacttccagaactggctcatggatggcacggtgctatgtgagctcattaatgcactgtacccncgtagggtgcaggccccgaagtaaaagacagatccaggcctccaccatggccttcaagcagaatggagcagatctctcagtttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatatttagccagtgacatacccagagagccccagaggtctcgagctccattctgtcagggtggggggttcgagcctgntctgtcacctctgaggtgccgtgcgtggcagtccatcctcaccccatgcttagtaatacgattgccgcttccccagttagccatcaaaaggtggaccaactggactcttcctatatacacactgggacagaaaattagggggcctacagtcacctcaccgcacatgcccctggcctattactgtctctccattcttaccacctggactgttcagtctctgagctctgtgtcctccgttcattccaagagtgggagtcactgatgctggcatctgacttctgatgctggatggccttgttctacaagtatgctttctaccacaagat

SEQ ID NO: 606235 - DNA, 348 bp, Homo sapiens
gacaacttgtcaaattttgtatattgaactggttaatctgtgagtggattgtattgccttagaaattaatggcatttggctgagcatggtggctcatgcctgtaatcccagcactttgggaggccgaggcaggtggatcacctgaggttgggagttcaaaaccagcctgaccaacatggagaaaccctgtctctattaaaaatacaaaaaattactcacgcttgtaatcccagctgctcgggaggctaatgcaggagaatcacttgaactcggaaggcagaggttgtggtgagcggacatcggccattgcactccagtctgggcaacaagagtgaaactctgtctcaa

SEQ ID NO: 606236 - DNA, 996 bp, Homo sapiens
cacgcgtgcagcacttctccgccgcagacgccgccgcgatgcgctacgctcgcctcctacctgctggctgccctagcgggtgcaactcctccctccagcgccaatggacatcaagcaatgatcttgtgacatgctgtgcggctactcgcaggctggacgatctgaccggctcatacaacggttatcatctgacgctgaactggaacaaaacagttgaacgacgtcacttgctccaggtgtatttggcataggtcttggccatgtagtatcctagcttggctggtggcttgtacgcctgtgtttctgtcttgctcccagtccctctggcatgtccctctgtctgtctgggtctcttgtcgctcttgctgtcatgcacgcaggatcgaacgaatactgactgcagaatgcaaggacggatcgtcctgacatgatgtcatgactgactgcacatggcgcatctcggcctttctctgtgactgtcaacaggtgtccttggcgttccgctcgtgtcacgatttacacatgccgcctctctcttaccgctcatgtccattctccgctcattctctttttgtacgtggcgtgtgcggtcggtgctctcctacgtgtcgttgtgtcgccctctgcgcggggtgggccccctatgtggcttttgcgcgagcggttctccctctgggcttctcctgtgtgtgtcctctatttgtgtcggtctgcgcgtgttagtttgtgtgcggggttcggggatgttcgtgttcgtgtccccctgcgtggtctccctgtgcctccccgtgtctcctgcctcgttcctctcacctgctgtcttccctctcgcccctggggggtttactcccccctccgtgcctctcacgcgctttgcgcgtcctacctctttttggggctcctctggtgtggccccgcgctgtcgtgtgtgtttccttgcttgcctctgtgtccgccccgtgctccccccgcggcccccccgccctcccccccgct

SEQ ID NO: 606237 - DNA, 375 bp, Homo sapiens
  misc_feature (6)..(6): n is a, c, g, or t
  misc_feature (8)..(9): n is a, c, g, or t
  misc_feature (11)..(11): n is a, c, g, or t
  misc_feature (14)..(16): n is a, c, g, or t
  misc_feature (18)..(18): n is a, c, g, or t
  misc_feature (28)..(28): n is a, c, g, or t
  misc_feature (64)..(64): n is a, c, g, or t
  misc_feature (287)..(287): n is a, c, g, or t
  misc_feature (325)..(325): n is a, c, g, or t
  misc_feature (338)..(339): n is a, c, g, or t
  misc_feature (357)..(358): n is a, c, g, or t
  misc_feature (360)..(361): n is a, c, g, or t
  misc_feature (363)..(363): n is a, c, g, or t
  misc_feature (366)..(366): n is a, c, g, or t
tctagncnntnccnnnantcatcgtgcncctccagcccgcttgaacgctccccgcagccaccgncacccattggaatggccaacaggggacctgcatatgcctgagccgggaggtgcagcagaagattgagaaacaatatgatgcagatctggagcagatcctgatccagtggatcaccacccagtgccgaaaggatgtgggccggccccagcctggacgcgagaacttccagaactggctcatggatggcacggtgctatgtgagctcattaatgcactgtacccncgtagggtgcaggccccgaagtaaagaggagccagggntcgaccaggggcnncaagcagagggggcaganngnngnggncctggaagg

SEQ ID NO: 606238 - DNA, 1007 bp, Homo sapiens
  misc_feature (6)..(6): n is a, c, g, or t
  misc_feature (8)..(9): n is a, c, g, or t
  misc_feature (11)..(11): n is a, c, g, or t
  misc_feature (14)..(16): n is a, c, g, or t
  misc_feature (18)..(18): n is a, c, g, or t
  misc_feature (28)..(28): n is a, c, g, or t
  misc_feature (64)..(64): n is a, c, g, or t
  misc_feature (287)..(287): n is a, c, g, or t
  misc_feature (818)..(818): n is a, c, g, or t
tctagncnntnccnnnantcatcgtgcncctccagcccgcttgaacgctccccgcagccaccgncacccattggaatggccaacaggggacctgcatatgcctgagccgggaggtgcagcagaagattgagaaacaatatgatgcagatctggagcagatcctgatccagtggatcaccacccagtgccgaaaggatgtgggccggccccagcctggacgcgagaacttccagaactggctcatggatggcacggtgctatgtgagctcattaatgcactgtacccncgtagggtgcaggccccgaagtaaaagacagatccaggcctccaccatggccttcaagcagaatggagcagatctctcagtttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatatttagccagtgacatacccagagagccccagaggtctcgagctccattctgtcagggtggggggttcgagcctgntctgtcacctctgaggtgcctggtggtatgctgctcctctgtgcttagtatagtttccgttcccgagagccatcatatctggaccagtctggctcttcctttcgcctgggaccggaattcaggggcctcagtccctcagcggcatgtccctgggtattctgtctctccttcttccctctggctgttcgg

SEQ ID NO: 606239 - DNA, 625 bp, Homo sapiens
gaggccctagcagcttcgggacaatgataagactcgcctatatgcgggcaagggtgtctcaaaggctgctcgagcacactcaactaaacactacttgcgccctgcccctggcttagcatagaaactgcaacgctcacacgaacaacgcagcaagcacttgacaacactgcactgactcgacgactggatggaacagcaaaataacatctaagttatggtagcgaacgccattctggcggcgtgtcccattgccgtctgcaaagctggtgccgcttgacgaagggggtccccctgtaccgccacatcgctgacttggctggcaactctgcaagtcatcctgccagtcccggcgcttcaatgctcatcaactggcggttctcactgctggcaacaagctggccactgcaggagcttcatgatcctcccagtcggtgcagcaaacttcagggaagccatgcgcactcggagcagaggtttaccacaacctgacacgaatgtcatccaacggacgaaactactgggacaagatgcccaccaattgtgggggatgaaggcgggtttgctcccaacatcctggcagaattaagaaggcctggagctgctgaagactgcttatgggaaagcg

SEQ ID NO: 606240 - DNA, 1080 bp, Homo sapiens
  misc_feature (891)..(891): n is a, c, g, or t
gcttgcttgtgactctgtgcgctcttctgctagcgcactgattgtaacactgcaccgcgactgcacctggcacgtattgctagatgtgctgccaggggatctgacatttgtgctgaagctgggaatgtgcctcccattcatggtaccattactagatgagtgcatcgcatcactccttcgatcgagtgtcctgcatcccattcgcagtcaccagacgcgagatgctcaaagcggattttgaggcgcacctcgggtcttgcagcgcagataactctccagaaaccttggttcagacgaatgagcagcggatgacgtgagtagtgacgtcgtctagttccattgctgcgtggtatgcctcgatgtgcgcgcaggtccccgaggtagaagacagatccaggcctccaccatggccttcaagcagaatggagcagatctctcagtttcctgcaagcagctgagcgctatggcattaacaccactgacatcttccaaactgtggacctctgggaaggaaagaacatggcctgtgtgcagcggacgctgatgaatctgggtgggctggcagtagcccgagatgatgggctcttctctggggatcccaactggttccctaagaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatatttagccagtgacatacccagagagccccagaggtctcgagctccattctgtcagggtggggggttcgagcctgntctgtcacctctgaggtgcctggtggtatgctgctcctctgtgcttagtatagtttccgttcccgagagccatcatatctggaccagtctggctcttcctttcgcctgggaccggaattcaggggcctcagtccctcagcggcatgtccctgggtattctgtctctccttcttccctctggctgttcgg

SEQ ID NO: 606241 - DNA, 1212 bp, Homo sapiens
  misc_feature (6)..(6): n is a, c, g, or t
  misc_feature (8)..(9): n is a, c, g, or t
  misc_feature (11)..(11): n is a, c, g, or t
  misc_feature (14)..(16): n is a, c, g, or t
  misc_feature (18)..(18): n is a, c, g, or t
  misc_feature (28)..(28): n is a, c, g, or t
  misc_feature (64)..(64): n is a, c, g, or t
  misc_feature (287)..(287): n is a, c, g, or t
  misc_feature (886)..(886): n is a, c, g, or t
tctagncnntnccnnnantcatcgtgcncctccagcccgcttgaacgctccccgcagccaccgncacccattggaatggccaacaggggacctgcatatgcctgagccgggaggtgcagcagaagattgagaaacaatatgatgcagatctggagcagatcctgatccagtggatcaccacccagtgccgaaaggatgtgggccggccccagcctggacgcgagaacttccagaactggctcatggatggcacggtgctatgtgagctcattaatgcactgtacccncgtagggtgcaggccccgaagtaaaagacagatccaggcctccaccatggccttcaagcagaatggagcagatctctcagtttcctgcaagcagctgagcgctatggcatttaccaacccacttgaccattcttcccaaaacttgtggaaccctcataggcacagggaacaaagaaaccattgtccctgtgtgcacgccgggaccgctcacatagactctatggggttggcttggaaggtacgccccggagattgattggggctcctcaactctgtggggaacttccccaatctttggtttcccctctaaagcacacatcacaaaggcagaatcccttacgagaaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatatttagccagtgacatacccagagagccccagaggtctcgagctccattctgtcagggtggggggttcgagcctgntctgtcacctctgaggtgccgtgcgtggcagtccatcctcaccccatgcttagtaatacgattgccgcttccccagttagccatcaaaaggtggaccaactggactcttcctatatacacactgggacagaaaattagggggcctacagtcacctcaccgcacatgcccctggcctattactgtctctccattcttaccacctggactgttcagtctctgagctctgtgtcctccgttcattccaagagtgggagtcactgatgctggcatctgacttctgatgctggatggccttgttctacaagtatgctttctaccacaagat

SEQ ID NO: 606242 - DNA, 377 bp, Homo sapiens
agttgtgcctgcaatgggactgtgtcgacgctgtagcttgtctgagaggacactgcctggcgggagctgggtgtgtagaagctgctgcaacgttgggagcttggcttggggggtccacagtgaggtagaacctgggcgtacagaatctgctgtgacgagccaccgttgggacctgtacacgtgctgccgggaggcagagtgctgggcctggaggggccaccaagatgcatgagctgggcctggagaggcttgcaaagaaacatgaccttgggcctggtgaggtcaacttgagaaagttcagggcctggagagaatgctgggaggcaggagctgtgtctaaagaggccattgtaacgatggagctgtacctcacccat

SEQ ID NO: 606243 - DNA, 119 bp, Homo sapiens
aggtgtagcactgaatatgtgctatgtctggaataattttcctttacaccctaagtgggaataaaaaatggcttcatcagttatgctgataattgtactccacattaaactgctgtcca

SEQ ID NO: 606244 - DNA, 682 bp, Homo sapiens
caaaaagattgtggaggaactgataaaaccaaccaatgcccccaggcttttttttcctgtgtcaaaaggcggccccagggggtggattttctcaagggccccaggaaagagaaccggtcaccccttcaattagagagaacaagcttgagaaggggatggacaaagtgcagctcattactatttctgttttggaatgtagaggacaggccccagtgtacggtcatagtgggatcaagcctcgcctatggagtgctctgggttatgaccggaaaggagccggttcatgacatcaagggcgggaaagtgggtctgaaaactgaatacttgcaggaggcgcaacaggccgctgccaagaaatataacaaccatgtcaggcagcaactggctcaagtaaaaacgtaggacttaagtaacatggtgtttggggccacaacctacctgagcctaaagcatgggcagtgtaagtcccagaaaagctgtgggggcaggatcaaacataaagggtgcaagttgtaggtccccagtggcccagccatttttttggctaggtgtctgaacgcctgggcttcccccagaaaccacatctcccagagttccaagggaggggtctttccacgtccccaaaggaaccaagccttgttcctagcgttcaataccccgtcaataaatgttttctttgtca

SEQ ID NO: 606245 - DNA, 372 bp, Homo sapiens
gagaaattgggccggttcttttttgatagctggttgaacccccccccgcccaccccttggggggtcgactctaagcccccctttctccccacgggcctgggctttccacccggcctgacttcaaggcatctgtggagctgtcctgtttcaccaaaaaacgggagcgttaggcccggctttccccccctgacaagcccaggggttaagggttcatagggggtttgggggctccccccccttcctctcccccctcccccaaaaggggttttaggggcctgggctgggggaatggggagggcaccatcgtgctgtgtttttcaaaacttatgtttttatatgggtgcatttaccccaataaatcctcagctggga

SEQ ID NO: 606246 - DNA, 199 bp, Homo sapiens
tctctacaggttatacctagtgtccaaagagctgtcctctttggactaacagttaaagtttccaaggagattaagagggtctagtggagcaattataaagttagaactaaagatactatcttaagacaaccacgctatcaccaggctcagtaggataagtggcctctacctaatcaatcttcccacatatattgctaca

SEQ ID NO: 606247 - DNA, 1366 bp, Homo sapiens
caacttaatacacatctttgactagaatcaagcacattgaataagaatttttgtttgtttgtatttatgttttttttttttaaagaatatcatccgggagcccttcattcctcttacaggtagatccattcgtggtttagggttacatcttcaactcaaggaggcgtggtgctagtgcatggggtgtctttagaaataaagaaagttcgacgtgggaaataattttccttagaaaaggcaaaccgtggtattttttgtgatagaagttgtgggacaggcattagctcaatttttttgtgagtgggagaagaagggtaaaaactcgtggacaatttataattctatcattctaattataacttatagttcatactctctctgtgaagaaacagaagctcatgtggactcgtggatgctatacggccgtggaagatcacagcgtggcaccacactcttcagagcctcacgtgggcaaacccatctgtggccttccacagaggtctacaacggcgaaatttatgggtggtcatacagaccatttcgtggagtcatagccgtgtggatttacgaggtcattggcacacaaccaagtggccaggggcatacaaattctatggcgtatattctctatacgataaaaaatagcgggggatctctgggccatgtgtgttgctgccacggattgaggctgtggaaacctctcgtgggtcttcacagagcaatgtcacacccgtggccttgtgcccttcccaagagttgtctgcgggactatcaccacggggtgataccattgtggttcgcttgtgcgagtcattgtggccaccatctatataatacacagctaattctacacatatgggactcctccctatggcatccttaaagctcttaaaattccccttggcccctttcctagggaccaattttgggggccggggcatatccagggaaacctcctcctggacaaccccatcacttagaagaggagcagatttacccagcagtgaaacggacacacactgtggggcaaatggggggccaatcactcacaatacatggtggccgccataaaaacaccccgatcttttacgtcgacacaaccacgctggtgcgccgacattttagccccacatttctaacagcgactacaactcgctagaagctcgcacaggcacgagagagacgacacaaacaactaactactcccccagaaccacaaactcgtctctaccccacacggagtgattgcacccacaccaaaccaaagaaacctggagcgacgggaggatcaaatcaacataatagtgacaaccacgcactaatgtgcataacccagtacgagagggggcacataataggacgaccc

SEQ ID NO: 606248 - DNA, 169 bp, Homo sapiens
aagatcaagagcatggcggccgcgagccaagctgaattgaattcccgatcgccgtgcacgcagttcttcggatgatacgaggagtcctggatcaaggagaagaagctgctggtgggctcagaggactacggccgggacctaactggcgtgcagacctgagcaagccagg

SEQ ID NO: 606249 - DNA, 170 bp, Homo sapiens
gcaccgtcataaggtgtagtagcaggagcctctatctttgttctctggcatggaaggggtcctcagagttactggggcccagactgatcttgcttcccttggcctttatcccctggctttcctagacactgccttgtgctggtggatatttattagcctgactcaaacaa

SEQ ID NO: 606250 - DNA, 121 bp, Homo sapiens
agcgggtttggaggcatgtttggtgtcagatggaatgagttgatcagtctgctgtaggttatgaataccaggggaagactgagaagcatgcctcccagaaaatgactactccagtaggtta

SEQ ID NO: 606251 - DNA, 378 bp, Homo sapiens
ctttggggtctttgctaagttttatcagcaaaaaagaagagaagagttgaggcgacattttagagattttggagacagcctgaccagaggaggaaagggctttctgcgaggagttgttggaggagtgactggaataataacaaaacctgtggaaggtgccaaaaaggaaggagctgctggattctttaaaggaattggaaaagggcttgtggttgctgtgacccgtacaactgggggaatcgtagatatggccagtagtaccttccaaggcattcagagggcagcagaatcaactgaggaagtatctagcctacgtccccctcgcctgatccatgaagatggcatcattcggccttatgacagacagtaatctgaggg

SEQ ID NO: 606252 - DNA, 575 bp, Homo sapiens
ttttttcccccttagaatacctaccatactgcatttcagcttggagtgcgcagcatgaggcatttgtggttcagaaaagaggtcttcctttttcctcctcctgttttcttttccttccttctccccaactccccaaaggcttactgcctttcttctcaggccacgtgtgtagataacctttgaggaaaagatggtttccgtgctgggatatttggatattacctaaagggacaagatgagccctttctttgccttgttttctttttctggcctcatcagagttaattatatgtgagtgtgtggcagtttattgaaccatccatcccgtgtcgtgagctgataagcccctttttgttggcttccatcaaggttgtttgtttcagaagttcctaatgcagtaggagaacaaagtggcaggtttcttatccctcgaagtctctaaagcagattcataatggtgttccattggtgctttattagaactgtcattcgctgtcaacttaggttattagcattgttccatagtgccagggattgataagttagagcttcctcagaagcaccagtgagctcag

SEQ ID NO: 606253 - DNA, 126 bp, Homo sapiens
  misc_feature (27)..(27): n is a, c, g, or t
  misc_feature (86)..(86): n is a, c, g, or t
  misc_feature (96)..(96): n is a, c, g, or t
gggcgcgccgcagctcctcaacgccgnaacggccggcccaactgcaggaagggttataaaattatacaccatggccctcctaaagncactctaggnaaaccatgtcatcctgatcttaaaacacct

SEQ ID NO: 606254 - DNA, 141 bp, Homo sapiens
atctgcaggacactcagtgtgtaagtgtctgtactttgtacaatagcatacaactagttggacagttggactacatacatgggctggaatcttatttgtcctgatatattttctagattgaccaatagagtgattttgcat

SEQ ID NO: 606255 - DNA, 84 bp, Homo sapiens
gagagagatgaagggtcttactactgtgcctgtgacaccgttttactgggggccggtggctcctgggacacccgacagatgttt

SEQ ID NO: 606256 - DNA, 583 bp, Homo sapiens
  misc_feature (6)..(6): n is a, c, g, or t
  misc_feature (67)..(67): n is a, c, g, or t
  misc_feature (338)..(338): n is a, c, g, or t
aacctnccctggggtcccctcctttgaatggcccaaaagatcaagttagggggccttcctctgggcntgccttatcccctcaataagcaccctgctccccggatgtgacagacagcttcagttttgtcaccctgtggtccagcagctttctgagggagggctgggaccagctctcatttacctgtgtctctcacccctgcaaggttctggccacagcaagcaatgcctaagcacatatttgtggagtaaaggtataaaagacaaggcatcccagatgggcgtggtggctcaatcctagcacttggagagtctgagacgggaggatcacttgagggcanagtttcagaccagcctgggcaacccagtgagaccccatctctacaaaaaaaacatatttttgtttgtttgtttgtttgtttgttgttttttaattagccaggcgtattggtgtgcacctgtaatctcagctacttgagaggctgaggtgggaggatctgttaagcccaggaagttgaggctgcagtgagttatcatcccaccactgcacttcagcctgggcaatggagcaacaccctgtctcaaa

SEQ ID NO: 606257 - DNA, 499 bp, Homo sapiens
cccccactgcacaaataagtgtaatccacttaaaagatactgtcttaatgtctaggtatttttatatcttttgtttttgcaggtgttacagacagaagaaaacatgttaaaatggaccttatattttatttctaggtcatgtttatttctagaaagttagttgggtatgaaccaatggccaggtgggcatgaaccaatgagccacgttcaagacatgataggggaaaatctcttgcctgtgaccactactatacaactacatttcccctgctagatccaacctgctcatcactacacttataaatatcatttcagttttctctttggactgagcaataataaatctttgtttcatcttagcagctgaccatatttcatgcaaactttgaatttaggttctctttagccccaacagcaacgtgttgtttgtcttatctttttcaaatatcttattatttttcatcacatttattctcttggttaaaactgaaaacattct

SEQ ID NO: 606258 - DNA, 432 bp, Homo sapiens
acaaggtcatcatttaataaggctgaattcattttcaccacacgggattgtacacgggcatttggtgaaacaaatttcttttttaacagatcttagtttaaaaaagtcatagggcccgggggttctgtataaaccgggggacagtaagttagttcctttggtttaacttataagcctcaacttcaccgcaaaataaagaatgggggccaaagaaagcataatcgggcactcgtataaaacaggattggttctataatttgaagctttctgaatggacgggttcaggcctgatgcaactggaaaaagattacttaatggatagactttttggaaattggataaaagggtattaccttttatcggtgggagcttaaacagccctatatcactaattggttttcaaaatcaaaaacctgtttttgaatccccaag

SEQ ID NO: 606259 - DNA, 155 bp, Homo sapiens
  misc_feature (47)..(47): n is a, c, g, or t
gatctacaggattctctttcaaggctgaagaaaaaagagcacgtganttccaatccatctccccactccaccccttccaaaattcaagcaattctcctgtgttggcttcctgagtagctgggactacaggcatgtgccaccacgcctgaccaaag

SEQ ID NO: 606260 - DNA, 942 bp, Homo sapiens
  misc_feature (325)..(325): n is a, c, g, or t
  misc_feature (383)..(383): n is a, c, g, or t
  misc_feature (661)..(663): n is a, c, g, or t
  misc_feature (822)..(822): n is a, c, g, or t
  misc_feature (847)..(847): n is a, c, g, or t
ggaagatgtctcagagccttccatgacctcccctccccagcgccaaatgccaagtgagacttggagctgcacaaagtacagtatggaccactaaatctccaagacctggtgtgtgcggaaggccggagtcctgctatgctgctgcaggtgttctgacacgcaagctgtgtgtagctggtgtagctgctgcagagatgggtgcggcgtgcgctgtgctctgtccggtgtctctgtgcgtcctgtgctgctgggtggggatgatgtgcatggtgatgaggcagctgtctttccccctcgaagatgttccctcgaagacatcgcatangctgaggatggcgtgaaggcgctccctcgagggcaagatcaagatacctttaagtgcntcttcatttagcaagtcgagagtctccggtcgctttcaccccaaatcctcctcgcatgtgggagcgaacgacgcaccaattccctaggcgcttacccgtcagggggtagcaccgtgttgagaccgcgtaagagagtggatctggtgcgtgagagtgatagaggagactgggcgactgacgagtgtactagcaaggcgctagctagtggtgcataaaagtcgggtcggacgcgacaagtgcgtcgttgatcgaagactaccacgagcaatagtttgttnnntcccccaaatccttctgttgtcttgggcgtgcctcacccagcaagtaaaggcgtgagtcaagcacagggtgggtacgacccgtgatgacgagatgatctgccctacgagtgggactcattgccctctaagaatgcgtcacctcgctcgactgttaacantacaatagactcgccgtatgaaagncgaagaaaaagaacgggttccccatgtggggcttgctcaaaagcatgtgaaggacaccacgccttcggagttgacttgggcgacgcggaacagac

SEQ ID NO: 606261 - DNA, 500 bp, Homo sapiens
  misc_feature (22)..(22): n is a, c, g, or t
  misc_feature (88)..(88): n is a, c, g, or t
  misc_feature (132)..(133): n is a, c, g, or t
  misc_feature (136)..(136): n is a, c, g, or t
  misc_feature (332)..(332): n is a, c, g, or t
  misc_feature (370)..(370): n is a, c, g, or t
  misc_feature (404)..(404): n is a, c, g, or t
  misc_feature (458)..(458): n is a, c, g, or t
agtatgctgtcctctatggaanactgagagccccaggagaggtctttaaatcccttcctcagaattatattcatcccagaaatatagncttggaaaaataatttggttacaagcatagatcccaggaatagnngtnccccaagttgctaagttttacataggggagactgggaaattcaaagaattggatggagaaaccataggatccaagataatgtcagggggttgaagatgttgggagaggcatggtagctcattgcagttgtgtattttccttctcacttggagtggaagttgtagggatatctgcctctaggaaatgtgccaatccnttttgaaaaaatgtggacacaggaagaggaggtggtangtaggagatggccagctctccgccagctgatcanaccaagagagaagatgatgaggcccaggaccagagtcatagcagacacagaaancttcagggtgctggcattgggggacaagccaaggtgtccaag

SEQ ID NO: 606262 - DNA, 447 bp, Homo sapiens
  misc_feature (94)..(96): n is a, c, g, or t
  misc_feature (98)..(99): n is a, c, g, or t
cgtgcgtctggttatggatgtgttaataatggttttctccgccgccgcgttttgaatagagttggtgttagaatacgaaaaatccatgtttacnnnanngagaataagattagttgcctaatccggagatatttgagaacaggtaagtagtattccgggggggcggttgaaaccgagtgagccagaccatacgctagacgagatggaacctaattagcccaaagatcacacgctgtgttgagagaaagtgcagccggagcgtcagcgtgtgtcgctgagaaatgttattctagttgaggatgatctagattttgttcctcatgggcagaaagctacgtatcttgtgtattgtccggctggagacgggacgatactactgcactatacgctttagccgaatgataaataaaatgttcagccaccttacgtacctgaacagaagctggg

SEQ ID NO: 606263 - DNA, 351 bp, Homo sapiens
  misc_feature (94)..(96): n is a, c, g, or t
  misc_feature (98)..(99): n is a, c, g, or t
  misc_feature (297)..(297): n is a, c, g, or t
cgtgcgtctggttatggatgtgttaataatggttttctccgccgccgcgttttgaatagagttggtgttagaatacgaaaaatccatgtttacnnnanngagaataagattagttgcctaatccggagatatttgagaacaggtaagtagtattccgggggggcggttgaaaccgagtgagccagaccatacgctagacgagatggaacctaattagcccaaagatcacacatagtcatagaattagaccagcggtttctgtacccccgattatagcgcatcgttactgcctgactnggcttaaaccctgtaccttcatcaaaagtggtcatcacgtacccggggtttacc

SEQ ID NO: 606264 - DNA, 303 bp, Homo sapiens
ttagatgatcccgcagctcgtgtcgtggcaaagatgcaaagaaaagggaattcatacactgttggtgggaatgtaagttagtacagccattatagaaaatagtatagaggttcttcaaaacactaaaattagaaatattggctgggcatggtggctcaggcctataatcccagcactttgggaggccaaggtgggcggatcacgaggtcaagagaaggagaccatcctggccaatatgatgaaaccccgtctgtactaaaaacacaaaaattagccgggcgtggtagcgcgcgtctgtagtcc

SEQ ID NO: 606265 - DNA, 270 bp, Homo sapiens
tgacagaggtcactcagtgatagtttaagttaaatatgtagatcagggatgtacaatcttttggcttccctgagccacattggaagaagaattgtcttgggccgcacataaatatgctaacactgacgatagctgatgagcttaaaaaaaaaaaaaaattgcaagaaaaatctcatgttttacgaaagttttacagattttgtgttgggctgcatttcaaagctgttctgggctgcatttagacccgtgggctagagttggacaagcttg

SEQ ID NO: 606266 - DNA, 437 bp, Homo sapiens
cccaggaccaggagatggaagatggattagcctttaagacttttttggaccaccttgtaccaaagttaattgaagccggagaagtcaaaaatgctgaaatcctcagattgaaggagcagttgcgtgaaatggaaaacctacgcctggaaggtcagcagttattagagaaaaactggttcctgcagggtcagctggatgatattaaaggccaaagggaaaccagggatcagaatcatccagatattcaacagttgaagaatgaccaggaggaaagtttcaaggaaggacttgcaaaaggtaaaatagttgagaaatgctgaaaatgaaagcagacctagaagaagtccaaagtgccctttacaccaaagagatggattgccttagaatgactgatgaagtcgaacgaacccaaactttggagtctaaagcattccagg

SEQ ID NO: 606267 - DNA, 441 bp, Homo sapiens
gctcagccgaacacatgtcccggagatcttgcggcgtgtgggccctatgccatgcatgccaggccccttctcttgctgtgaggaccttcaactccttggctatgggggttctggctttaggtccattggctcgtttaggggcccctcaagatgatggcagttcctgggtgtcacgggtacctttacgggcgtggcactcccctcgctttgggtgcctccgttcgggctgctcgcctggaattctctaattctcgacgtcgcatctcctcctttatcagagtttcgcccaacctttgctgatttgacctggtccctggaatcttctcacatatgtgctgggtcgccacaggcagaggaggtggcaaagtggattggacggctggtgaggtggatagttctgctgcaagggtgctgggtggttgggatcctttggagacatct

SEQ ID NO: 606268 - DNA, 249 bp, Homo sapiens
  misc_feature (30)..(30): n is a, c, g, or t
  misc_feature (125)..(125): n is a, c, g, or t
  misc_feature (128)..(128): n is a, c, g, or t
  misc_feature (173)..(173): n is a, c, g, or t
  misc_feature (185)..(185): n is a, c, g, or t
  misc_feature (208)..(208): n is a, c, g, or t
agccagagacaaagtggtgaggtagaaatnccatccttatctctggaaactctgctctatatcttggccaaaggagacgccaaatcaaagtggctgtttagcagcaccacacagtaagagtttcntcncacgggtcccccgggtaaaaacccctggctggccttcccacactnctgggatatccnctttgggacctctcccattcagnatgggtggcactctgatcatttactaaaaccagtgctaacc

SEQ ID NO: 606269 - DNA, 119 bp, Homo sapiens
ttaagcctcacacgttttaacaagttcacaccgtcggtcacctccggggtctcatggatggtctcgtttgtggctcaaggtggggcttaagggacccttggggcttaagggacccttgg

SEQ ID NO: 606270 - DNA, 111 bp, Homo sapiens
  misc_feature (91)..(91): n is a, c, g, or t
gttccgaggagcatcgccgaagcccgaggccggtcccgtgttagggactgcaggggaaggcagcggcggggcggcgggagccaccgggtcntgggactggggaactgcctc

SEQ ID NO: 606271 - DNA, 170 bp, Homo sapiens
gcgtctgctcttgaggatcccacctcgctttagtgctccgcgttccagtggccaggctggagccacagcaccccattatgcggcaggggcctacccatccttcaggcagcctatgggacgcaggcccattctgtccctcggtcgccgtgtgcccggagtgggtccgtcgt

SEQ ID NO: 606272 - DNA, 225 bp, Homo sapiens
tttggatctggtgcacaatcacaatccagttggtcctgagactttgcgcagatatcatgaatgtcattggagaacctattgatgaaagaggtcccatcaaaaccaaacaattagctcccaattcactgctgcaggctccacgagatacatgcgaaatgcagtgttgagcacggaaattctggctgactggctatcaacggttgtcgactctgctcagctcccata

SEQ ID NO: 606273 - DNA, 308 bp, Homo sapiens
actggtgactctacgtggccatcagcaacaagttcatcggggacctcatgccagtgaccatcatgcgcctcatgatcaacaatacgaaggccttcatccaccacgagctgctggccaacctatactcctcggaagaccatagcaggctcatggagagagtcggctgatcaggcacagcggtgggacgacatgctgtgcatttaccatgcccttcagggaggcgctcaagagtcgtcggtgacggtcatgaccagtaggtgtgtgcacgtccgatatggggatcctgagagtgaacccagcgggcatgc

SEQ ID NO: 606274 - DNA, 261 bp, Homo sapiens
ctgaacatgccagcaggatggctcttgtacatgtatagagggcgtgtccacgttctggggtcagaggggattcatgtgatcagtgacttgaggtcagctgaccctggaagtgctgctcatcctgccaagacctcctgggtcctcctatggccccctcccagaccagtactccgtctcctgctgcagaacaaaccacccaaaacgaagcagctttagacgacagcaactcagcatctctcagacggttccggctcagccctt

SEQ ID NO: 606275 - DNA, 134 bp, Homo sapiens
cccctgcatatgcaaggtccaagaggtgtgtaggcagcgtgacatgtgcaggatatcaagatgaaccaccgaaatagaataagttacctattgcagttgtgccctacgcaggttcttggccttgccatatgcaa

SEQ ID NO: 606276 - DNA, 448 bp, Homo sapiens
  misc_feature (422)..(422): n is a, c, g, or t
  misc_feature (438)..(438): n is a, c, g, or t
atggacttttaggttgattccatgtctttgctattgtgaatagtgctgcaatgaacatatacatgtgtgtctttataacagaacaagttatattcctttgggtatctacccagtaatggggctgctgggtcagaaggtatttgtttttcggtctttgaggaagaaccacaccgttttccacaacggttgaactaatttccactttcaccaacagtgtgtaagcattcctttttctctgcaacctcgccagcatctgttttttgtttgttttttgagacggagttttgcttttgttgccggggctgggagtgcaatggcacgattcttgggctcatcgcagcctctgcctcccgggttcgggtggattctcctgcctcagcctcccaagtagttggggattacagggcatgcaccaccatgcncgggctaatttttgtnatttttaagt

SEQ ID NO: 606277 - DNA, 1371 bp, Homo sapiens
  misc_feature (1)..(1): n is a, c, g, or t
ngtcgcgctgggtgtcgttgatggtatgtctgtggaggaatgtgatctatgtgtctgtggcgtgttgtggtttgcgtcggcttgtggtggcttgtagtcttctcgttgttgcgtggcgttgggtcgtgtgcggttgttgtgtgactgtgtagtgtgtcgttcactaccttttttcaaaccccggtgttgggcccttatggactggaggagatcaacgtggttggcacagaaaggacgtcgttttttactgcctccccctttttttatcgccgtttctcattgttgggcgtgcccttggggtgtgcaaattttggcacccgagggcgtttgagacacgaaagtttgggttagcgctacgtgtctcgtggaaagaaagacgctcgcccagctccaacagaaatagggtccctactgttatatggtgatgatttaacatggggcacggtttttccccctttattaggggattatcttgagagacccatggttattgttgagagtttcttaaatacggggacaggaggtgccccccggtaagtccttccaagacacacagcggttttaagggattgacgaacgaattgtgggtccatttggaaaaagggtggtctaataccaaggaggttcacaaggatggtatcgtcatgagtccatctcatcttcaggcccctccacaaggtgtccctcgtttatgccccccacggggaaccttctcctctctggagagcttggaaggaccccagtactgcccgcctttgggggtgacaaacaaattgggcctaccattgacccttttgggcctgtttccccctctgtctacaacccaatagcccagtgctctgagaccacacccccagtctaaccctgtagcccaacaagttctcgggactacacgtgccacgtacccaccatcacagggcttttaaggcctaatattccacgacacggtatgtcgggcggaaacagctcttgactgtccctcaagggtgtctgtaaccgcgccacgccccagagatgccgcagataaaaaaagaaatgaaaacacatcaccctttctgtttggcaagaagttgggccccacgaaaaggagaagccacggagacacaacacgctgcatccacccctggaaacccgagttatgttactaatgggggaagacgttttcatcccgctaattcttgggaataagaggaggaagcggctggcacactgaaggctggaacacttgctactggataatcgtagcttttaatgttgcgccttcttcaggtttttaagggattttcccttttggttcccttttgtacccctttggaaaaataatctgcagaaacgagctgtgcttgccaagacttcatagttcccaagaat

SEQ ID NO: 606278 - DNA, 92 bp, Homo sapiens
gagactggagcgctgcggcgcccgcaacttctcccgttgctgctgctgctctgcggtgggtgtcccagagcaggcggctgcaacgagacagg

SEQ ID NO: 606279 - DNA, 215 bp, Homo sapiens
  misc_feature (28)..(29): n is a, c, g, or t
  misc_feature (40)..(40): n is a, c, g, or t
  misc_feature (64)..(64): n is a, c, g, or t
  misc_feature (169)..(169): n is a, c, g, or t
agatacccccggagctccagccgcgcgnnttccgtgcgcnggccgctctgcccctaaacttctnccgtagctccctttcaagccagcgaatttattccttaaaaccagaaactgaacctcggcacgggaaaggagtccgcggaggagcaaaaccacagcagagcaagangaagaatcagagagcagccttcccggagcaccaactccgtgtcggg

SEQ ID NO: 606280 - DNA, 346 bp, Homo sapiens
  misc_feature (7)..(7): n is a, c, g, or t
  misc_feature (198)..(198): n is a, c, g, or t
  misc_feature (259)..(259): n is a, c, g, or t
  misc_feature (307)..(307): n is a, c, g, or t
agtgtgntggaaaggcaggaggaagctctcccatgctgttttctctggaggaacagaacggaaaaggacagcaatgatttgaaagtctcccaaggcttgaccctggcctgggcctggtttcctcctgggaaagaaggataggcccagtccctgggggattgggataggggtatgaagataagatcgtgcttgaaaatnagtttgcagtgttttcttcccctcagccactcgggggtcttgtccttagtgcagcacaaanatcaggactcaggaaaggatccttttgttttttttttttttttttttntaaactgtatgaagcttgagagttgcatcacacgccgcc

SEQ ID NO: 606281 - DNA, 235 bp, Homo sapiens
gcggtacggcaaactgtggagtcctagacgtgtgtgtgttacaggcaggtgtctgcagcagtggcagaggcgcaggccacgctagcgagggctaggagttaagagtactgtctaaccagtctgccttcttccttcttccagcagccagccctcccctcccattacagttttactcccacatcctaaaagctcctaacttgaccttggtctaaatagtctctcttaagcggctcag

SEQ ID NO: 606282 - DNA, 1138 bp, Homo sapiens
caggttctctctcacgtgccatcaaacgtgtaaaagattaaactgcgaagtcaagctcaacagattattttgggaaagtttcggtatcaagggattaagtaacatcattctggttttccaccaggcagggagtcagggcttagggtttcaaaacacctctgcttactgatgtgcgccttaatattcggctatggccagcaattacacacatggtcttcatggtacattgggaactaacacgtgatgtgatatattcctaaactatgaaacctttttcctaagtagtcaggctagactcattggtacggggaagtataaacgccacccaacggtacagtaacataagcaaacatccgtggactaatcatggtcgtccagcagacaaaatgtgctttggcttgcgtctgggacacaccgcgataccactacggtgacattactaacataagtcagggccggggcgtgggtgggctcaaacctggttaattcccagaacactgggaaggccgaaggacagggggggactggcttggagctcaggggagttctgagacacagttctggggcaacaaaaagttggagactccatctctattatgaaaaccaaaaaaccacgtacaggcacacacacaacattaaatcacgtgggccattgggcacctggtgcttaagacagtaggaaaatttacagggttgttggggtggagtaattccaaaaaggtccaatgtttctcaatggtaccgtctggggggcacgctccggtacacatcctggtgagggggccttcccaagcagcccccaaatgtcacgggaggcacacgaagtatggggccacggaaaacctgtgaactgacactggcaagcagaacaggcggggccaacccggggagtatttggaccccagtagaagagatggggtcccagaataatgaggccctcaagggccccatatggctgaatcaacactggctcccttgacagacggcatggataacattagacttatgcaaccaagcggccaagtactgcgagcagcaacagcaccagctgatacaccctggtcgttcgtgatcgccatccatacgtcagctctctcttttttctttctctgccgtcctcttatgtatgtctgtgcaa

SEQ ID NO: 606283 - DNA, 509 bp, Homo sapiens
tctttccaaacaacacaaaggtattgaaataacattaattctaattaaattccacaagttctttattaaatctccaaattggatattattagtattttatatagtcaatgtttatttttttgatgggacatggtgggggcttaccttttttcttgtgtgtcagatgttccttctaggtagaattctttataccttctgaaattatgtccttagagctgtagatttagaactgacatctcttgagctgttctaagataatatcttttactttggagatacgcagtttttattatatgtctagctatagatttatcatggatttaggttcattatgaatctgcagatttgtgtcttccatcaaatctggattgttttcaatattaaaaaaacttctattttaaaatctgtatatagaaaggtacataaacataaatgaacatgttaatgagtaattgtaacaactatgtaactgtccaagtcaagaaataaaacatatcaagtaaaaaaaa

SEQ ID NO: 606284 - DNA, 971 bp, Homo sapiens
cgttcagtcgcctctcctaattcagtcctcacaacagtgctttatacaaactgggacaagaggtaagaggaagtcaggcagatttccagtcatcagtagagagtagaagggaccaggtagaggatcaggattcgaacggactgcacccaggctctgctatccaggcttgctgtgtgacttgtggtaattttgttcccttagggaactgagcttgctcattggtaaatgcaaacaggctggtgggaggatcagaatgagatccaggggtgaaaacagcttagttcactatcaggaatgtacccacgcggtatataaaggcgagatattattatagtcatggtgatggtagatcgaggaacccatttcctcaattctgcaaattggaaagcctgagggcccaaagagggacaggggcttgccccaggtctcagcaggctgtgagcaagagctagagcctaagtcctcctgtgcttggggcctggagcccttccttgtagccccaggggatcagggtcttagtaggatacaggcttagatcgagtgactgtaccctgagaacctaggggagtaccggtacccaatgcttacgtccgaccaccgaccttggacatgatggaggaagacccagctgtgtagagatgagcaccagagccaagaagctgaggaggatctggagaatcctggaggaagaggagagtcgcgctgagaggctggtacagaagccgggttctcaaggacccaggaaggtggcgtgcagcatctggagacgagacgacgacgcaaagcctcccggaggacccaggagagcggaatagcgaccagggggcacgggccatcacaaaggtcaccatggagaagctggagacctctagagagccccaagaggctggacggtccataggcggaaagagtgtcagaggccagagacaagaacagtagacaatcaggacaagtgtgagtgagtaggagag

SEQ ID NO: 606285 - DNA, 543 bp, Homo sapiens
  misc_feature (393)..(393): n is a, c, g, or t
gaatgagtgtggttatgttctaataaaacttatttataaaaacaaggggaggctgggtttagcctgtgggccatagttgtcaaccactggtgtaaaaccttagttatatatgatctgcattttcttgaactgatcatgaaaacttataaacctaacagaaaagccacataatatttagtgtcattatgcaataatcacattgcctttgtgttaatagtcaaatacttactttttcctatatccaggactctgcctgagaaatttatacattcctccaaaggtaagtataaaattctcaggcagagtcctggatataggaaaaagtaagtgattgaagtaatacttcagatggttaagtcagaactaagtgatagtgctaacaactgatgcaangagtgcctcatcgtgagagtgcttaaagatgggatccccagagaccataagacagatactggaactggtatctagctactgatgtcttacttcgacgttctattgatgcttcagaatacagtggtagccatgtgcatgaatatacccata

SEQ ID NO: 606286 - DNA, 430 bp, Homo sapiens
gatcagctcgtcccgcttctgcttctgcctaggttgaacagggtcgttggtgagaggcaattgaagtggggagagaccacctgagcaatgactatcgatcagattgtcaaacgcatatgctcgaattggcaagtcctacttcatagaagacgagtactaggatgccgatccatttctatatagcaagatctctggacagagcaccgatatcccacggtgtgctcaagacattgccatgccaggtcagagaaatatctcatgtaaggagcaagaagcggctggcctatcgactaaacccctgatctggactttgtgtcgagaagaacaaacggcaaccgcagtagtttgctcgaagagggtgacctatcccgcaggaccaatgatacgcagttagtacacgaagaccagtcatgagagcgaacctcgaaac

SEQ ID NO: 606287 - DNA, 121 bp, Homo sapiens
  misc_feature (5)..(5): n is a, c, g, or t
ccggnacacgacaggagtacctgagatgtagcagaaactcaggcttcacgtgggttacacggtgaaagagcgagaatcaggcactcctattacgtgtacgcggccactacgtgtccggcca

SEQ ID NO: 606288 - DNA, 866 bp, Homo sapiens
  misc_feature (300)..(300): n is a, c, g, or t
  misc_feature (490)..(490): n is a, c, g, or t
  misc_feature (800)..(800): n is a, c, g, or t
  misc_feature (826)..(826): n is a, c, g, or t
catagaatacatgagctatttctgtcaatctcctagaacgtttatgggcgcagattaaacactatctattagttcttcattctgctgtttctaaattaacagaaacttcattagcatttgggcataggatttccttcatggccttatggtgttatgtgtcacactttatgcttcagatatgattcttaaaatcataactgaagatatgattaaaaaatcaaagatttttaaaatctttcacatacttgtccttgaaattcccagtaaaagggaaaccatcagtcccatagtcctaggggncttcccgactgtacaagaaatcactacttcatgccccagtgcagtgttttagaggagaggctgcaaggcttgggaaagtggccccgcattcagagtcagacctcaggggctgtgagttctgactccgcttcgttgtggttgaatcatcttgtcaacttccttgacgcgcccttgagtttctctttcttcntctttaaattttggaggatcagatgccagaaagtcaggagactgaagagtaaagatgtggaaatccctgtctagaccctggtactggggagagttttgtccttgggatggacctggctcctgccctgtaggcagtgaccacagcagcatgtccagccttccactgaggcaggcgtgtctgtcttttctcagagtatgaagagtgtaaagacctcataaaatttatgctgaggaatgagcgacagttcaaggaggagaagcttgcagagcagctcaagcaagctgaggagctcaggtgaggggaccccgtngggggaggcaggcgggtagggtgtanatctcctgaagtacagcagccgggcgggcctaaacggccc

SEQ ID NO: 606289 - DNA, 1051 bp, Homo sapiens
tgctgctgttctgccgccggctgcgacaccaggctgatcgtgaggatggaaaacgcttgcaacgatttacctgccagacgtgcccctactgtgcacatcatcatccgcaaggtaacgaatgcgtaagtagcccaaaactgaagatatacgatgattatcgtgcgttggtgcgtacgaccagacgtgcgctgggtagcacattggttgagctactacctggacgagcaggtacagttggttccgcaagagtggctaacaattctaatccttcgttaaccatttcacattacgagtggcgattcattacggagcacttccactgtgtcctgtcagagtagaggacctggcattgaatctcacccttcataacaaaggctggcgtgtaactgcttacagcttggttggaaaacgcgattggaggtggaatacatggccagcgttggcctcagcgtgccccataaggtggtgttgatttagctgtttgttccccatcaggtggagcaagaataggctttgagattggcaaatttgaatagaaatatggcagatgtaccatgaaatgccttcgttagacataggtgctgagatgcgtaacaagtatgagaacccttttttgaagggctgtaaatgaagcccaggcgagtgttcacgttaaaaattactggtgctcgttatatttggctcgaatggcaaggtgtctgggaaataggaaaagctacattgcaaatagtacatggggcgagaaattatacctaggtagctcggtgggacaggacagaaaccacggagtaaccccgagtaaaacttggaatagtttatggcttgctgggttggttaagaaaggtaaccctttagttcattttcccattagcaaactcggaagcgtttagtgatttgggccccaggtttgcacaaatttccccttgagacttacccccaaattcgaaagtaaactcctgttaaagactagattaggcgcaagccctggttttgggtcacacacagctttttatttttagccatgtttcccctttggagtttattttaaccc

SEQ ID NO: 606290 - DNA, 453 bp, Homo sapiens
  misc_feature (140)..(140): n is a, c, g, or t
  misc_feature (153)..(153): n is a, c, g, or t
  misc_feature (159)..(159): n is a, c, g, or t
  misc_feature (195)..(195): n is a, c, g, or t
  misc_feature (257)..(257): n is a, c, g, or t
  misc_feature (323)..(323): n is a, c, g, or t
  misc_feature (371)..(371): n is a, c, g, or t
  misc_feature (378)..(378): n is a, c, g, or t
  misc_feature (417)..(417): n is a, c, g, or t
gggtccaagtccagctgccttcccaaggtctgctggtccattaggcccaggtcaagttgctttccccaggtcagctgcggggcacctgggctcttctccagcaggccctgtgggtatcaacccagctccttttgcaagancaaaggggaaccntgggcnttaacccagcttcctttccaaggatgaatggccctntaggtaagactttggtcccatttcctagggtaaggcagccctccctggctcaaatccaagcntgctttccccaggccaagggggtccaattggcttgcaatgtacccaaatggaatgttacccccttnaaataccatttttcttccaagggccaattttgttaatttaagcactgnggggttntgaactgggggctgtctcttagataaaaggagtagattntggaaagtaaagttttaaagaacatagctggggctc

SEQ ID NO: 606291 - DNA, 167 bp, Homo sapiens
agtgttgcctgggttataccctttgtcctcgcctggataccatacctagcgctcatacctagctcctaccgtagttcaggatacagggtgacagcgcaagtgccttcagggagatgactaccgtaccacccagcggttgctactaccttaaaatattaccatggtgg

SEQ ID NO: 606292 - DNA, 129 bp, Homo sapiens
aggggagtcggaaggaacacttgtaaccacaccagtgcctttatcctccttaatagttagcaatgggagagaccctttgaagtcaaggacaccgaggaagaggacttccacgtggactcaggtggtgtg

SEQ ID NO: 606293 - DNA, 465 bp, Homo sapiens
ttgttcgcgacgcggggacgcctgggggtatgcgtgccgtagtggccggtggccagagtagggtttatctccaccttggaggaggccacgcggacccccttcggccttgccggagggggggccgaattggtttcgggctttaacttggaataggcggcgggccccttggcccttttttttatggcggggtgcccaaccttttttttaataacccccctcccccctccatttttcttggggccaacattggggggcctttccccgggactttacccgacatttttgggccccagggccctatttttaacccccgtgttttttgggtttgggccgggatcccccgggttcgggtggggccaatttatccccctccttgggaaaaatttcctccccctccccctgggtttttttttttggtggggtcccatcccccttccattttccgggtttcccccccccccctta

SEQ ID NO: 606294 - DNA, 917 bp, Homo sapiens
aaaaaaaaagaaaaaaaaaaaaaaaaaaaaacaaaaaaacacaaaaaaacacaaaaaacaaaaacaaacaaaacaaaaaaaaaacaacaaccaacttcttgtctaggtcgaggcctggtgttacaaccatcagtacccaggcccagtcgggaggatggccacaggccctaagttcccaccggtactctgcctgcagtaggtctggagtggtctgccgcagtcaagtactgcaactagcctccctgtatatccccttcgtaccccaagttcatcacctaccccttcgtaccagaacaggttcgtccagtacaatagccacttccttggaggaacagcacaaacatgtacctcctgactgagccagtacctgggggtcaccatcgatctcatcaactcctgacacctaccgcttcgaccccaactgttcttctagactccagctgatgagaacacttttggacagacggagattcaggcccccaccagctccacgacgactcccagcacgccgcgacggtggtgccctgcgactgcgacccgacagagtacactctccactgcagttccaccgtcactgcgcatctccaactgagcacagcctgcggtccgcatctggggcttctgtgacgccgcacgctctaccgcgccccgcaccctctcaccgacggccctgcccgatacagccattgccaagactccgcggatgcccacacctcatctcacgcatcacagcaaccccgagtccccggtggaggtcattgctgtcttcccagatttaagatgtggctcactcctgtgctcggtgccttgactcgacccgcccccaggcccgagtgctcactccgtgggctcttctccggccccctcggctcctgccggacgccccgcggcttcctctgtcccgtccacccggcccc

SEQ ID NO: 606295 - DNA, 976 bp, Homo sapiens
ccgccgcctgtggtgacccccgtttcgctagcgctccgggtcattatcaacaacggggtggagttccactctgcgttgctcacttgggcggttccttacatggccggtgtgtggcacctctcctgctttgtctggggtggtttctccccccccccttttcacgtgtttccgttccccgaacaaacccggggggggtgccgccgcccgacccacctgggtcggcccctccccagctcctggtgacttcgtgaaccccttccctgcgtgggaaggaggttcacccccgcccactgtggcagcacccaggggtgccagcgccgctttccctctgtgtgtgtaggagacccccccgtttcgatttcggccgaactccaacaatgccacatggtaaatctcgggcgactttcccgcggtgcgctgttttcttcccgtagggcccggcggcgcttcttactttctgccttctcgggcccacggaaatcgcctccccttgtctgggttctcccgccccacagagcgagtcctctctccagcgcgcagcctccccggtcacccccccctgtgaacagtgaagaacactgttctgcccccccagctgctgcaccggtgaggtccaaacacttgtctctacccgcggtattctgttccatgccaccaacaagagggcgtctttctcacagacagcacacggttggacacgttcgtgacgtagaggtacggaacaaggtctcccgctcgctcttggggtccccccagcgtccccatgttcttgtgggcgcagcatcacgcccccaagtcttgtggtggcgcccgcgcccgctacctttctcaaagcagtgagcgctccccccggatgcctcgaagacacatctcgagtcgcctcgctaggaccacgttagcacggcccacgcgggtccccccaaccccacactcctcctattaaagggtttccaaaaaagcgggcacacatgagcaa

SEQ ID NO: 606296 - DNA, 550 bp, Homo sapiens
  misc_feature (458)..(458): n is a, c, g, or t
gaatccccggcgtactgtacagtggccattacccctctacttggaaaacgccactgtgctggtcgaagcctgcagccttttagggctagagtattttatataaacagaagagctaagttcctgaagactaagctagatagctgcagctatatgtaaattgtatatttttatgaacttttgaagcacacactcctgtttccctctgtgtagctttgtggggatttcatgtatatatgctgtctgaaagaatccagaggttggagtgccaatagaaaatgaaaacaaatgccttgtactacaggcagcctctgaaagagaccagataactgtgttcactgcgaccagtcggagtccctgcttgcttgtgaagaaggggctcttgtaccttgttggagatgccacctcagaagttcacactgtgcaggaaaaaggttttattctctcctggcatacattanaatgtcagatgcctgcatccatgtggaccacgatggggcctctaaaattggtgggcagggggtttgcttatgagttttctctggaaaccgat

SEQ ID NO: 606297 - DNA, 427 bp, Homo sapiens
tgagcagcgcgggccggaccgtgccccctcctcggtccccgtgccccgcgatgtcgcgcatgttcccgaggctgcgggccctgttccctgcgcctggccccctcagcgggccgtgctcgcatcaccgaggtcggtccggggcggaccgaagcccccggggcggggcggggcgcgggcgtccggtggcgccgcgggcccagcccccggcatgccgcccggcaaagtgctgcagccggtcctgaacgatgaatggtggacgagctgttcctgtactggctcagcgaggccagcacgcagcggatgctgcaggactgcctgcgccggatcaaggcgcccgggcgggaccagccgaccccgggggacggggagcagcccggggcctggcacacagaccagtcgacgaacaaggacaaaaggagtcgaacaa

SEQ ID NO: 606298 - DNA, 126 bp, Homo sapiens
ggttttttttttggggggggggggttttggggttttggttttttaacccgggcttttttttggggaccccctgccccccaattttgtccccggtttttgggccccccttaaaaggttttttgggga

SEQ ID NO: 606299 - DNA, 933 bp, Homo sapiens
  misc_feature (87)..(87): n is a, c, g, or t
ggtctgtacgacctgaatcatactgagatgggggagcttatccgtatgacatagatggtgaggaccattccagcatagatatgtccnatctcgtattgcccagagttggagtctgtccacgtggcaccgtgcgagcctgtatcacagcgcgtccacgccatggaacgggtggagcgtgatcaatcacgccagagcatatccatgtgggactgaaaaggatgcatgtggttcatccgaggcgtttgggacttctggtggaggactgtggacagctaggtgattctgtaccatgagtatcatcttcctggaaggtcaagtacgctgcaggaggagcaggcgtcattacgatgtcgttcgatgcctgtcttgagaccaggtggccactcagtacttcatccgtagtggtgtcatgacgcgctggctctcttgtgaggacccagactgcctgttctcgcttccggggatcctgagtcattgcctggagaagtagcgcccgcctgccaaccgaactattaggaagctgctatgacccttggaccgtgtctggtctgagaatacagtgtctttgagagtctttaccaggatagaatttcgctttcttacaatcccatgcagacccaggtgtttaacactgtatacaattagtgacgaaaacgtgtatgttggtgggcccccaacgggacatgcgggaagactatttgtagcagagtgttgtcatcctgcgacatgcgtgctgcccgagctcggaggggccgctgctgggtacagtcgagccccagtggaaggtcctggcagagcaggtatacatggaggtggtaggagatgttccaggagaggtgtcaagaggaagggtggtactcctgagaggtgagacagaaagagctgaaaggtgtggggaaagggaaccattatcatcaggatcccgtgagaagt

SEQ ID NO: 606300 - DNA, 109 bp, Homo sapiens
ttaatgacaagattctaatccaaaggattacgtgaaacatacgtcatcactactgctcaaacaagtgcccgagatccacaaaagccatcccatcagtatcttgattatc

SEQ ID NO: 606301 - DNA, 129 bp, Homo sapiens
gcctgataaccaggtgtacagagcattttctcatgctgggccgtggggtggcctcactcaggaatcttgaggcctcgagagaaccaccaccatggcatagaggtcggtggccccgtctgccagccgctg

SEQ ID NO: 606302 - DNA, 163 bp, Homo sapiens
aggttctacctagtgaacacggcaagccaatgtgccccccgagaacagaagaggcggtcgtgcagagttcagaaggcaggcagctcatgcttgaaggtgatagccttctgtctacaagagaaatacttgctgcacctcagttacttctgtgttatcaaggaat

SEQ ID NO: 606303 - DNA, 635 bp, Homo sapiens
gagtttcactcttgttggcccaggcttgagtgcaatggtgcgatcttggctcactgcaacctctgcctcccgggttccagcgattctcttgcctcaacctcctgagtagctgggattacaggcgcccaccaccatgcctggctaattttttgtatttttagtagagacggggttttgccatgttggccaggctggtctcgaattcctgacctcaggtgatccacctgcctcagcctcccaaaatgctgggattacaggtgcgagccaccatgctcagccctgaatccctgactttgttaatgacctgtccttacccccggctcttctcctgacctgccaataaaaatttatggtccaagggaaaaaaaaaaaaaaaaaaaaaaaaaaaaaaaaaacaacaaaaaaaaacaacaaaaaaataaagcacacgacactaacactaaccagaacaacaccacacaaacatatacaataaacacacaaactatacatctcaaacaatgtcgagccctcgtatatccatcacaacccctacacaccaacatctattcaccccactcttcattcatccaatagcaccatatacatcaacattataacatcataacatcattccccctctaacatagcaacta

SEQ ID NO: 606304 - DNA, 238 bp, Homo sapiens
  misc_feature (124)..(124): n is a, c, g, or t
ttcatatacagtgctttcatcccggctggcagctagcaaagccagaaagcaagtctaacaggatctaagatgaccatcaggagaaggagttgagactgtgtatgcaacgccccaatagaccccncttttactcgtgatcttggagacatgtatctaggcttcatcattttcaatgtcacagtgtctcgtcagaccccgtggattcatgaacccataggccacacaatcatagtgcatg

SEQ ID NO: 606305 - DNA, 1450 bp, Homo sapiens
ggacatctactctaaagatcattcgcttcgcccttgttctgtattgatgcgccagtgacatcgatcggaagcgcgattctggtcccgacgtgatgcgagtgcctcacgggctccgagcgaatggcgtgatgcgtagcgtcgcctaggatcctgcatccatgctgaatgcaatagttatctgacgaatggaaagggtacctcgtacactgcatgatcaggtctatcaacgacaattcaacttttcaacgtgtcgcaggtgtgaggaccctagaagtgccaaggctgacatgacaccaacacctagaagggtccgacctcgtttcgtcagggcatttgtgggctctcaatataaccaagtcgactaacccgtgggttctacaaggtctcgttgatcgtaggcatcctactcacatcttgtcatggatgaaaattcgaaggatcgaatccaagcgatccttgtgttagaaattgtcccacccaatttgactgaaaaagcctaacaaggaatatcgtgggctcctgcgtagatgcgccaattcgtggggggcatagcgtacaacacagaagaaggtacttatccaatcgggactcatcaactttcaagttccgaagctagtccgttacaatcttgttcaccaagaatgggactaggaaagtagccactttacacacatagtgagtattaggtactaaggaaagaactggagtaattagcaagctacggatcaattgaaacataaataatgccgtggagacagtgaagcttgaatacgttcatcattctttggcatgaatggggcacggggccttccccatggaacaagagggcctaataggtcgaccaacaggaaccaaatggggtaccctcgtgattgagcacaagattatagacggcacgaaagacattgccaacttgaacatatgactttagcaggggttggccccttattcttgaagggtacaagtgagccctgcgggatttttctggactgggggagaaaacaatgcccggccattaaggctgggagcccacccattgacctgtcccctttaaattctaccgaggtggactggacagggcacagggaaacgcgtcacgccttgttctattcccaacaccttttgggcaagcgccgaggcaaggtggatctaccagaaggtcagaaagtttcacgaaccagcccggggcaaaccaggaggaaaacccgggacttaacttagacgtatattacaatagcggaggcgaagagacgggacccatgtaatacccgaacaaccggcaagcctgaagaggcggaaccgcgacaccacgacgacgatggttgcgtagaccacagctacaccaggagcaacacgaggcgacagacacacctgggcggacaaagactcgacccccgcgagcaaaacaagaaacaaccaagaccgcactcagcgaacaacagacagagca

SEQ ID NO: 606306 - DNA, 111 bp, Homo sapiens
ctgcagcagacaacagcagtgtatgaggattaatttctctacatctgtgcgaatatacagtacagtcttttttaacgtttttacaatttacatggtgtataacgtatattc

SEQ ID NO: 606307 - DNA, 457 bp, Homo sapiens
ctcgaggccaagtgcggcactttgcgacgcgtttcgcgtccgtgtcgccaccccgcctgcgcctgcttcgacattccggattgacacccgccgcagtcggcctatccgtagggtcagggattacgctggatgcagccgcgcgtcccgggcaagcttactccacgacaaggggaccatccgtgaccaacgcacctgctgaaacctctgcaccctacacggccagcacggccatctggatcgccctgatcgccggccttaccgtgatcggcagctacggctatgcctgcgccgcaccgctagcggccgttgccgcgctcgccgcgctcaaaatgaaccgccgcaacggtgccatcctggtcggcctcgcctggatcatcaaccaggccgtcggcttcctgctgctcaactacccgcacacggccgaaacctacgcctggggcgcgggcatcggcttcgg

SEQ ID NO: 606308 - DNA, 631 bp, Homo sapiens
  misc_feature (95)..(96): n is a, c, g, or t
  misc_feature (99)..(100): n is a, c, g, or t
  misc_feature (111)..(111): n is a, c, g, or t
  misc_feature (113)..(113): n is a, c, g, or t
  misc_feature (116)..(116): n is a, c, g, or t
  misc_feature (123)..(124): n is a, c, g, or t
  misc_feature (128)..(128): n is a, c, g, or t
  misc_feature (139)..(140): n is a, c, g, or t
  misc_feature (142)..(144): n is a, c, g, or t
  misc_feature (171)..(171): n is a, c, g, or t
  misc_feature (174)..(174): n is a, c, g, or t
  misc_feature (198)..(198): n is a, c, g, or t
  misc_feature (221)..(221): n is a, c, g, or t
  misc_feature (258)..(258): n is a, c, g, or t
  misc_feature (504)..(504): n is a, c, g, or t
tcctgagttcaagcgattctcctgcctcaacctcctgagtagctgggattacaggtgcccaccaccaagcccagctaattttttgtatttttgtnnagnngggtttcaccntntgncaggctnntctngaactcctganntnnngctccgcccgcctcagtctcccaaagngcngggatacaggcgtgagccaccagncccgactcctatttgactttttnaaaagtgctcctcagagtactgataccatgaccccanactgcccacagagaccctgtctctggatgtaatgccagcttcgtgccagtagaagcagcgtgagttgccaggctgccataatgggatggttatgctgtcctggaacgtgagaggtgatcaggtggtcctttgaggcgcttaaacgttgaaaccgtaagtaaagtgctggcggatgtctaaaacttaggcctaaatagtggcaccacactcccttgccttcctctcagtggtccctcggtggtcggntactgagatggggtccctttcctatatccctcaggtcccctaagtaagctcactccacccctaggcctgcctccctcaggagcatctccgggcagggtgtcatcgggatggcaccacttggtggacg

SEQ ID NO: 606309 - DNA, 282 bp, Homo sapiens
  misc_feature (202)..(202): n is a, c, g, or t
gaggcattctgcactgataaagtagagatggaatgagaccaagtggttcaagatctagcctgggtacaggagggagacagagtcatgaaatcaatatgggatcaaatgtttccgaatcactcatcatattctcatagtttggaaaaaaatacctcactctttctcccaaaaatatttaaatctgccatacatattatatatngtatgtgtacaacaggtccataaacgcaaattttataactttaatcacttttggcaggttagcatagaatttacaagcaa

SEQ ID NO: 606310 - DNA, 113 bp, Homo sapiens
gtcgacggggagagggtggctactgccagggaacaatggccatgagtgtgtgtttctgtgtgtgtgtgcatgtgctgtctgtgctgtctgtgctgtgctgtgctttctgtgct

SEQ ID NO: 606311 - DNA, 362 bp, Homo sapiens
gcccagtgacagtgggctacccctttctctgtggaacagggagggcctgtgtctggccagtgctgaggtaccagatctgttgccatcatgggcccttcagggtcctgggaaattcctggcttctcctaaatcagggtgaactgggcctccaggatcaggtctggagcaggcccaaatatagtcctggatctgcctggattaggtgccaattgtctgagtctgggttccagatcaactccagaccccaggctggatctggccccatttgagttctgattccccttggagctgggctctgggccctgggccagcatctatccttgtgtggcatctgtcctgagctggtcctggggcaccatgca

SEQ ID NO: 606312 - DNA, 357 bp, Homo sapiens
  misc_feature (110)..(111): n is a, c, g, or t
  misc_feature (113)..(113): n is a, c, g, or t
  misc_feature (187)..(187): n is a, c, g, or t
tgttccccccccccccccagagggggggggggtgttttttttttatttatttttgtttcccccccccccccccccagggtgtggaaaaaagggggcggtggttttgggcnnanccccccctccttaaaagggggggtttttttcccccccagggggggttttggggttttttagaagaaaatttttnttttgccccccgtttttaaagaacccctccccccggtggttttttttttgccccccccccgggggggggggagaaaaatttttttttttttttcccccccccccccccccgggcggggggggttttttgggggtttcccccccaaaaaaaaatattttttttttggggga

SEQ ID NO: 606313 - DNA, 501 bp, Homo sapiens
ttccaatgtgcccgagctctgccatcatggttagcgtggctggttcacatctcattggacgtacgtgtaattcggaggctggcggaatactgagtctgaggctgattcatgtcacccttggctgcccccatggctgctttctgggctgcctgctgcacatttggcttcttccatgcccctgtgttctattcctcctcaacattgctgaaactccccccacttccccggtaaaatttatgaaccatgctgagggcgatgaaggaaaagacggccatcactgtgaacatgacagtgggaattagcatcaccaccgccgagccaatgttcgttccgaagaaggtgatggtagcaatccagccgcagacgccccagcctgggatgcccacggcctggatgatgctgatgaccaactgagccatgaaggtaaagaagaatgccatgaaactgaaggagctgtcagtcctgcggcagaggaggtggctcccgtcacctgggcagagg

SEQ ID NO: 606314 - DNA, 502 bp, Homo sapiens
  misc_feature (132)..(132): n is a, c, g, or t
  misc_feature (140)..(140): n is a, c, g, or t
  misc_feature (145)..(146): n is a, c, g, or t
  misc_feature (150)..(151): n is a, c, g, or t
  misc_feature (154)..(155): n is a, c, g, or t
  misc_feature (163)..(165): n is a, c, g, or t
  misc_feature (173)..(173): n is a, c, g, or t
  misc_feature (186)..(186): n is a, c, g, or t
  misc_feature (200)..(200): n is a, c, g, or t
  misc_feature (210)..(210): n is a, c, g, or t
  misc_feature (217)..(217): n is a, c, g, or t
  misc_feature (223)..(223): n is a, c, g, or t
  misc_feature (264)..(264): n is a, c, g, or t
  misc_feature (409)..(410): n is a, c, g, or t
aggcccaccccaactcctaccaggctacgctacaggcagagcccagcactgatagggccccgcccaccgggccccgcccaccccaggccacatcccacccatctgaagtgaaggcccagggactctttttcncccccccnaaccnnccannacnnacacgggnnngacggatncgtggtgctcagnaagagctagtgccntaggtggggnaaggcangactcncgactgagagagagaggagggggatatgaccaccctgcccnatctgcaggagcctgaagatccagctcaagtgccatcctgccagtggcccccagactgtggggttgggacgcctggcctctgtgtcctagaagggaccctcctgtggtctttgtcttgatttttcttaataaacggtgctatccnngaaacgggcaaacctccactcagcttcttagcatttgggctaaaattaaaatatcagcaaatgtgtagaacagtgccaagtgttaggctccc

SEQ ID NO: 606315 - DNA, 343 bp, Homo sapiens
  misc_feature (97)..(97): n is a, c, g, or t
  misc_feature (157)..(157): n is a, c, g, or t
  misc_feature (178)..(178): n is a, c, g, or t
  misc_feature (211)..(211): n is a, c, g, or t
  misc_feature (259)..(259): n is a, c, g, or t
tgaggatccttgcgggcctttcccacaaggtgaactagttacagtcccacagtagtgtaaagcatcctatttctccacatcctctccagcacctgtngtttcctgactttttaatgatcgccattctaactgggtgagaggtatctcatgtggtttngatttgcatttctctgatggncagtgatgatgagcatttcttcatgtgtctgtnggctgcataaatgtcttcttctgagaagtggctgttcatatccttggnccactttttgatggggttatttgattttttcttgtaaatttgtttaagttctttgtagattctggatattagccttttgtcaga

SEQ ID NO: 606316 - DNA, 1311 bp, Homo sapiens
  misc_feature (421)..(421): n is a, c, g, or t
  misc_feature (607)..(607): n is a, c, g, or t
cgggttttccacacacacctccagtatcctcgtggcccaaaaaaaaatttatggaaaccactggggggattataaacgcccccgccaccacaccacaagaacccctgggaacatggcccgggagaaaatttttcgggtaacggagtcctttattccggaaaaaagcacccagtagcccccgggtgccccaagagtccaagatccgagaggacccgagattccgggaacagtagaatcccatgagccggggccccgcaggaggagaaactaatgagggtaaagcataggaggacctcccacgcctacttttggagaaacccccccaaaagttaagatgtaattgagagcgccccactgggaactcttgtgtcaccacaaagggtaccccttgggggttctttaccccaaaagaggagctttnggattcacaagctcgccatcccaaatggaaaaaagatttttcttgggggttttttcattgtgcttgtgggaaagagccccacaagaaattctccctgtaaagaaaacgccccagggaagcgccttaaaaggcgcaaacctgggggagaatattcttttggcgcacaaagtgctccacacacagatnttatagtccagaagatggcttacaccccagaccccacagagatggtgatagcacacatagcgccttttgggaatatagtagatattgagagagacaggctcggagatatatatcttgccacacaatatgggagacacacagggtgtatacacacacagagaagggggcgcgcccctatatgggcccccctgtgtggagacctttagaatatacctcacgcgagaagagatataccacgcgagagaatatattggacccactccataagagagggcttgtgcccacaaggcgtgcacatgtccacagtatatggtatatcacaaaatgttctgaagaggggcggggaaatcccacagggcgccttccacaaggagaaaccccaatgcgaacccaacgccaggagccttggatctcgctccagagtgggaagaggagagattgagagcgccaataccattggagaaagagagggatagaaagagatgggaagactggatgggggttggaagatccaaaagcgacccaaaataactaatccactagtgtaccaacccagagatgcgtcccacaaggataatgctccccccggttttctttctgaccaatgttcccaaaggttgccaagatagtttttttgtggatgaataataaaatttttattgtgtaattacttggttcccattataaattggttaacttgctta

SEQ ID NO: 606317 - DNA, 427 bp, Homo sapiens
cacccacctgtagaactcaaggacatccagaaggtccaagagcttccggttcttctcgctgtccttcagtttcacgtagtcatgctgcaaaccatgcagggtcacacttcgtctcatcatccacgaagatctccattggatcttgcatgaacttgcggcagcctggacggcatctctttgctccaggtagcactgaacatcatgacctgcttctcgtggggggtcatgccgaaacatttcctggacatcccgacgcatgtggagctgtacaggcatctttatcacattcatccaaaaataaagggttcatgtgttagcggttgaggctcttaattcgagccaaggctaggatacggcctggagtcccaagacgatatgcgggagttcttcttcagaacctcttcatccttcttgatagacagagcaa

SEQ ID NO: 606318 - DNA, 257 bp, Homo sapiens
  misc_feature (176)..(176): n is a, c, g, or t
tccactagatgtggcagaggcagagatggaagttggaatggacaagccgtgcctctccttggctctccatggctctgtcctcaggctgtttctgcaatttgacatgaggcctggccccagtgtaaaccatgtggggcctcatctccttcccgtgtgctgctctgagtgtggagccnttctcagggttcagtccatgctctggagccccttctccagcgtcggtcaccaaatgctgtctggtcccagggcgctgacta

SEQ ID NO: 606319 - DNA, 302 bp, Homo sapiens
  misc_feature (270)..(270): n is a, c, g, or t
ttttaggctggatgtggtgacccacgcctgtaataccagtactttgtgagtctgaggcagtaggattgcttgaggccaggagtttgagaccagcctggttaacgatacaagacccccttttttaaaaaaaaaaaaaaaaagccaactgcaccagcatatgcctgtagtcccaactactgagggcatagaggtaggagcatcatggatcactcgctccctcgaggcgtttgaagctccacgacgctacgatcttatcactgcaattcagcngaggtgcccgccagcaagcccttgtcacacca

SEQ ID NO: 606320 - DNA, 432 bp, Homo sapiens
ttcaagatagttgagaaaaatatatccatagcctaaaaaaggccataagagggttgcaaaatctcaaaatcaaaataaattattactaatatatatttggtgcttcatgtgtattgacccagttaattcttaaaatagtccaataactgggccgggtgcggtggctcatgcctgtaatcccagcactttgggaggccgaggcgggcggatcacgaggtcaggagattgaggccatcctggctaacgtggtgaaaccccgtctctcctacacacacaccccactagccgggacacggtggcaggacgcctgtagtcccagctactcaggaggctgaggcatgtgcacggtgtaaccccggaagacgtagctcgatgtcaactagtatggcgccaaggcactcccgcccgggcctcacatttagactccgtatc

SEQ ID NO: 606321 - DNA, 116 bp, Homo sapiens
tcacaattcagcaattgtgaacatgataagtgtacagggaacgttatggttgcatattgctcaggtggcgcatcccaattcagtgcatgcagtagtggcctgccagtcaatgttag

SEQ ID NO: 606322 - DNA, 349 bp, Homo sapiens
aaaaaaaagtttctgaagacaatgtgaaatctgacaactgggaaatggatgctgttcattattttattccacatatttgttgtggtgcttaaaatattttgtcattgaaaaaaatgtaataaacaaatgactagaaaaagtcaaaaaaaaaaaaaattatttttaaaatgtcctggtgttggccgggcacaggggctcactgtttaggtggtcaaagtgggaggatcacctgaggccaggagttttgagaacaccctggacaaccttatcaagactctctgcctccaaaaaaaaaggcccgggttgttttatggttcccaaattcattattttttacacgttgattttt

SEQ ID NO: 606323 - DNA, 444 bp, Homo sapiens
gtcgtctctacaggatccccagttgacttcgtaagcgccttattaagactctctgcaaattcagtgatttgtctaagtaaatatagaacttagatgtacatctagtagttactttatggcaagtcttagtcgctattcaaggcactttagatgcacaaattcattgtgttctctcaacagccatgtgatattaagtaatattactttgtttgatagaagaagaaactgagggtctgtacacattggtagtaaagggcaaagttaggaactctgaacagatcagacaaagccgtgtacttcaagtgttctcctaatgtctgcaatagaaatgtggatggagaggcttctggtcagctattctggaagctaaaaaaccttgttcaatagagtaacattggaaattgtgaccacatagcctgactaagccatgagagaaattcagtc

SEQ ID NO: 606324 - DNA, 595 bp, Homo sapiens
cccccccctctttttttttataaccatgggggggggtcccagggcgccttttcccccaagccccccccccctttggaaagacctttggggggggggggtaccccgattttttcccgggaatcccgggggggccggggggaaaatttttttgggggggagggggcccctggggggggggaaaaaatccccccgggcctaaaaaaaaatttttcccgggttttttttttcaccgggggccccccgggggggggttttttttaaaaaaaaaaaaatttttttggggggggggtaaatttttccccccccccgggggtttttggggagaaccccctttttttttttgggggggggggttccgaaccccccctccccccggggggccaaattttttttaaaaaaacccctttggagggggggggtttttattggctcccccgggtttttaaaaaaaccccaaaagggggggttggggggggggggggccccctgggggggttttttttggggggttggggaaaaaggggttccccttgggggttgggccccccccctttgtttttttttacccccccggaaaaaaaagggttttccccca

SEQ ID NO: 606325 - DNA, 103 bp, Homo sapiens
tgtgagctccttgtggttttttattaactcatggatgaaatcgaattcgtgtcattaaggctgtaggccaccttgaaggcttcaggtactcatgactggccaa

SEQ ID NO: 606326 - DNA, 248 bp, Homo sapiens
aagcatcagattgaatgcagtggatccatgcagtgtcattgaatgcagtggattccatgcattgtgattgaatgcagtgtacaacatgcagcctggtaaaatgcatcccgattgaatgctgtagattccatgcggcatgattgaatgcagttgattccatgcagcatgaagaaattgaaccctattgaatgcagtggattttatgcagcatgattgaatgcagtggatttttgcagcatgattgaatg

SEQ ID NO: 606327 - DNA, 553 bp, Homo sapiens
  misc_feature (28)..(28): n is a, c, g, or t
  misc_feature (66)..(66): n is a, c, g, or t
  misc_feature (109)..(109): n is a, c, g, or t
  misc_feature (143)..(143): n is a, c, g, or t
  misc_feature (147)..(147): n is a, c, g, or t
  misc_feature (163)..(163): n is a, c, g, or t
  misc_feature (165)..(165): n is a, c, g, or t
  misc_feature (191)..(191): n is a, c, g, or t
  misc_feature (206)..(206): n is a, c, g, or t
  misc_feature (217)..(217): n is a, c, g, or t
  misc_feature (233)..(233): n is a, c, g, or t
  misc_feature (248)..(248): n is a, c, g, or t
  misc_feature (250)..(250): n is a, c, g, or t
  misc_feature (254)..(255): n is a, c, g, or t
  misc_feature (326)..(326): n is a, c, g, or t
  misc_feature (337)..(337): n is a, c, g, or t
  misc_feature (341)..(341): n is a, c, g, or t
  misc_feature (349)..(349): n is a, c, g, or t
  misc_feature (399)..(399): n is a, c, g, or t
  misc_feature (415)..(415): n is a, c, g, or t
  misc_feature (419)..(419): n is a, c, g, or t
  misc_feature (421)..(421): n is a, c, g, or t
  misc_feature (423)..(423): n is a, c, g, or t
  misc_feature (436)..(436): n is a, c, g, or t
  misc_feature (440)..(440): n is a, c, g, or t
  misc_feature (446)..(447): n is a, c, g, or t
  misc_feature (505)..(505): n is a, c, g, or t
agttccagacaagcaggaagcagcagcnagaagcaactagcacacagaaacacccgtgcgtgtgcnctacacattcaagcaaagccattcctctagctaggacgcagcnatccccaccctcccacctacgggcaaaagagaanagcngaaaacaaacttcccncnttaaagggcacactcaagtaattttngaccacaatggccangaaaaagaaanaaaaacaaaaaaaaanagaaaaggtcgatcntncctnnaaagcgggcagtggctattttcttctctctgccaaagcaggacacttataaatcttaacacagagggcccnaacgctaaacntcanaaatactncagacagttgtcttcaacatcctgtggttcttcgtccgattccttttttnttttgagatggggagncgcncngncccccaggctggngcanagtggnnccaaacttgacttactgcaacctccacctcccgggttgaagggattctcctgtctcantccccccaaatacctgggattacaggcgcacgcaaccacgccaggcta

SEQ ID NO: 606328 - DNA, 439 bp, Homo sapiens
  misc_feature (24)..(24): n is a, c, g, or t
  misc_feature (28)..(28): n is a, c, g, or t
  misc_feature (51)..(51): n is a, c, g, or t
  misc_feature (58)..(58): n is a, c, g, or t
  misc_feature (74)..(74): n is a, c, g, or t
  misc_feature (78)..(79): n is a, c, g, or t
  misc_feature (123)..(123): n is a, c, g, or t
  misc_feature (220)..(220): n is a, c, g, or t
  misc_feature (332)..(332): n is a, c, g, or t
  misc_feature (371)..(371): n is a, c, g, or t
  misc_feature (437)..(438): n is a, c, g, or t
ccggctcaggaatcggcacggagntaantttgtgttcaatttgagtccccnaggaggnaaagaggtacatgatntccnnacacatcaccagcttccagtggctttgcgtgggagctctgtcancgggtttacatgggttaatcatgctgaggccagatgcagtggctcatgcctacagtcccagagctttgggaggccaaggcaggaagactgcttaagncaaggagtttgagaccagcctgggcaacagcgagacccccatgtctacccaaaataagaaaaaattagccaggtatagtggtgcacacctatagtcccacccactcaggaanctgagatgggaggatcacttgagcccaagagttccaagnctgcagtgagctatgattataccatcgcacttcagcctgggccacagagtgagaccctgactcccnna

SEQ ID NO: 606329 - DNA, 1626 bp, Homo sapiens
  misc_feature (1197)..(1197): n is a, c, g, or t
  misc_feature (1626)..(1626): n is a, c, g, or t
tgggttgttggttttgaaaaaaagtcttgctctgtctcccgggctaggggtgggggggtgtgactcttgggcctcacgggcagcctttgcccttcccgtggcctcaagcagtctttacatcttcagccctccaaagtacgctgggactacaggcattgtgatatgatgcctcggctgatttgtggttacttttttaagaaaagagtggggctcttgtgccatatatttgtgccagggctgtggtttgtagaactctcctatacaaccctcaaggcattctcctctccacacctgtgtgtgctcctccccaaaatgtgttgtgggacaccccagcgggtgtgtttgacagcccaacccgtgccgccccgagactttagactctcccgtggtgtgtatgtgtgtgtattatgtgggttgtgtgtatacacatttgtggtgtgtgaaagtgttatagagcgcgccctctcacaatttgtgtggggaacagagcggagggaacaacacagagcgatatttattcttagtatatatatataacactctgtgtgtgtctccccctgtgtgagaagggatactcccagaggagggagtctgagagagataataaagaagaagtgtggcgccccgttgagagaaacacacagagtggctgtgtgcggaattctccgacgccctcttctgctgtgcccgtggggcggctccctatatctcatgccgcgtgggagtaatacaacgggggaggcggaacccaaaagagcagaggaccagcggaggagtgtgtggagacaccacatagggagacaccgtctgcaggccgcgcctcttatctcctctgtggggggtggttgagccccccgcggtgtttgcagttttctattgtcaacacgcagagaacaaaacaagcgcttctcgcatgtgtggttgtatacaaaaacctccgtcttttacaaacaacggctaccaactatgggtattatttcaggcgtcgcagaaccatctctgttatgagagacacttatgttgggtctgcgagcgcgacgcacacctctttccaacgagcagaacaaatcatacaaagggaggggggcgatgtggtatgaggagcgagcaacacaacctcccccccccctctccccactgtatgtttgttgtcttagtgggccaaccaacacgctggtgttgcatcaatttgtcaanccctctatacagacgcggcggcgtcgcagacagtctgtcgaacaagaatctaaaaaggcgcacccccaccggtggctagaaactcccgccgcaaaaacaagaaacaacaacgaaacacaacaaccacgaaaacgacaacaaaagcaacgacaaacacacaaacaaccacaccccagcggcagaccggccacatcattatcttaccacagcggggactcgcagcagccgaacaaaacaatgagcatcaatgagaaacgaagcagaccgccgagcgagctgaatcgaacacatcgatactctatctcactgcagcacaaccacatcatatccgtatccaagcagaggggcggtggacgaaagccgccgcgcgcaccaccaaatcacagtggcgggcgagctatacaaactacagcaagccccggactgcan

SEQ ID NO: 606330 - DNA, 107 bp, Homo sapiens
ccatttgcagaagaggacttatcagcagatgccctcttgaatatgctttcagaagtaaagattcaggaattcaagccttccaagtaaggttgttcaaacagatgaaa

SEQ ID NO: 606331 - DNA, 999 bp, Homo sapiens
ttcttggaaagcagctcaatcttggaaagactgatctttccaaaatatatccctggtctgaagctttggtctgcacttctcaaggcttagagaatccagttacagaccttatggggttcagtgatgctatagattgacaccctcctgcctgtttatctctgcatcccaacctggcaaggccctcctgttgggtgcccatctgtgcctttataccggctgtgccctcgactttacagcttacccatgttctttggttaggtttctctcccttccttctttctccttcgacaatccgcctgttcgtcagggcccagtattgtttcctcatacaccttcctcatacccaccccacatggttgactcttgtccctcagctaccacagctcttcatcatgccactcatttcagaacttgagcacaaaccagggcagtccggcatctgatagtctttctggtctcccctaagaaaaactaatgctcttgagtggcaccagcccttggaaattgcttcctatcttgctgagcatggtgcacctttccttatggacttccagagtacagcccttctggccagagagcgcatcttacctccatgcactatggatgtgactcaaactgctgggtcccacaggcttctccctgtaccacttgctgtgcacttatcacatgtggggtctgctcttaccgcagcgcgatccgggacccaggtgggtcacacaccccagaggtcggccggccgcgcacatcagcacagagacgcggagggagcacgcccgacccgcgacacccggccgcgaccgacaacacgcgcactagcgcactcaacatgcagacaggcgccgcgcccagacaccccatcgcggccgctgtcccagactctcgaacgacgggcacgcctcccgctccggtggcacaccaaatgcaaaccggaccgacacaccaccaaaaccacgctagcacaggataggacacgcccccccaacacccgcgccgccccac

SEQ ID NO: 606332 - DNA, 235 bp, Homo sapiens
tattaaaaaaggagtttttttttccccaggcgggggggacgggcccccattggggtcaattggaactttggcccccgagggaaagaaaatttcctggcccaaccccctggggggggggggcccaagggggagggcccccacccccgggtatttttttgttttttatggggggggaaaaatttggggccccgggccgaaattcaaaaccggggcaatggcttgtcccgggggaaaa

SEQ ID NO: 606333 - DNA, 157 bp, Homo sapiens
ggccagggttcctggagctggcctgagggggctcaatgggccctcgggggcccaaggggggctttcaaccctctccccccccccccagccccctgccctgaaatggggctttattttggaattattaaaaaggacagggatgctccaaaaaaaaaaa

SEQ ID NO: 606334 - DNA, 253 bp, Homo sapiens
  misc_feature (28)..(28): n is a, c, g, or t
  misc_feature (118)..(118): n is a, c, g, or t
  misc_feature (166)..(166): n is a, c, g, or t
  misc_feature (201)..(201): n is a, c, g, or t
  misc_feature (222)..(222): n is a, c, g, or t
cttctagggactgggggctgcagatctnaggaactggagggaattcataggcactctgggttcaaatcttggagtaggttcgtaacccaggcattcacagtaggactggagattcttnggcaagggtagttggtttaagggatatgtgagacaggtgttgagtgangaggaagtaaaccatgacttggaagtttctagttngttggggagaacagccgatgnctttggactgtagggacatggagcttggttt

SEQ ID NO: 606335 - DNA, 1839 bp, Homo sapiens
taaggtttgacgggggaatgctggaaatggtaatggggtatggaaactttgtcatataacgtaatgctagggtgaggggtaggaagtttttccataaggcaggttgtctatcgagttgggcccgtcagcgggacctctgggggtaatagctggagtccggatattccataaaacacaccagggcagtgttaaacaatgtaaggtgtcttcgtggttgcaccaacaattattgttgttgtcaaatgtccacgggggaagaaagtgtggcgtctcacatatgtgtgtgtgtgtctccatagagaaaacgcacctgtgtgtagcgtggtgtgacagggtgtgtattttactatatatcacataaacgtggtctgaggtgttaaatgtgcgcgcgctatgtgtacagaacatatacgaggcgcgatacaggcggtgccccgtgtgagctggcagaataaatctcagcacgtgtattgtgacaacagcccctgtgtagagcacacttaacgtatctcgagaactctccccacatttgcgtgccaatggggtctcacacagagaggagaggatctccgagtagtgtggtggtctctccgtgagcataccgtgtgtgtgtgagagcactaattaaatctccaatatctctaaatgtggcgcgccacaagagggttgtccccacttgatgattgtggcgcacagggagaagtgctacactaactccacaagagaggcgctgggtaccacctatgtggtggtgctatgctgggaagacaacacaagaggggtggatgagaggaccacgacaggtgtttaacaactcaccgagtcgaagcgcccccacatctttataaattaatccaacgaaacaacatatgagtggtcagatcagaacatcaagctgatacacacacactacatcttgaaatattaggcagccacaaaaatcgatggtggatgaagcacacacttctacacaacatatataattatgtaagcagacacatttggagggtgaataggggaggaggcagaataaatcagttggctcctaccagacaaatgttttatgccgacccacctagaatatcccaatcgtgggagccaagagttacaaaactctatgtcggaggaaatcactagaagcagtgatgcagctcacaaacccccccaagtatgaaactaccacaagacaaagggaacttatgaggagtcaatcaacaaacacagcgaggcaaccataaggggccccaatcaaaaaagcgagtctgaggcgcctcacagcccaaacactaacaaccactacagacgagaagtgctccccaaagagcacatacgaaacgaatcatgaaacacacaagagagagagcgaaaaagagaccaaacaatagcgaaaaagaggagggagaaaacaaaaaaagacacacacaaacagcaaccacacaactggagacagaaaaagcacccaacaagcgagcatcacagaataaccgtgtagtcatatctatctaaaaaatgagtagtacacttcggaataactacctgtgtagtcactgacggcattatctatcacgtggagtgcccccccaatatcgtgtgagtcaacatcacacgaaaataaacaattgataggtcatcaagcagcaagacaaggagtgtatgcaggatacaaaccacccccaactgaatagaggcacgcacaccacacaacgcacgatatagagaggctagcaagctagtgcgggcatactcgtcaatactataatacacgcccactaccataacaatatccgtgcctcgctagagcacgacactactaaaaagtaaagcatagcgatagcgaca

SEQ ID NO: 606336 - DNA, 171 bp, Homo sapiens
tcttgagatcactgcaatctctgcctcccggggttcaagcgattctcctgcctctagcctcctaaggtagctaggactatagatcctgccaccatgcctggctcatttttgtatttttctttttcttttcttttccttatgttgagatggagtatcggctcttattgccca

SEQ ID NO: 606337 - DNA, 163 bp, Homo sapiens
tgtcatacaccgtgtgccaactctacgtttcgaatgaagaatttcttaatggcctagtccttgggtcacgcatcactgcagcaggttagtgcagcgaataggctgcacgtggccgcggcccttttgggcacgaccattgttccttcttttctttgtcatcttg

SEQ ID NO: 606338 - DNA, 165 bp, Homo sapiens
tgcttgggcaacacaggtagacccatatctctacaaaaaaaaaaaaaaaaaaaaaatttaaattaactggactggtgggtgggttgtgcccctgtaagtcttaagtctaactcgaggaggtctggagtgtgaaattggagcctggggtgggtccagggctggcaa

SEQ ID NO: 606339 - DNA, 397 bp, Homo sapiens
acagacgagcgaccgtaacgaacagtctaaaagagcgcatcccgtctatgtatgcaaaatagtgggaagatttataggtagatgcgacaacacctaccgagcctggtgatagctggttgcttccagatagaatcttagttcaactttaaatttgcccacagaaccctctaaatccccttgtaaatttaactgttagtccaaagaggaacagctctttggacactaggaaaaaaccttatagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctattagaactggctt

SEQ ID NO: 606340 - DNA, 118 bp, Homo sapiens
gcccagtgtgtggcatctctgccgcaattcggctttggccgtcactttcactcgccaccaacccccttctacctgcctaccttacacacacactaccacgttctctactggacacctg

SEQ ID NO: 606341 - DNA, 137 bp, Homo sapiens
ggcacgagcggcacgaggaggtcttcctggtttaaagggacacaatggattgcaaggtctggctggtctcgctggtcaccatggtgatcaaggtgctactggctacgtgggttctgctggtcctatgggccctgctg

SEQ ID NO: 606342 - DNA, 122 bp, Homo sapiens
tagctcggtacccctgaacttgacttgcaaagaaagactgtgcctgcctcagcagctgcctgaagtacccatgtgacatattttggaagtgcagggcatttggccattgagtgttgggaggg

SEQ ID NO: 606343 - DNA, 696 bp, Homo sapiens
  misc_feature (478)..(478): n is a, c, g, or t
  misc_feature (489)..(489): n is a, c, g, or t
  misc_feature (548)..(549): n is a, c, g, or t
  misc_feature (616)..(616): n is a, c, g, or t
  misc_feature (620)..(620): n is a, c, g, or t
  misc_feature (663)..(663): n is a, c, g, or t
gggctgcaggttttttgagacagagtctcactctgtcacccaggctggagtgcagtggcacgatcttggctcactgcaagctccacatccccagttcacgccattctcctgcctcagcctcctgagtagctgggactacaggggcctgccaccatgcctggctaatttttttagtagaaacagggtttcaccatgttagccaagatggtctcgatctcctgacctcatgatccacccaactcggcctcccaaagtgttgggattgcaggagtgagccaccgcacctggactgtttcctgactttttaatgatcgccattctaactggcatgagatggtatcttattgtggttttgatttgcatttccctaatgaccagagatgatgagcttttcttcataagtttcttggcagcatgtcttcttttgataagtgcctgttcatatcctttgcctattttttgaggcaggtatttactnttttctggttntgtttaagttgtttgtagaccttggatatttagcccttgtcagatggacagattgtttnntctccattctgtaggttgcctgtccactctgatgataagttcccttgctgtgcagaagctctttggntaantagatcccattgtcaatttggcctttgttgcattgctttggtngttagtatggtcttccccatgcctatgtcctgg

SEQ ID NO: 606344 - DNA, 1116 bp, Homo sapiens
  misc_feature (853)..(853): n is a, c, g, or t
atgggtgatgcggtcgcatgtaagtctctaagcatagatcgactgagttctcgcctatacatagaatgagctttatctactcttacatgatcgaggcgcatctagtagatcgatgtatacctttatactgactatctctcaagtccttggtatgaccctatgtgccgtaatccaatctacaacaaaacactacctaaatgacttatacgattcttcatgacggtctcgagagtccattaggcatcacgctgtacttgaacttaatcgctttgtgccgaacatctatccatagttctctcgatcgctccatgcccatctccattatgctatcacatttgagcgataactagaaagagagataacgatactgttcctcgttaggcattcatagatccaattgggcccttcccaccagtcgtgtgatcatgaaaccgctaacaggaagtcacgcacgcatatactgcgtgagaaggaagagtgcttttcgacactttcacgtaccaattacttttcactccctacttattgcagttagataccccaagggctgcagcctgtcgcacatccgtgtgcatcggtgagtccacatcgcagtgagtcccatctcgcggatggagagccctcccatgtggttcttacatacatttaccaatacatcatcgacgtctttgcactacattgagtttgtctgtacccttgaggttgaatccgcagattgcgagtttcgccgctaggtcatagggcactagcagatgacaacgcgattagacgaccgaaggtattgctcgagcaatttccttggaaatttgtgcgaggtaccacagttcatggcatcgtactaagattaagtgcnctaaaaattttgaaataagtggcgattaccgaaatagaagcttttaagggatttaagtcgggaagttgactataacaattttgggggggaagtcagagagtgtaagccaactggttgcgggccaggggttgtaatgaaagttcgaggaattgggggaatgggacacaaaaaaacgggggagcagtttgacaattagtgtgtggacagtcgagtaaccgaggaagaagattaaggagaagatatagaggggggatacagaacga

SEQ ID NO: 606345 - DNA, 147 bp, Homo sapiens
cgccggtccttcgatgggcgggcacttagaggtggggagcagagaatctcttatccaacatcaacatctgggtcagattgaactcttcaatctctgcactcaaagctgttaagatagttaagcgtgcataagtgcccgccaatcgaa

SEQ ID NO: 606346 - DNA, 1018 bp, Homo sapiens
ctgctttctctctggctctctgtgctgtgtttcgtcctgttgtgggtgtgtgtcggggtgttacttcgtgcgtgcttttgctagcttgccttggctcaactctggttggttttcttctgttatctccatctattgtcgcctgtgtgggtggttccgtttggttgaaaagttggggcatgttgggccttcgtggttccacgttctcgcgctgatgccactaccatccccttgtccaaacgtgatgtgcccttttccacagggtgccactcaagtcttgagttgggtgtttccctagatctaggcagtcaatggggtattcttcccaaggagttagaatgggcatcctcaatcctttccgctttcatccagctgggatatatgcattgcgtacgccacgtgacatagatcaattaagacgcaggctttcccgtattagtgcgtaataaacaaactttggggctgttgggtagtgtgtatattcttcaggatatccgatgggtcattacagtgtcgtcgaactggtgtttcccacaatcactgctatgtatgtctctcctagcgctgacaatgcccatgtttggcgattggcagcatcgctcccagatgggctacactgtcggtgccccatgactggcaattgccatctattcgcttgatagtgacctccagagaccagcttagttaggaagacgcaagtctcacccatagatggagtggacactgaggcccccgagatgttgtcctccggtgtccaatgctcacatgcggtctggctgcttgggaatgattggccaggaactggactcactatccatttggcacagttaggctaatcctggttttatgtgaagtcagcaattaagtgttcccactagaactgacctaagccactgatgaatatttaatgagggaaggtaggggagaatctatgccattgtctataatgccaggaaatctatatatcgttatctgatgccatttttcctgaagtagcctatacgtctgcggcctgcagttt

SEQ ID NO: 606347 - DNA, 331 bp, Homo sapiens
  misc_feature (42)..(42): n is a, c, g, or t
  misc_feature (71)..(71): n is a, c, g, or t
  misc_feature (148)..(148): n is a, c, g, or t
  misc_feature (271)..(271): n is a, c, g, or t
tctgtgtcataaataagtttaaggaaaggtgctgtgcctggntgtgcacataggccagatttatgtttgantttacacagacatctcagtgcagtaaagagcagtattgccgccagcaggtctcacttccagccataaggcagttttntcctatctcagtaaatagaatatatgatcaggttttacactgagacattccattcccagggacaagcaggagacagatgccttcctcttgtctcagctgcaaagaggccttcctctttcactnaatcctcctcagcacggaccctttatgggttgggggctgggggatggaggtctttccttt

SEQ ID NO: 606348 - DNA, 657 bp, Homo sapiens
  misc_feature (212)..(212): n is a, c, g, or t
tcatagaactgtcactcagtaatgacacagtatatgtgaaagcaactagaacacacctccgatatataacagaatataccaccatattatctggctactttcaccatcacaagtgcattatcatatgtggatttttgataacaaggtgttgaccacgattatatcttcatattattgcctttcccctttgtaaatttttttccccataaatngctggcacattacatcatgcattaagaaatcatgtatggactgtgccctcaaaatacattatctatacaggtactaaaccatgacattctctatcatattatataccagggtagcatatcttgtttctgtacaataatgactgtattctctcaccattaggacttaaactttgtttctccagtggcttaattcctgttcctttgggtgatcactagcacccatttttgataaagctggttctacatggggggatagctgtggaatagatcattcgctgcatgttaattaattctcatgaactaagcctgtgtcagtggttctcacggaaagtataccttttatcaggagctcattcccagaacctggatgctattacacatgcttttaagaaacgtccatgtatattcttttataactctaccactttggggcaagctaattcag

SEQ ID NO: 606349 - DNA, 178 bp, Homo sapiens
acatacagtagacttaccttctgtagtttttaattaaacaactttaaagataagtctacattaaacaaatgatcacatctaaagctttatctttgtgtactctacgtatatgtgagaaatcagaattggccatcaacttgtcttcagttgatattccacaggcatttccacagtcaat

SEQ ID NO: 606350 - DNA, 239 bp, Homo sapiens
cctttttccccccccccccggtttggggggttttgggcggtttaaaaagggggctttccccccctttaaacccggggggttttggccctaaaaagttaaattttttagccccaagggaaaaaccccggggggagttttttgcccccttcgggttttacccccttttggccctttttctttggggggcccccccccccccccccccactcccggtttttttttctttggcccaagggggg

SEQ ID NO: 606351 - DNA, 263 bp, Homo sapiens
gggttggggagggaaaaaagtttttagcccaaatgttttacataatttgttcccaaaaaaaaaaaaggaaaggaaaaaaaggggtggcctgaccctggtggccctactaagtgtgtgtttttttaaaaaaaaaatggaaaaaaaaaagcttttaaactggagagacttttgacaacagctttgcctttgtattgtgtaccagaatataaatgatacccctctgaccccagcgttttgaataaaatgctaattttggatttgga

SEQ ID NO: 606352 - DNA, 821 bp, Homo sapiens
catgtacaattgacacattaatatggcagtacagagaaaaggagttgcagatatagcctgactgctgtgggacctattgttacatgatgacaagagaagactttatgtgacctgtagaagaatacccagattttaattatgttgggaagaactacctctggacctagaggacttagcagccaaacaacttgaagcagaaagcggatgtcaaatcatggtccgaggcaaaggctcaaatgaggcgatacaacacaaaaggatggtagcacaatagaggcaagcccaattgggacgctatctacaatgacatgatttcacagtgtgactcacatcacatgtgtgatagcatgccccacgagacagtagacatgaaactcaacattgacagtagatgcagattgcaagaacgtgacagacacattagtcggtacctgcagcagaaggcagacagacagcctgaagaagatgcacgctgatggagcttgcgattcgtgaatggcacctactagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaagtgctgcacatagttcctccaggggccgaaggcttggttaatctatacaccctatgagtaccccgtacacattggcaacaggtacatcaatccttgaagtatcctatggaaccta

SEQ ID NO: 606353 - DNA, 199 bp, Homo sapiens
cctatcactattacgaaccaagtaaggcggctggagcgtgaatccccaacgctgagtgtggggagccatccctctctagcaaggtggcaatgatggagggaacttgcatgctaagcattcaggatgccatgagggggacaccagggagcactgagccagtgctggagcactttccctgcctctgccattgggcccagcg

SEQ ID NO: 606354 - DNA, 247 bp, Homo sapiens
  misc_feature (32)..(32): n is a, c, g, or t
  misc_feature (55)..(55): n is a, c, g, or t
  misc_feature (79)..(79): n is a, c, g, or t
cgaggaatcttccgagtcctatttattctttnaaactttggcaaactggtccttncctcgctgggcaccatagctgtgnatgtccatttactggaaaataaaattaatggcaattgcacaggcattaaaatctacgtttctgacgatggcaaagctcatttttctattaataactctgctgaggatccatttattgcaattcatgctgaatctaaattataaaatttaaaattaaatgcatatcctc

SEQ ID NO: 606355 - DNA, 142 bp, Homo sapiens
gctatttctatgcaattagaaatcagcacattcctcctacttccctttctccacttcccccatatcttaaaaggtgtggaagcagaaaggacctcattttcctacatgaggagctgacataggggaaaggattggatacgaa

SEQ ID NO: 606356 - DNA, 416 bp, Homo sapiens
agaatgtatagaacatcatcagtaattacacctgcactgtgatgtggggtactatgggcccagtgtcagttcgatgattcacgtgtgagcctttggtaggccccagcacctgggctaccactggactgtactcactctttgggaaacttcagcttcagcctcacagtgtgccttcaactagcactgaaggaacaaacttaactgggattgaagaaaccacctgtgcaccatccggaaactggtcatctccagaaccaacctgtcaagtgattcagtgtgagcctctatcagcaccagattcggggatcatgaactgtagccatcccctggccagcttccgctttacctctgcatgtaccttcatctgctcagaaggaactgagttcatcgggaagaagaaaaccatttgtgaatca

SEQ ID NO: 606357 - DNA, 368 bp, Homo sapiens
accccttctgtattctccccagtaatccgctgtgtattgttccaggagcaccagtggatgtctgaaacctcagacagtaccgaatcctattgccatcattcacaccatctttctgtgcatctaccaccttgaaattgtaattgccttttccatcttaactaagcagttacacacactgtggtcataacttccatagcttgaggtacgacagcgaaactccatgaatttcttttatcttcctcacaatttcatggcacaagattcatttttaccatagatcttagcaacctcagcgtattattttctttccttatttagttgagaactttcaccttttgacttccagaaagcactttatggcttctctt

SEQ ID NO: 606358 - DNA, 1412 bp, Homo sapiens
aaggaaaggtaccggctctactgccacctcttccagctccacctgtctgtgtgcaggcacgtggaacatggcacaaggcaaatggaggctcgggagattcagccgtgaacgcacagttgcagatagatggcctttgtggtactcaaactgataatcaaacattatcaagaaagaaggacaagggaacgtgaagttgttcaaggagttgcttattgggtctggttgtagaaagatcggcttgaaattaccaactgctttcctttccctcagcacacagaggatgatgctgacctttgatgaaagtccaaatatcagatggaacatgatgcgggagccttgcgcacatggtacaccattggactcattcttacacgttgggcctgggtatcaggtcccaacaatacctaagtggctcaatgcgttaacccccgggggcgactccctggggaacttctccaagtctcagacgttcaccaagccatggccatttgagacgaatcctgtcgtaactccactttagtgatccctattaaagacgatcgtggcccaagagatctctctacaactaccgcgccgcaatcacaagcaccgtgggactactcataaaacgctggacttgccgacaacgttgcgctacaccagcacaccccaggactttttacccctcgttaagacgcgactttgacaacaacacgccaaaaatacttcacccgttttggaaggctaccaattggttctggcaaaccaacagtgccccgcattcgggtatcacatgtcacaaacagtgtcacacacttctggacatcacaacctgtcccaaacagtggtggacgccaaccgttcacaacaggaacaagctcgacacgtggttttgccagcatatacaacactttgaaatttgggctcccacaccttgtgacaatgcaagacaacactcaatagtgcggcgacaacaaatatctcaacaagatgtacgtagtcggcgcaacaaaaaggagcggacaacacaaacaagggcgcacccaagagaataagagatgttcaaacaccacgacagcaccaacataccatggaggggaaacactcactgcatgtgacccaacccacgacccgcgggcgaccgacaaagacgccgaacaaacagaccacaggcggcagccaagcacggcggaacaatataagaaggagaccagaagagagggagagaaaaaacccccgcctcaccagtgagaggagaagcagatgccaaaaactattataaaacacacgaaggagctgccgagcagagagagcgcgagtccataatgtgaggaccgagaaaaaagaagcgtgacgagcagaggaggaggtggccgccagcaatcaaagagcgcgcagcgatcaaaagacagcaggaacgcgacacaacagaa

SEQ ID NO: 606359 - DNA, 555 bp, Homo sapiens
tatatttctatttaagtagagatggggctcactatcttggcctaggaaggtctccatctcctgatctagtgatctgcccacctcagcctcccaacagatgctgggattacaggagtgagccactgtgccgggtttgagttgaaatcgttacagctttatattttgtgtcttatgttttgtgttctcatgagcaatagtggtatattagagatggagtcttgctctgtcgcccaggctagagtgcaatggaaggatcgtcgggtcgactgaaatctctgcctcctgggtccaagctattctcctgcctatagcttcctgattagctgggatgacaggtgcgaacccaccatacccagctaatttttatcttttgagtagaggacagtgtttcaccatgtcggtcaggttggtatcctgacctcatgatccacccacgtcagcttcccaaagtgatgggattacaggtgtgagccaccgcgcctggggccaatttttggtattggcagtaggcagtgtaccaccatgttagcgaggatggtctcaagctcctgacct

SEQ ID NO: 606360 - DNA, 286 bp, Homo sapiens
gtttggtgcgcggacccagctatgtaacgatgaaccatggtcattgctgtgtcctaggagatcctgctcatgagtagtgcattggattcctcagccaataatagactgcccggtggctaacgatcgttcttgaacaagctccacgatgagtgtcactgatgagtcattcactggattctatcaggcatggagtccaaggcgacgtgcgaatattgacaatttacggcccacgggtcgtgattgactacttctggtatgtctccatcctacttgatgaagggtcgtc

SEQ ID NO: 606361 - DNA, 401 bp, Homo sapiens
tgtacagatggtcgagtatagctgtttctgagttgtaaaatggacggggagatataactggatgcgctgtattgtaaacggagggcgagtaatagctgagcgctgtttgtacctaggaggcggagggcaagcggagggcggcacatatcagtaggggaggtctaggcggacggatcacgatgtcaggagatcgagagcatcctggctaacatggtgaaaccccatctctactaaacatacacacaaacttagacggacgtggtggcgggcgcctgtagtcccagctacttgggcaggctgagcgcacgagactggcgtgacacctgggcggcggagcttgcaccgagccaagatcatgccactgcactccagcctgcgcacccaagcacgactctgtctca

SEQ ID NO: 606362 - DNA, 108 bp, Homo sapiens
agatggcttcttgccagtttgagcctaatctgatctacaggtttacctcttggaccaatgtaaaggttttttaatgtgaaatgattaaatgctcagtgaggctatctg

SEQ ID NO: 606363 - DNA, 279 bp, Homo sapiens
tccctccttgttcttccttttctcttttcttttctcttctctttttccttccttccttccttccgtccatcttgctctgtagcctagggtggagtgcggtggcataatcatggctcactgcagcctcgacctcccaggctcaagcaaccttcctgcctcagcctcccaagtagctgggactacaggtgcacaacaccatgctctgctacttcttatcgtaaagagaagatagggtctcaccatatagcccaggctgatctccaactcctgggctcaaat

SEQ ID NO: 606364 - DNA, 789 bp, Homo sapiens
gccctttggcacgaagagtgggtctaaggtgcccagggcccatccctgctgacagaacttgtttcgcggttctcagcctcggccagcccccggacagccttcgaggacccatacccaagtccttcctggtcagcgcagaccatggcccatctggcatcccgactacccggacaagcatgaggagaacccccggcccttattccccaagggccccgtgatccaggtgaccgccagccacgctatgcttccaaccgcggtgtcagaggccctgatccgagaggtggcccaccaagtcaaggtccccctgccggatcgtcatggtcccggaatgaccacccccccgtgggaccccccttggacctatcttggcttttcggctggggctgcgggtgctggatttaggcccgccccccactggcccatgccactctatcccgggagatggcctgcaccccaggagtcctcccgaccctcaccctcttcagggcttctttgagctgttcccttctctaagccctaatctcttagtggattgagccctcttggaaagacttctctgccactccccttgcaacctgagaggggaagttttcacgctgagctgaagctggattatttaagtgggttgtcaacctcagactttccgtgctacgcttatttggaggactagaggagatgggaattgagcctggcttgaacctttggaacccagaaaaagattggggagccggtggaggaggcccaccctcctgggagactgatggttttaaatctggttttaaatttcca

SEQ ID NO: 606365 - DNA, 107 bp, Homo sapiens
tagctcaccttcacgagttcccttgtcaaagcgcactaaacgtctcagttcgagcattcagcaaacaagcaagcagagcaacagaaacgtacacctgattttcatga

SEQ ID NO: 606366 - DNA, 211 bp, Homo sapiens
  misc_feature (40)..(40): n is a, c, g, or t
  misc_feature (109)..(109): n is a, c, g, or t
  misc_feature (111)..(111): n is a, c, g, or t
  misc_feature (122)..(123): n is a, c, g, or t
  misc_feature (154)..(154): n is a, c, g, or t
  misc_feature (182)..(182): n is a, c, g, or t
  misc_feature (185)..(185): n is a, c, g, or t
  misc_feature (199)..(199): n is a, c, g, or t
ccaatttaaaggccaaattttttttttcccaaggccctgnttaaagggggggcttccgggggttaaaaaatttttttggtggtggttaccttccttgccaaaggactananggggggtaacnntaaaggtggatttttaggggttccccaaaangggaaccatctttttttttgaaggaatnaanaaaccatggttttngaaggggctgga

SEQ ID NO: 606367 - DNA, 127 bp, Homo sapiens
gagtgtacaggtcggtcatctgtgtccctaccagctacaacagaacagcaagtctcacccgtgtgtgtttgttggacatcaattcacctattatggagcgtgccgtagggcgcactggcagctcatt

SEQ ID NO: 606368 - DNA, 356 bp, Homo sapiens
gaatatatcaggctgaggcgtaactctaagaaaaaataatatttttgggcagggcgcggtggctcatgcctgtaatcccagccttaaaactttttttttttacattagctgagtgtagtgggtgctcgcctgtagtcccgtctactcaggaggctgaggttgcagtgagctgagatggtgccactatgtcccagccgggacaacaaagcaagatcctgtcttaaaaaaagaaaaaaaaaggagaaggggtagagtggcctatagcagcaaagggagatggtctacctaattagaagaaagtgaaagatttcaaacaaattaattaaaagaatctacaagggaatacaagataataa

SEQ ID NO: 606369 - DNA, 309 bp, Homo sapiens
  misc_feature (38)..(38): n is a, c, g, or t
aaggaagctggtagtcatcggtcgtctcggtccggccnttgcccaacgccgccaagaaactgcgcgggctgacctggttcaaaccgtcctgcaaatggttgaccaaccaagtgtaaggcttgccccgtttgatgctgctgcccatcgccttacccgcaagacgctcgaaaagagcttcctgacgatcttcatcttggcgcaggtcagaaggtacggcccagttcgttcctgcgttcgtcgtcgttgctcgactccggcccacccagaccgcaaagtgtttgtgactcacaggggcattgccgtcgacgc

SEQ ID NO: 606370 - DNA, 328 bp, Homo sapiens
gggacagtccgccgaggtgctcggtggagtcatggcagtgccctttgtggcaagactgggacttggtgcaaaccctgggcagacaggtgcctcatggagcaagttcaacttgctgtgcaatagcagtaactgaagcaagcagtcgcagtgaagattgtagatatgcaagcgtgccgctcagcactgtcccaggaacaatattcaagcaacagcagcatctggtatccacatcacacaaatgctcacaatccatgcaaacatgtcagataaagattctcatgggtccaccaggcagcagcacaggcgaatcatccgaatcattctcatt

SEQ ID NO: 606371 - DNA, 312 bp, Homo sapiens
cgcggccgccgacacggcgcgagaagacgacagaaggggggcgtggtagtcacgcctgtaatcccagcacgggaggctgaggcgagcggatcatctgaggtcaggagttcgagaccagcctggccagtatggtgaaaccccatctctactaaaaatacaaaaatcagctgggcatggtggtggggcgcctgtagtcccagctactcaggaggctgaggcaggagaattgctcgaactcgggaggtggaggttgcagtgagctgagatcgcgccactgcactccagcttggcgacagagcgagactccatctc

SEQ ID NO: 606372 - DNA, 1337 bp, Homo sapiens
gattccagtcctgagcggttgttctcatggagcagcgtacttttatctccgtccgacttctctcctacctaagtgcgtgccgacaaccgatggaagatacgatggacatggacatgagccccctgaggccccagaactactcttttcggattgtgaactaaaggccgacacagattatcactttaaggtggactcactgatgaccactgagcaccagttatctttacgaacgcgtccagttcaggggctggtgcacaggatgagtcgcacacttgtagaagcagagcgcggatgcaattaccgaaggcagtcccacttacacagtacaccactgcgcaactcttgcaacaatgtctgtacagcacaacaggtattcccattgggtcggcatctcggaaataacacacaccagctggtctttaaggtctgacagtgtgcgttcacgggcccacgtgcatataacctgcgacagcaccttacgtagctgtggcacgggcacgaactgcacagacgtccacgaacgctgacccacggcaggacagcgctcgcgacacacacctctacagtatcatctgcgaacagcgcgcgacaggccccctgcccacggctgccaacaccacaggtaccaccagagaacacagtaaaaaccctgcctgccatgcatgcacagaatgcatgaccgcactgactggctgccaccccggcatgcccgccgggcgactgccagacagcagcaagaacaacacgaaggacgcaacgacaacaccacaagacaacaagacacacacgaccacacaagcaacacgaacacacccaaaccacaaaacgcgacacaacgcgccgaaactcgccactggcagcagccacaccccacccgcagaccagagccccaccgcaccaggaccaccaaaaaagcaacgacacacaccaccaaccgcacaaggcgcccaccccgcaagcgagagaccggcacgacgccgccgcaccacagccggccttaccgccaggccacacacaacgccacgcagcgaagcgaagccgaccggaagaccgccggacacgagtcgcgaagaaccaaggagagacacgccgcaagacgaccgacacggcggcccaggaggaacacaggccggcagcaagacggcgaaacggagacgagaagacagagcagggagcgcacgggcgaccgcgggcggcaagacaggggccagggcaaacgaacaacccgaacgagaacaggaccagaaccggcggcgagcccacacccgacgggagagcacgcggcgacacagcagcaccgacgccggaccgagaagccaaccgacctgcccgaacag

SEQ ID NO: 606373 - DNA, 418 bp, Homo sapiens
gatccctatctctactaaaaatacaataattagctgggcatggtggcatgcacctgtagtcccagcttctcaggaggctgaggcaggagaatggcatgaacccagaaggcaggaggttgcagtgagctgagatggcgccactgcactccagcgtgggcaacagtgttagactccatctcaaaaaaaaaaaaaaagaccttttccttgactacccttgttttagaattaacaacttcctgtgctccaagcacttaccagttcccacttttcacttactttatatttttcccgtggtagttattttcaccattctgagattattagctttagattacagattttagattatttttctttttaaattcgtgttaacttataacccttactataaaattgttagagccatattttaaggcct

SEQ ID NO: 606374 - DNA, 318 bp, Homo sapiens
ctgtcgaagagtccgttgttcgacgagatgatgagcggacgctggaggccatctgcgagcggctgcgcccagcactgtatacccggggcacacgtctggtgcgcgagctggaccccgtggactccatgctcttcatcatccgggggtacctcgactcatacacgacgcagggtgggaggtctggtttcttcaactcgtgccgcattggagcaggggagttctgcggagaggagctcctgacatgggcgttggacccgaggccctccgagtacctgccgcggtccacgcgcaccgtgcgggcagtgtccgaagtcgagg

SEQ ID NO: 606375 - DNA, 100 bp, Homo sapiens
cagggaggccaaccctctccaacagtacactaggtcccatcccttctagcagagacaaggacacccacggtaatccttccctcatcctaaactcatcact

SEQ ID NO: 606376 - DNA, 217 bp, Homo sapiens
atgcaggatcccgaggcgagcgatgccaacattgctactgtgcaatagcttctaacacggatgtctagtaatctgaatactttatggggttatatgaaaatgtgctttcaatgttactaattaatagatctttagaaagggttgtatctttatgaccctatattaatttcctcaaggcatcaactgtcattagtaaaaagattacggaagtaaatga

SEQ ID NO: 606377 - DNA, 937 bp, Homo sapiens
  misc_feature (937)..(937): n is a, c, g, or t
gagctggtcgcggcggagtgctgtggagactcgatgtggtgacagcgaaagaacgataacaaaatgcctggagcgagatagtgagcacgttctcacaatacctttggcccccgtatggcctactgatgtggatgatcctcacttcctgccacacaatcaaaactcaccaatgaagacttcaggaaacttcgtcgatgtatccccaaggctgggcctacctctgaccagcttctaagtcacgtcaccatgagatgccaagggagtacaatgaggatgaagacccagctgcgacgaaggaggacccctagaagaacgttattatgccaagcgtacgccaaccagacatgcgagagagagagagctagtcaagagaagtaccgggatcgtcgccaaggaacggagagatggagtgaacagagattatgaagcaaagcgagcttatcagcaccacgagctaacatatcgggctgtggggcccccactgcgtgaggcggacaaatcagtctgcgggagaagagaagacagtagatccaggaggtccaaaattcttgggtggtgacagtggatactacagtccattggtgaaaggcttggactttgcctctgcttcaaaaggtacgagctgagattgccagtcaagagcaggagaaagagcagtggtggaaaggcccagaaggtgaacgccagaaagcaggggatcctgacgactaagtcgattggaacacgatggggccgaaggatgaacgaatgctgatagagcaaagcattaaggcggaggagtcacacggcggggcctaggtaacggcgtatggctggaagagatccactactgaggagaccccgagcaccggacagatatagggccaatacgaggcccacgccatagggagaacggacaaaagcccaccagaaataggcaaggaaaacgcacgagcgn

SEQ ID NO: 606378 - DNA, 161 bp, Homo sapiens
gagtagcccaatcgatgcctaatgagctacaccaccaccggggcacatgtcctcaggttcctgcagcaaagtaccaccggaacttcttggtcaggtgagcttggaacttttcatgctttctttctcagggctggcatccacggacaatgctgcaggcatga

SEQ ID NO: 606379 - DNA, 1389 bp, Homo sapiens
  misc_feature (370)..(370): n is a, c, g, or t
gcccgactaactgctcctgtggatgcgcgcggtgcagatccgctgcgccgatcgcgatctgctatcgcaggcttgagataggcgcagggcctgctgccatcagtgcatctggactccgcttctacagcctaacaagctcagaaacctcgactagtagaccacgctttcctagctctccgtggcgagcactgcatccgaaatcggttggcgctgttagcactacttccgatgatcactgggctgtaccgtcctggcgtcgagtacgacgtgtggggcctcactactctgtgagtggcatcactccgcggtgctacgctccaactcgttgccaagacgcgcggtcgattcgatccataatattgagtacctncttcatgggtagctgcacatgctattcgtacccgaggtacatgcccatcggatgagtgcgtccactcccatccttgtgagcccgtggcagcactcgaaccgcgtcgagtcaagaacactctctggtgtcgctggggacagaatctctgattccgaaccgtgaggcaaagccgcccctaggactgaaaccgtggaactgtcgacaagggccattacacacctctgcattgcagacctcatgtgccgcagttctgccgaagcctcaggacagagctcccttgctgatcaaccgaaaagccttgaccttgcggacacggggaatgctcctgctgctccatcgcactacgtagaacaccacacgaccctcccccccagcaggtccgcacaccagcctactgcgcccctgcaatccctcacccatcgcccccaccgccactacccaccatgcccccgcccaccccctctttgccccgcacacttcactgccgcatagcccccaccgcgcacactaaccccccccccccaggacgccccacagcgccctgaccaaaccctacatcacccccctgcaccccagccacaccggccctcctccccccccccgccgcccgcaacccacccccaccgcgcccgccgacccaccagcccccacccccgccaccccgcccccccccacccccgcccccccccacacccccccccccccccccccctccacccaccacgccccccccccacaccccccccccccaccccccaccccccacccacacccactaccacaccccctccaccctccccccctcccctcaccccccccctccccccccccccccctactccccaccccccacccccactcaccttcctctccccccacactcactacccaccaacccacacccctccccaccctccacacttccccccccacccccacccccccccccaccaacccccccccccctctccactcccccccccctcccaccccccactcacacactcccacccccccca

SEQ ID NO: 606380 - DNA, 777 bp, Homo sapiens
  misc_feature (35)..(35): n is a, c, g, or t
  misc_feature (75)..(75): n is a, c, g, or t
  misc_feature (97)..(97): n is a, c, g, or t
  misc_feature (99)..(99): n is a, c, g, or t
  misc_feature (150)..(150): n is a, c, g, or t
  misc_feature (159)..(159): n is a, c, g, or t
  misc_feature (190)..(190): n is a, c, g, or t
  misc_feature (212)..(212): n is a, c, g, or t
  misc_feature (215)..(215): n is a, c, g, or t
  misc_feature (233)..(233): n is a, c, g, or t
  misc_feature (257)..(257): n is a, c, g, or t
  misc_feature (312)..(312): n is a, c, g, or t
  misc_feature (318)..(318): n is a, c, g, or t
  misc_feature (388)..(388): n is a, c, g, or t
  misc_feature (394)..(394): n is a, c, g, or t
  misc_feature (396)..(396): n is a, c, g, or t
  misc_feature (398)..(398): n is a, c, g, or t
  misc_feature (470)..(470): n is a, c, g, or t
  misc_feature (481)..(485): n is a, c, g, or t
  misc_feature (630)..(630): n is a, c, g, or t
  misc_feature (683)..(683): n is a, c, g, or t
aaaaaataaaaaacacttcaccaaatccaaatganaccaaatacagatctacatggggatcagaaatgactccancgaattatcaggattccataantntatgttttataaaaccagaaatcaaaaaaaaaagcccaagttcatcatganaggagaggncccacgacagctcccaggactctgctgaagnccaggcaatgctaacagtctgngantccacatttacacaatantctataaagaccctcggtccactncgactattcaagtatatatcgattttaaccgagcccatcaccactcctttgcccnagtcanctgtgtcacagctaccacaaagctgtgttacagtcatatttagcaattttacaatcataatactcctttnaaaccntncnggggggctttaaaaataaaaaaaaagtaaactttgttaaagcgacactgaggctctactaaacccagaagtnaccaagtacannnnnatgtataaatacaacttacaagtccatgatttcccatcgtcccccttccttgtacgaaagcagggtgaggaagtacaaagcagagcttttagattagtctctcgtggagatcggagctctcagctgttcctttagcttagctctnggtatatatagtcagctgtactttgttctgaaagatatgttaaatgccacttntatatacacttggagctttacacctgagagtgattatcaagcagtcagcttatctctcttcaaacatttcatatagacatacacacacctctgc

SEQ ID NO: 606381 - DNA, 155 bp, Homo sapiens
cgggtgcttccacccgttttccctaggccttgggtctcaaggggcaccaccttggctctactgtcaaccgctcgcgctttccagggtttcagagccaaattttctctgtccttagccctttccaagggagccggtggcacattcaggccacaagt

SEQ ID NO: 606382 - DNA, 1159 bp, Homo sapiens
agcgggtcttacctcgttgtggcgtcagaaccgacgtcgactcgctcccttctcggcagtggtacctgttcccggtgatccctgagagtacgttgcgggtcaggtacggccccgaaagtacggaagcggacgggcgagcaggtttgcgggtccaagtgttagcggagtacggcacctctacagtcgtagcaagtcgcggagggagtgatgactgcgaggcataggcccatggacgtaatggagtccaaagaggaacgagctgttaaacaagatctcagtcgctggagacaaatgtcaaccatggaaacctgatgaaggcaagatgaaaaggcgagcaagattgcctaattaacgcgggaagcccttatggacccataaccctgtatgaactgctctactctgacacgtacatgtgatggcctaagaagggaaaaaccggctaatgctcggtttcccagctggtatcatcggtcaaggccccatatcccttgacagttacattacgactaggcgacgattatatagccgcttagcgctttgcgagaaggccacaaggggctacaaggtacatgaacgaagcatgagcaagctattggcatcaagcgacttgcggcgcacgtaagggttgaaggaaacaaggcattgtacttagcgacagcagaacgccgttgcatggcgctacaatacacgccaaggctcctgcagcttccacctaatggatccattgtcggagcgccaatggtcacaatgcccacacgtggaagttccccgcgcgatacagctccaatggcaccgcaagtccacaccggaacgtggaacgcttattaggccctttaattgacccccgtgtaacattcccttgaactagcgatattccccccccttgacagaccgttataccactaacggcggggaacgaacgccccctattggcgttatcttccgctgttaaagaaacgatattaccgagccaactttattcgattgacggcttggtttaaccccatatatagcgacccgtaaagacacgctggttaacaataagaactttggtttaaccgcctatgaggctctacaacttataggttatgagggcgatatcacttccacatttaaattttaccgccacagacattattcctacaaacaatatgagaag

SEQ ID NO: 606383 - DNA, 128 bp, Homo sapiens
agctcgtgatcacagtggcactggagctatggaggacagacaagccaagtggacatcccggatcggcctagcaagtctcgaggaaatggtgcatctcggtgaacacaggagtcagtcagcagcctcca

SEQ ID NO: 606384 - DNA, 130 bp, Homo sapiens
taggggaaggtcacttcagtatgtatataaatgaatatcagtcacagtatttagttgtggaatacctataaaataaattgattagatgatgagcaggggtaggcaactatagcacactgaccaaattctg

SEQ ID NO: 606385 - DNA, 951 bp, Homo sapiens
  misc_feature (43)..(43): n is a, c, g, or t
agacaatgcatgcagtgctgacatcacgcagtactatcttggnatgccaccacaatgggacatgttctgtgtgtgtatggctgtggccttgagtgagtattgaacgtgtgccattagctgttttgtgtgacacttctggactgcactggtcatgaacatcgcagagcactacatggcttcctgacgtcgaatgggatcctactgggcgctacgtcgtcacctctgtgtcctggtggagccataaggtggacaacgcgtactggctgtggactttccagggacgcctcctgcagaagaacaacaaggacctgcttctgccagctgctgtgtgcggccccggcctcccacactcctgagccaggaacagatcaagcaaattaaaaatggatctgaatgaaatactctaagatcttttgaacatgcaaggatctgttctgagtccagtcccaatagcctccaaagtgcacatttgggtgtgagcagaagtgcgccaccatgcatggccagcatttcctgtgcaagtcaccggaaaatggcccaggagctctatatggagcagaaaaacgagcgcctggagttgcgaggaggggtggacactgacgagctggacagcaacgtggacgactgggaagaggagaccattgagttcttcgtcactgaagaaatcattcccctcgggcaatcaggagtgacctggagcactgtgggtacggactccgcctgctgtcccgtgctgagctacagggactcacgagtggtgagccgtcggtcctctgagtggcagagcacaccgatgtctgatttggatcccgtaggccgaacatgcagggaaagccatggtgactacaggcttctaccatgggcacatctaggactcggacttgtactggtcatggaaatctggcaatgtgaagaactataggtggcctcaagccctggcgtctcactggg

SEQ ID NO: 606386 - DNA, 329 bp, Homo sapiens
cgagtgagcccctgcccgagtgcctgctgggggatgaggccgcgtatgcgggaccgagaagtgggctgggatgcagaggtcgcggaggtggcgagcgaggccggggtcccatggcgtgggacctggcagtggcccgggagtggcgggcagcgccaggaatcagtggtgccgggctgagggagggggccctgcgggttggggcacgtggtggcccggggaggtgaggtaaacagccctgcaggcctcggggcaccgttgctggtgcggcgccggctggcatgtgcgagggcccgtcccgcatctcggggcccatccccccagacctgacg

SEQ ID NO: 606387 - DNA, 157 bp, Homo sapiens
tgacagtgatatgggtctgccaagtgcttccccttcagtacgttcccattcatatacgggtaagattacacagcatatagaacttgatgggctatcttgtgccactggcacattatacgctgcatacaactggttgactgccaaccttcttgtcacc

SEQ ID NO: 606388 - DNA, 421 bp, Homo sapiens
  misc_feature (56)..(57): n is a, c, g, or t
  misc_feature (87)..(87): n is a, c, g, or t
  misc_feature (113)..(113): n is a, c, g, or t
  misc_feature (261)..(261): n is a, c, g, or t
gcaagggaaagatgaaaacattataaccaacgcataatatagcaaggactaacccnnctataccttctgcataatgaattaactagnaaataactttggcaaggcagagccanaagctaaagaacccccgaaaccatgacgatgctaccttaaggaacaggctaaaaagatgcactaccccgttcctatgttacgccaaaattagcttgggaaggaatttaacttaaggttagcaggggcgacaagaccttacccgaatgntcccttgggggttggactaacgcccttgggggatataggatccaccaaaaccgcaacttacacgaacacacttcccttcttcacggctctaccaacaccccttcttctcaacaacctctcctggggcccaccaagccaaacgcaaaaaacccccccattt

SEQ ID NO: 606389 - DNA, 116 bp, Homo sapiens
acgcctgtaatcctatcactttgcgaaactgaggtggtggaaggatcactgaaggtcgggagttcaagaccagcctggccaatgtggtgaaaccccgtttctcctaaaattaaaaa

SEQ ID NO: 606390 - DNA, 153 bp, Homo sapiens
ctcatccatattttcatccatattatttttggctaaaaagaaccatgtaacgataatttacgttatttccagagtattagcactttaatatgtcaagtttagtgaaaataaacaagtaatttccagcaagttatgtttcattttttcatttaa

SEQ ID NO: 606391 - DNA, 771 bp, Homo sapiens
  misc_feature (274)..(274): n is a, c, g, or t
gccatgtgctggctctgtgactttaggcaagcgattcacatcctcagccaatttcatccgtgaaaagaaaaccagaagagcaagatgtggagaataatatctgctagagaaatatgcatctcagcctgactattgtggtgcctgaacatgatggcggagttcggtcctgtgtgcccaggctgagtacagtgcgcaatttccagctcacagcagtgattctcctccctcagcctcgcgagaagtggattactgggcatgttgccattacgcccanataattttgtatttggtagagacggggtctctccatgttgtcaggctggtctccggaactccttgaactcaggtgatccgcctgcctcggctcccaaagtgctgagattaccaggtgtgagccaccgttgccgggctaattttggtatttttcagtagagacacggttttaacccatgtgtgccagggtggtctcaaactccttgatctcaggtgatccacccgcttggctcccaaagtgctggattacaggcatgagcccactgcgccagccaaagtgaaggcttaatttttaaccttgtgatgattatacttggaaggggtggctgcccctccaacctgtggtaatttagtcgggtgtatgagacgactgagacaaagaacttaagacacagagactagtatagagaaacaatagttggcccgggactggcggtccagacaccaaggacctgattggcacggtctgattcctcggtttattatattcttttttgg

SEQ ID NO: 606392 - DNA, 103 bp, Homo sapiens
ggggggcccccctgggggggccccccccccccgggttcccttttggggttttttggggctttttcaaagaaaaacccccttggggggattggggaagggccca

SEQ ID NO: 606393 - DNA, 97 bp, Homo sapiens
ttttatttcatttataagatggctcaatgtattgggaggctttttttttattacaaaaagtgtatattggtatataataaatgaacttttcaaatga

SEQ ID NO: 606394 - DNA, 186 bp, Homo sapiens
gcggcccctactactactaaattcgcggccgcgtcgacctggctgcatgttgattatattcacaagtaagaggcaggagcatttttatttgagagttcatggcaataactgctacttttaaatactggagatctcaagagacccaagggaacacaagacacttccaggtctgggaagtttgcttgg

SEQ ID NO: 606395 - DNA, 1318 bp, Homo sapiens
cagagacgcagtcgcgctcccacgcaccgcatcgactcacacacgagccctcgttctgcctcttccatccgggagccagtcctgctgccacctgcacgcacgcccaaggacacatcggccacccatccgcatgccattgtacctaccacggtccagtgtcctcggtcctcctaccgcatgagactgttcaggaaggacccgtggacacctgagtacgacctgagtccgcagtctccaaggcacgtgagactaacgttcgacctaacagtggcaacaccgaaaccataaccagcacttgggacaagtcgccgcgtgcggaccgcacagatagcacatgatctccaagccactcgtacgacctacgattcccaccagtggactggaggcgttgtaattggcaaacaggcggccataccatacttggcccggatgcacgccgtgcaaggtagacaaggcgagatagccaccagagggttgcatgggcatccctttgccaggtgatccgtacggagatgtgaggctaactgtcagcgttgagtccagctcgtcctcaatacagatcacccccgaaacgtttccccacggaaaactacgcccgctgacccaaaggcaaccacatggcttggacagcctggaatgagacggcctgaacagttctcccggcctgtcggccccaacctaagaattccgcatccaaggggtggaggcccactcccattgggacgccaggcacacacactaagagataccctgcacaggaccccggatgccaccggaaggcaagcctccaaggcggacccagcgcgaccaaagacccggcgcccgaagagggcgaaccgtcatagccaccgcaggccgaacaggggggcagtgcggcgaccgggactaggtcgacccacctttacaccaactcgaccaaaggtcccgcacatccacgggctgggatccgccgactctatcttggcccgcggacccttcaatggcgccctaccgcgtagcgacaactagcgcacgatcggcaattctggtttatcgatacatctgcggcagcgcgcgacgagcgccccggggagacacctatgccaaacgagagtcagacacagcgggccccaccggcccggctgcagacgcctgcccgccaaccaggggaccgcagggccgcccgacccgtgccctgcacgacacaacgcccgcgagacgcccacaccggagacatgcagcacccagcgaagcgcacccgaggcgcgcaacccagaacggagagcaccccgacgcacggagagcccgacaaagcacgcccacacaccaccgtgccaga

SEQ ID NO: 606396 - DNA, 1315 bp, Homo sapiens
gagaggacgcggaggcgagcaagatggcgcagacagcagggcacccggaggaaagtctgttactacatacgacggggatgttggacaaattactattatggacaaggccaccaatgaagcctcaccgaatccgcatgactcataatttgcatgctcaacgtatggtctctaccgaaaccatggcacatctatcgccctcacaaagccaagtgctgcaggcaagatgagcaagtaccagagcgatgactacattaacattcttgcagctccatccgtccagataaccatgtcggagtacccaggaagcagatgcagagattcaacgtaggtgaggactgtccagatatcgatggcccagtaacgagaactacatgtcacgcgatcatacctggtgcgcacctgtgagaccagatgcatggatgaaaacattaactaagacagcaagaaaggcacattcagcatgatgcacatcgagacaatgacgaggccatggacagccacgtacaccagaaggtccgaaggcatctaggcttcacgagaaacagtcagaggggcataataggcgcgatggggaacaaatcccatgagaaacggcgacaaaggaactagacccacgaagagggcgcacgacacaataggaccagtaggacaaatccaacccaatgaaagaccggggacgcaggccaacgaagggaagaacagaaaaaccaagtgacaccaggaggcaacaatgaaacaggctcgccccgcacacaacaaacgactaatggaggcgacaagcataagagatcgccccaacggagcagaccggagcgaaaccctaacggggaagataatacgaagcaaatcgggacagcgagggcaagagctgacaaacactgagcgcacggataacaagataacgccggcgcgcaccgaagaaaagggagaagaaggaggagcacgacgaccccaagtgaggggacaaaggaagaacaaggcacgggacacacacgatagccaaaaagcagagaagtggacagacgatagcacaccgagcgaacaagagaacgcacaagaacacacaacacaaagagtgatcgacatcacggaacagcgacacatacacagagggaagaaaacgacgaaaacgggcgagccgcaaacacccaacgaaagcaacaaacgaacaacgagcagagacgacacgagcacacgaagagaacaaccacggaacagaagaaggacatcataaaagcgagacagagcgaggagccaaagacagcaccacacagcacagccaaggaagccacgagcatcggacacaacaagcaaa

SEQ ID NO: 606397 - DNA, 510 bp, Homo sapiens
  misc_feature (207)..(207): n is a, c, g, or t
gcttcttgccggtggtggttccctccagcccgaaattgtggcatctccaattcccaacaattagccccatccatcttccctccccctcctgcccaggcagggggtaagcagcccagaagccccgtaactgccccttccccgcatatgcttttgatggggtcatttgctccttcctgtggcctcatcccaactggatcttcccttacnggttatattttccccccgtaatggttggggcccggcccatcccttttcccccttctataatggttgggactaaacgtcccccaggtgggttttccttggcttaaaaatggaaggcgtggtgggattttctcctgggttccctaggccctagttagggcaaaaaaaaaaccctcctttcccttttttccccgttaggcccagatcccccccaaaggcaggagtgctgccctttcccctgggggccgggccttttttctgtgttttttaacccccccttttaggggattaacctggcccttggga

SEQ ID NO: 606398 - DNA, 157 bp, Homo sapiens
tctcaaatgaggcaatagaaagcctctacgaagccctctatggttgactactttgccagaacctgtgataacgtgggtatgatgcataatgacagtattatacatctcgccattattgtcatcatctgccgttcacctgctgtccccggcgtccatg

SEQ ID NO: 606399 - DNA, 127 bp, Homo sapiens
cgggtctggagagcgccagctatcctgagggaaacttcggagtggaacagtatagatgtaattgcacgtcatgaccgctacagaccagcccatctttcgggtcctaacacgtgcgcccgtggtccca

SEQ ID NO: 606400 - DNA, 178 bp, Homo sapiens
ggtcgcactctctatagcctggctagaaattaaaccctcgagattacagatgatcattcgtgagctctcacactgagcggatcatgcgtcggtatctacaaatatgcccatcatttctggggtatgaagactgagagcactacatgggtagaagctggaaatcatcagaagtgactct

SEQ ID NO: 606401 - DNA, 661 bp, Homo sapiens
  misc_feature (150)..(150): n is a, c, g, or t
aatctaggttgggcaaggtaatgggagggcaagcatgctggtggtgacaatggggtctaaaaaaatgccttcaattagtttggcttggtgcagacgttctaatctaggctctgagtctatagtatcatcacttatccaaatgcagagacnatctatcctgcagaaccattcattcccttaagaaatattttatttgtagtcactatggtccagccaccattctaggtgtcaattgtataacaacaaacaaagcagacatttctgtccccatggaacttaactctaatgtattttagatctgccttttgcttatttacctgggtaaataaaaaaaaaagcttttacttttattatgggtgatgtacactaacccgtattagttttcatgccaaaacctcacccagtgagccagactgaaacccaccattttcttgatatgtgagcatggaccccatcctgcaaagagaagaatggataatgagaggcatgtgctggggttcaatttgcagggttcatttgtaatcagctatgaggtcaacttctagtcctatgacattaatagaagcagagacagacacttcattttcagtgtacctctctcttgcttccccaaagcctctgttctaaaagtttagtaaaaccttaacattcttcaacttgc

SEQ ID NO: 606402 - DNA, 240 bp, Homo sapiens
gcgatgtaaatagaggatgtcatgcctatgcgtcagcagtataagggatgccgttagtgcccacaaagatcttacacactttgcacaacttgttactatggcctcctcaggtgtcatacgatgtacagcaaagcgagccttggtgtcatagatcagacggaaattctctcccgtcttgtcactgctgatgacatccattaatccagcagggtaggttatatcagttcggaccttgccatc

SEQ ID NO: 606403 - DNA, 154 bp, Homo sapiens
tagtcagaggagaacgtattccaagaaatagaagcacaggatgccaaggtctagggaagacggaactggcttaagcgcatgtgcactgaccatggacaaacctgtagcgttttgttcaagttgctcagaacaacttccagcagatcaatctccg

SEQ ID NO: 606404 - DNA, 354 bp, Homo sapiens
caacagacacataatatacaccacatgggcctatataagtttactagtaaccacatttataaaacataaaaagagacaggtgaaattaactttactaatatatcttatttaacccaatatatgtagaatgttatttcagacaaaatataaaaatcactaaagaaatatttcctattctttttttcatattacttccctgaaaatccagagtatattttgcatttatagcacatgtcattactcactagccacattcaggtgctcaatagccacatgtgactagtggctgcctttttggatagtcagctctagattttacttatgagatgtacaggatctaaaaacatctttagc

SEQ ID NO: 606405 - DNA, 149 bp, Homo sapiens
atccattgccagccaaaagatttttttttggacccatttgttttgcagaagggtgtttttcccttttccctttttttggttctttttgtctttcctttttttttgtttggggaaatcccttagactctgggggccttttttcccgccca

SEQ ID NO: 606406 - DNA, 259 bp, Homo sapiens
  misc_feature (108)..(108): n is a, c, g, or t
atcatggggttgtttgatcccgtatatgctatgtattccgtgaggccaaatatcatctgaggggccacaataattacaaacttactatccgccataccatacattttnacacgccacatgtctactgattaatcttctaaaatttattgaactacgttcgtcccaatgtatgggatgtgtaatatgtaagttagtaattactgaggcccctcaaaatgatttatggcctcatgggaggacacaatctatgaatgctgtt

SEQ ID NO: 606407 - DNA, 161 bp, Homo sapiens
ctgtaacatctgcctggctaacttcacaaattgaataaaatgtttgatatatattcatttttttaaaatccaaggagaagctgggtgtggtggcacatgcctgtagtcccagctacttaagctgaagcaggaagatcacttaagggcaggacaatcaggca

SEQ ID NO: 606408 - DNA, 253 bp, Homo sapiens
cctcctgggttcgagcgattcctgtgcctcagtttcctgagtagctgggattacaggtgcccatcaacacaaccagctagctttgtgtatttttaatagagacagggtttcaacatgttgcccagactggtcttgaacacctgacctcaggtgatccacccacattgtcctcccaaagtgcggggattacaggcatgagccaccacacctggtcttctaggtaggtttcttacccatgtgattatctagtggc

SEQ ID NO: 606409 - DNA, 182 bp, Homo sapiens
cgcgtgggtcttgtgctggaggcctacatgcggctggacgaggtgctgcccgagctgaaggcgagcctggcgctgtctgagatgctcttcagaggggaggggccaccctgtgcctgcagccgcatgtaccagtaccagatgaagatgaggaagccttgcaaggaggtgatgatgctgaaaag

SEQ ID NO: 606410 - DNA, 150 bp, Homo sapiens
tcgattcagtcaactatgcactgaatgtagctcctaaaatcagttctctaccctacggatgggatgttctaccaagaaagagaagcatcaccatgtcatctagtgttctacacactatagagagttacagttgcccccaacacggatgct

SEQ ID NO: 606411 - DNA, 184 bp, Homo sapiens
agtgagttatttatcctgatcctcattcctctcacccagcctccatcctccaccagaccgtagtgtgtgttgtgcccatgtgtccatgtgtactcatgattcagctcccacttataattgataacatatggtattaggtttgctgctcctcgatgagtttgtaaggataaaggcctccagctcc

SEQ ID NO: 606412 - DNA, 289 bp, Homo sapiens
ggaagggatacatgattttaaaaaagcctgtaagaggtgaaatatgtgatgtttgaagtctctttatagactctttatatatatttcgtgaaacactcatcttagatgaggtgcctttgagccagttcttaaaaatgccagttccgggaagccacctcctttggttccctagggaggaattctctaactcatgcacactcttttaaatatagcgaactctgggttttgagataatctctctacactcacaacactcttgagagcacatcatctctactttataataaat

SEQ ID NO: 606413 - DNA, 310 bp, Homo sapiens
atttagccgggatggactcgatctcctgacctcgtgatccgcgcgcctcgccctcccaaagtagctgggattacaggcgtgagccaccgcgcccggcccccccaattactcttaaaggtaacatcgctattgtgaacctaagatcagctttttgagatgccttttcaggtgtaatggataatactgagtgtcagctcgattggattgaaggctacaaagtattgatcctggatgtgtctgtgagggtgttgcaaaagagattacctgtggaaggcagatgcacagttaatctggtggcacaatctaatca

SEQ ID NO: 606414 - DNA, 543 bp, Homo sapiens
  misc_feature (3)..(3): n is a, c, g, or t
  misc_feature (14)..(14): n is a, c, g, or t
  misc_feature (33)..(33): n is a, c, g, or t
  misc_feature (52)..(52): n is a, c, g, or t
  misc_feature (66)..(66): n is a, c, g, or t
  misc_feature (118)..(118): n is a, c, g, or t
  misc_feature (177)..(177): n is a, c, g, or t
  misc_feature (247)..(247): n is a, c, g, or t
  misc_feature (292)..(292): n is a, c, g, or t
ttncttggtccctnccccaaaaatgcaatggtnaagccctccctacccttgncccccttctggatnactcctaccctgagatgcccatctctattgttttgccccctgattaaactcnagcagagggagggggacccctgcaagagggggaacatggctccctcccccactcccatncccctccccaggccagccccacaggtgtcctgcctgcatcaacctaaatgggtgccccagtggtgagaantcctgactgtgctttaggaatagatcacattcctagctatgcacnagtgcacgcctgtaatcccaacaatttgggaggctaaaacccaggagtttgagaccagcctgagcaacatactgagaccccatctttccaaaaagtatttaaaaattatctaggcatttggcacatgcctgtggtcccagccacctgcgaggctgaggtgagaggattgcttgagcctagtagttcaaggctgcagtgagctatgatcatccactgcactccagcctgggtaagtgagaatttggttcaaa

SEQ ID NO: 606415 - DNA, 428 bp, Homo sapiens
  misc_feature (25)..(25): n is a, c, g, or t
  misc_feature (78)..(78): n is a, c, g, or t
  misc_feature (96)..(96): n is a, c, g, or t
  misc_feature (136)..(136): n is a, c, g, or t
  misc_feature (147)..(147): n is a, c, g, or t
  misc_feature (197)..(197): n is a, c, g, or t
  misc_feature (236)..(236): n is a, c, g, or t
  misc_feature (246)..(246): n is a, c, g, or t
  misc_feature (248)..(248): n is a, c, g, or t
  misc_feature (273)..(273): n is a, c, g, or t
  misc_feature (321)..(321): n is a, c, g, or t
  misc_feature (325)..(326): n is a, c, g, or t
  misc_feature (333)..(333): n is a, c, g, or t
  misc_feature (339)..(340): n is a, c, g, or t
  misc_feature (342)..(342): n is a, c, g, or t
  misc_feature (346)..(349): n is a, c, g, or t
  misc_feature (352)..(352): n is a, c, g, or t
  misc_feature (359)..(359): n is a, c, g, or t
  misc_feature (362)..(362): n is a, c, g, or t
  misc_feature (364)..(364): n is a, c, g, or t
  misc_feature (387)..(387): n is a, c, g, or t
  misc_feature (390)..(390): n is a, c, g, or t
  misc_feature (404)..(404): n is a, c, g, or t
  misc_feature (408)..(408): n is a, c, g, or t
  misc_feature (419)..(419): n is a, c, g, or t
  misc_feature (422)..(422): n is a, c, g, or t
  misc_feature (426)..(426): n is a, c, g, or t
  misc_feature (428)..(428): n is a, c, g, or t
gtccacgtgaagaaaacagaacacntcaagattacatgatggggaaacatgtaggggctttgtctctattgaaaaatntgtcttacagttgttttngtattttattttaggcaaaagtcaacaactctagcttaantggagtaggcnatactcagactctgaggcctggtaaggattctgtgataaagtaggattgntttgatagtattaaaaaatttagttttcattcttcagcntacttttcanancattcaagcacacagaagagttganagaagagtacaataaatacgtgtttacgcttttaccacaattttttantgcnntttcttngcgttnngngtgnnnngcngggccantcngncggggcgcctctcttcagaatanggnccggctctgcgttnctgnataaccataanacnatcncn

SEQ ID NO: 606416 - DNA, 1256 bp, Homo sapiens
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 606417 - DNA, 175 bp, Homo sapiens
  misc_feature (123)..(124): n is a, c, g, or t
gcgtcacagttgcgcccgcgtgtttaattttgaattactttaaaattgtaaaagaggaattgttccggggtgatgtgatacagacgagaaccaggtgcagctgggctcccccactcacctggnnctttctctcagcctttgtggcatggttggtccccgcaactggtacggcggg

SEQ ID NO: 606418 - DNA, 1645 bp, Homo sapiens
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 606419 - DNA, 1267 bp, Homo sapiens
agggaagaacaaccttagggctaggtacgaggctgggtgttaatcggccgagggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 606420 - DNA, 1039 bp, Homo sapiens
gataggatgaacagtatgctcaacgaatagaaacgaaaaacgatcgcatctatctataattgtaagcatgatgacctgtttactagaggcatgcgtgatatcgacttgtctagtttccgttgcatttgggccgcctgtgcttgcctcatttagtcgacttgactatgctggtagtgatacatagaaagacaccatgacctgtttaatcccagctttggtatgctgcgaagggtagactctatgcgatgttgcaattttatcatgacagtgacagtaaatgtccctgtcccatacgaggagagggtggaactagaacaccgatgattggagatgaatcatgatcacagatataaacttcctaatatttactcactctctacgatgccgactcgacctttaattttatcgtgtggactcgcgaacgtgtcatgccggttatacaggactactgattaggtttctgctatatgagtgaccaacatcgattgtgttctgctagataaatccataatcacctggtctaatatgtctagacagactcctggtagactttggtcgtgtgtgattattggcaccatggtctttcttaaatacacaatacagacctcattcgcgtgtgcatgttaacaaatatgggtgtctcgcgtgacttcaatctacaagtaggagggacggggattactgaggttgggggatgcatcttcttccactgatgtgtctcgtatgatttatccagtgttgtgcatgtttgtgatatgcccagaattgatgagcccgttgaattttcatcccctgaaactccaatctttaaccatctgcttgccagatcttttatgaatttccccacgaatgcacgccatgctggtagtctactgctgagaacagtcttgagcgcattgcggatctagtccattttagttgactgcattgctgctttcaactttcatttcgtgtgtcaatttgtctcccattttggtaccgttgactgtggtgtgcatgacacagttttttttgtaacagaaagccttgggccatatat

SEQ ID NO: 606421 - DNA, 1177 bp, Homo sapiens
gtttttctttgatacgggagttcctccttcctctcgcccctactctttctggtgttagatcgagcaaccctctaaaagcagtttagagtggtaaaaaaaaaaaaaaacacaccaaaggctcgcagccacaaaggggatgaaatttcttctgggacatcctccgggttctcccgttactggatcgtctggctccctaaagtccttcgtggaagcttttattcctaagaggagaaaatcagtcaccgggcgaaatcgtggctggattacagggagctggggcatgggaattggggagactggactggcctatgaatttggctaaacttaaaagcaagctgggttctctggggatataaataaggcatgggactgggagggaaacaggttggccaaatggcaaggggactggggtggccaagggttcatacctttggtgggtagactggcgagaaaccggagaagattatttacaggctctggcaaagaaggtggaagggcagaaattgggagatggtcagtatttaagtaaataatggctgggtggtagtctatacatcagattcggttggctacacaagatcctcagatggaaaagacttcggaagttcaatggtactgtgcacatttctggactacaagggcatgtcttccgtgcaatgacgaagaataaccatggccatatgggtccctggggggcttcggacagcttggaccatgtctcggtcctctttttaatggtttactggtcaagcaagtttggtgctgtgggatttcataaaactttggacgattaaacggtggctttaaaatacttggggttcaaacacatgttgggtctcaaatttggtaaacctgcggctacccaaaatctcagtcaacgtgtggggcccatctgtaagccccgggagagccggggaaagacggcgggtcgcatggagacatcagagaggagagaaaaaagatatatcaaccagcactaaagattgcaccaaccggggaggaggccccaggcaggagcggcggcgaacacacacactcatggtgccgacagagtgaaagaagacaagcatcattagataaaagcaacgaggtgtgataacagaagacgagagcaatacaactcagggagtaggacaccgtccacgcagaagcgcaaacatagactcactacccgcgc

SEQ ID NO: 606422 - DNA, 2425 bp, Homo sapiens
  misc_feature (1762)..(1762): n is a, c, g, or t
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattcccaggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggcttnactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacgtacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaa

SEQ ID NO: 606423 - DNA, 216 bp, Homo sapiens
  misc_feature (26)..(26): n is a, c, g, or t
  misc_feature (101)..(101): n is a, c, g, or t
ctgggattacaggtgtgcaccaccanacccagctaatttttgtattttcttagtggagatcaggtttcaccatgttggtcaggctggtctcgaactcctgncctcgtgatctgcctccctcgaactcatgacctcgtgatctgcctgcctcggcctcccaaccatctgttttcccaaggaagaatgtgaacctcagcctcagagaactgtctctga

SEQ ID NO: 606424 - DNA, 1302 bp, Homo sapiens
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattata

SEQ ID NO: 606425 - DNA, 343 bp, Homo sapiens
  misc_feature (264)..(264): n is a, c, g, or t
aacataagcagagtttcggcactgtcatgtgactctgggcacgtcacgttaacgtcgacaaagctatactctgtctgtgctgtccacgtaggtatgatgaccacgctaagctcccagttagcttggcagggccgggagcctgcactcggcttctgctctggggtagtagagtccggccctgtcagctaaggggtgctgctctggcagtggggtgggtctcctatgagctatgagctgtgctgggagatgcccggagtggaaccngagcaggacttaggtgaggcaggcacaacagagaaggcccagtacccgtccctggcatgctaggctcgcagaggccact

SEQ ID NO: 606426 - DNA, 1451 bp, Homo sapiens
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggaaaaaaaaagaaacaagaaataagaaggaaaagaaaaacaagaaaaaaaggaaaaaagaaaaaaaagagggggggattaaatacgggggcgaatccactttataagagccagtgtattataatagggggggtaagggggaaaactggtggggccctgtggggttgccccaaggataatttgtgctgggttgaaagg

SEQ ID NO: 606427 - DNA, 1439 bp, Homo sapiens
ggcctgaccacgcagttcttgggtctgtgctgctggcctggggttgtggttgaggccgggtctccgctcctgtgcccgggaagatggtgctaggtggttgcccgaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 606428 - DNA, 819 bp, Homo sapiens
gggtcataaagtcgtagacgaaggacccctggagcgggattttttaaaatacggccagaggggcattcctaggttgttagcccttcccagaggcctgtggcatgccggggatggccatcactgctgcccacggggctattccactgcagtgcagaccgggcgatcctgcttccaaagatcatggtgtaacaactccgtgggtgccatccatggtgccctgatagtcatgttcgaatgccctggacttctaccactgttgcttgtgttattgtgtctgatgtgctcctgtgtggtgtgcttgccccgatgtcccccagtgcttccttgctgttggaagacattgggttgcactagcttgtcctgcaactgtggttgccttcttgcctgacccttggtttccaacaacccctgcttgcaatcagcaaacccactgggtgacaacccccaagcgcaccactttgtggcaaactgaaaatggcttccaccattggcccgaatgattgtgaactaaacaggggtgccatgttgggcccattggttcccaatggcaataccgggtcacatggttgttccctgtgaacttgccaccctgtggatcccccgggtgatggccccccccttgaagtttcgtggatatccataacacaatggggcgcttggttcgaactgtcctattggccctccagtgtttggtgcgaacacatggtaaattggtgctgtatgactatgacccaccaaatatttgccccaaagagcatgcccacagctcatgggcctgtgcaattaccctgaatacaacccttggccaccttgcattgc

SEQ ID NO: 606429 - DNA, 1542 bp, Homo sapiens
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatctctggtcttactaaacttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 606430 - DNA, 410 bp, Homo sapiens
  misc_feature (1)..(1): n is a, c, g, or t
naggactggttacatctcagtatgagtggcgcattatgacgtaatccgccctgagcaagaatgtcctcccgctctcacgtaatcatatgactagccatgagctatgcgactacactcttatgcacacaaggcgttcccaaacacgcattcgtagggtttctcagcaatgtgctcattctgcagatgatgcaagtatccgctgtcatacactttgttccaacaggcgtcacacctgttcagagtcgacatgtaatgcgttccctgatgatctgccacatgcatactgtctctcaagacagggccacacctcgggcaggcgtgggccttcctgtaagacacacctgccataggagtcctgaaaagagtctctctttgtatatatatacgctgctaagcaggtcaggcctaat

SEQ ID NO: 606431 - DNA, 366 bp, Homo sapiens
accatgcctggctaattttgtatttttggtggagactgggtttcaccatgttggccacgctggtctcaaactcctgacctcaggtgatccacctgcctcggcctcccaaagtgctggcattacaggcgtgagccaccgcacccagccaacccaggagtttgacagcagtttgggtaacatagacctcatctctacaaaaattaaaaaaaaaaaaataggcaggtatgggggcatgcaccagtaatgccagctattctcatgaggctgaggtgggaggatcaactgagccctaaagttgaaggctgcagtaagctatgatcacaccactgcactccagccggggcaacagagtgagatattggactc

SEQ ID NO: 606432 - DNA, 1335 bp, Homo sapiens
ggcctgaccacgcagttcttgggtctgtgctgctggcctggggttgtggttgaggccgggtctccgctcctgtgcccgggaagatggtgctaggtggttgcccgcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 606433 - DNA, 1193 bp, Homo sapiens
ggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaaaaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgga

SEQ ID NO: 606434 - DNA, 1379 bp, Homo sapiens
  misc_feature (220)..(220): n is a, c, g, or t
ggtcagacggagctatgtacgccctctttgctcgtggtgccaggctcgctggagcaagcgggctcgtagaccgtgcaccggtgccattgagtagatgataagggaatgcatccgatggggcctacgagacaggtgttggtgcactgtagactgtgacacgacgggcgtcgcgacgtagcgagtggccagctggaaggcacgtgctctgcacgtacccagntgtggaagcagacgccaaggagtgaagagtccgcttctcgcgtggcggacattagtgtcaagaagagcgattgctcaactgtgaggctgagtgagtgatgcatgagagagagcaaatggccatctgagagacggtagaatccattgcttataccgtatgcgacgaagatccttgtgacatggtgttcacggaaaatggaagacatgtctggtttcatgcaagggtagaataagtgagactcgcgtatgctgtccctgctgattcgcttggacactgagtttaagaggggacgagaagtgaggccggttcatgggcgcgaagaggtggtcgcatcctgcgacgtcaaaccgtacttgcaggaggtttattcggtcccagaaaaagcatccttaggccaagcacgcatgcacattcgatccgagtagaggactaagcctaggaggtcgctagacttaaatgatctcgcaaggaagcccttgggtagcaatcagacatcgcagtgtggggtgtgcgctcgcactttttcattgcgcgcgaagacaattcgcgcgtctcccgtcacataacttagccgcttccaagtgcaatagggcaccgccgacgggttaattggaacacacggtcccaccccaacgaatctgacacaatgtgcacttaacttggtggggtgggcgaagctcttttggccgcctatgggggaacacttgggcaagttcttcaagcagatttagaggttatgaagccttggcaacaatttccaccaaaggaaatcctttggccaataggtaaacagggcggagccacgagaggatgtatacacagaggcacttttctatggcttacccaaagaggggcgccatcttgggaagagtcgcggagacagaccaaaagttcgttttcgtaagagcggggagtaggagagaccagattagataggaacgagcacggacaacattgggtagtggcgatccgccagtgagtgaccatctttggggccccagtagcgcaaatttaattttcgcgaagggaaaacgcatagatatgtcgacacgaccaggttatgttctttggcacaagattttggccttaactcccgaggaagtaagaacttagacgtttacacgcaaattagtcggaccctcccagatgtcggagccaa

SEQ ID NO: 606435 - DNA, 503 bp, Homo sapiens
  misc_feature (5)..(5): n is a, c, g, or t
cactntgggaagctgaggcagaggattgcttgaggttaggagttcaggaccgtcctggacaacatagtgagaccctgtctttatttaaagaaaaaaaaaaaagaaaaagctgtttgtctttttcaaccaatgaaagttaaaatcaagaaatgggaggccaggcacggtggcttaagcctgtaatcccagcactttgggaggacgaggcaggtggatcatgaggtcaggagatcgagaccatcctggctaacatggtgaaatcccgtctctactaaaaaaatacaaaaaattagctgggcatggtggcatgcaactgtagtcccagctacttgggaggttgagacaggagaatcgcttgaacctgggaagcggaggtcacaatgagccgagattgtgccactgcactccagcctgggtgacagagcgagactccgtcttaaaacacacacacacacaaatttaaacttaggcaatatagtgagacctcatctctacaaaaaatc

SEQ ID NO: 606436 - DNA, 749 bp, Homo sapiens
cagaagggaagggtaaggatggagagctcctctgtcactcgccaagtcactacctctatgcatcatttctgtgctggctgaggtgtgccaggtccccacacacgttttaagttaggctctcttgtcacctgtctgtccttggggaatttgggctgccctgtctttcctgtatagctagttttgtggttctttctgacagccatgtgctgtctttcccccccaggagtgggaggagcggcgcaggcagaatatcgagaagatgaatgaggagatggagaagattgccgaatatgagcgcaaccagcgggaaggggtgctggagcccaacccagtacgcaacttcctggatgatccccgacgtcggggtgggcccctcgaggagtctgagagggatcgccgggaaggcagccgccggcatggacgcaactggggaggctcagattttgagcgggtgcgctctggcttggaacaggagcgacagggccgcagggctggcctgggcagtgggggcgacatgacgatgtccatgacgggccgggagaggtcagagtacctgcgctggaagcaggagagggagaagatcgaccaggaacgtctgcagcgacaccgcaagcccaccggggcagtggcggcgggagtgggatgccgagaaagaccgatgggcatgttcaaggatggcccaggcgctaaccaatgaactgtccccaccgtatgattgaccaagttggggaaaacaactaaagctccaa

SEQ ID NO: 606437 - DNA, 415 bp, Homo sapiens
cgggagattgtgtgcgttctggatcttgatcgcttctggtcactggggattctctttacgggatcttcgtcgagtcactgaagtcctgggacggtgaccgtctccggctgacttgtgaagttcgagatctggacctacgtcggcttatcaagagggttctggacctggatcgccggtgagtggctggagaggctcgagatctagagcgtttccacggggctggtgatgtgcgtgagcggagaacgcttccgactggttgggggtgtccgagagcggcctcttcggcgtcgagaggaggtccgggaactttcctggcgggcaggtgaccttgagtgataaccagaggctcccctccggcggcgagtaacccgcgaacttgacctggtccggtgtcttcggcgttaggccgatctga

SEQ ID NO: 606438 - DNA, 369 bp, Homo sapiens
gccgtttcccccggaggccgggccctcccggaaaagccgggtcctccagaccccgaggccttgctttcagaggggggggcccccccccctggagagccccgcccctaagggtctatgagtcctcaggggtcaagttcagaaacggcccagccagacctaaacccccacgcccccaaagtggattgcccccagacaagaactcccgtgggggcctcccctttattcccccccttgagggggcccccttactgggggggggtccttgcaattccagcgaatcgggggccaggccagggcgtccttgctccctgccccctccctgttttgggccctttttttacctacataaacccccgccttcccccccca

SEQ ID NO: 606439 - DNA, 220 bp, Homo sapiens
agcgtataagtccactccgtaaatcagatcgtatactcgcagtcggagtatcaagtcaccgtgagctcaccatagtctaatagaaaataagcgaaaccaaataaattcaagcacggcttattacaattttactgggactctattttaacatcctacaagcctcagagtacttcgagtctcccttcaccatttccgacggcttctacggattcgtcggtca

SEQ ID NO: 606440 - DNA, 884 bp, Homo sapiens
cgtaacaaaggtgtgttctgtaacgtggtgactgtgggtaagttgtcgtctataaacaagtgttgcccagaagagtgcccgcctgtgagagtcggccgtttccagaaacattgggcctcgcaatatagatggcgcccacgtttcagggggatggctccatgtccgcaaactgttctcgggttaatgccacccccggtcgttcattaacttggttctgcgaggcaagaaaaccatgctgttggccaacacaggggaaggtgtttttttaaaagacccaggtgaagtcggttaataatgggcgtcgagaccaaagcttggggttttaaataatgggaaaaggggggggaaatgagaaagcggccgttttacaagatggaaaaaaggttgggggccctgaaattactggacgacagttcctctctatcggtgcggcaataccgagatttctcccaacgatgtcacgccttttccattcttggttaaaaaaagcactgctgttggcccagtttttttatcaacccactttgtttaacacccacaggtatatacggcgaggcaacataacgctacgtgtggacaatcgtttgtaaaagcccgtgttctcccccacgaaaatcatgtacaaactatacgtgtgcagggtggtatgggagaacactaccgcaactccgcttgtcgataataatttagagagtatgtcgagagtcaccacccgcttgaatgactattggctgatctaccactggcctctcctgttcttgcagggtgtgatctcctctctagcccaccgggtggttaagtcctttgatgattaaaaaaagtagggcgcgaaaaattaattttcctctggtttccgaaaaaaagagaacccccgtcccacaaca

SEQ ID NO: 606441 - DNA, 394 bp, Homo sapiens
atcagacgatcccggtgtgcatacaatattgctgcgtggaattgaatcggcattgttcctacaggtttgtctctcttttttttactgtcattcattctctttctggcaggacgtcacgtctgtgtgagaaggccatcatgtgtagagtgcagcatttgggaccgttcgtcaaaagacaaaaacggaatgttttctgactttagagaaacgtggtgatgtctgaaggaagatggaatgagtgacagaaagctacaaacgagaaatgacattcagctttgtataataaaaacacctattaacattcatcacaaggtacagaaaactttaagcctccaagaggccatcggcccaaatggaggcctgaggtcagaacttaaaatggtatagtagaagg

SEQ ID NO: 606442 - DNA, 352 bp, Homo sapiens
  misc_feature (26)..(26): n is a, c, g, or t
  misc_feature (58)..(58): n is a, c, g, or t
  misc_feature (242)..(243): n is a, c, g, or t
  misc_feature (261)..(263): n is a, c, g, or t
  misc_feature (301)..(301): n is a, c, g, or t
  misc_feature (313)..(313): n is a, c, g, or t
  misc_feature (347)..(347): n is a, c, g, or t
ggttgaggctgttgatggcttttgtntgccatcaattggggtcagaatagttcacaancccgttagccaagctctgccctgtgatcttgtcccgaaccaacttgcaggactcgatgtcgccaatgctgccgaagagactcttgaactcatcctgggtcatgttctggggcaggtagttgacgatgaggttggtcttgctgtcgtcagtggctccatttgtcccaaggagttggcgttgggcnnggccggccggccgggctnnnccccacctgagactccatggcccccagtatctgagtgncgattcttgtgntgcggcgggcgcggtccgtgttgaggggggctcnggggg

SEQ ID NO: 606443 - DNA, 605 bp, Homo sapiens
gcacgagctgcgggccgcacatagacgtcatctccatggggatgctgacccaggcggccccagcccttgatttctccctcaagctgttggccaaagaggtggctccagtgcccaaaatccactactcctaaacctgaagaggatgacacctgccatgggttaacgaggctcctcatgaccctttgggtcacacgtctttacggtcagtggcctatggggcacatttggcactagcttgagcccaactctggctctgccacctgctgctcctgtgacctgtcagggctgactgcacctctgctcatctcagacttgctaatctgcaaaatgtgtctaatcaaggatcaaccgcatggggctctggcgtgataatgagcacatattgaggggacagcaaatgttagaagttgcctgggacatttcgggcaccaatggctacccccgtaattccactctttctgaggcttaagcaggaagatctctttgagtttatgagtccaaaacctgtcctggcaacatggtgaaatcccctttattcctgtggattaaatatttacctgggtagcgtttgctcatacccatgactcccaattctcttagggggc

SEQ ID NO: 606444 - DNA, 160 bp, Homo sapiens
ttccattctccagtgcctccaatatcacgctgtgcttccacagattagccgccaggtgcttcatgccctgaatgttcttcaacatgacatcgccgattctttggtaatctctgatttgggcatttgagcgtgccttcccacagggcaagtcgttggggtc

SEQ ID NO: 606445 - DNA, 769 bp, Homo sapiens
agcggggtgagaggaagtgatcgctcccggaggagcgacgagccgatgctggccgtgacgcacgcgtgagacatgcacatcctgcccgctgccggtcccgccatccttcgggaggcctgtgcttgctaccaatcgcgtagcacgtccgccacacggcatcctgtccgcctggctgtctgcgcggataccccaatgtgtcctggcgctggtccgacgcagcgtccacgtgataactcgaagcagttgtcgtggatcgaacagaaggtgtcgttaatacaagccttgaggctaggacgcgcaaataaatgcgatcggcttatacggcatcacgactactggactgaaggacgacacgaatactgggaacgcgaaacgacgcgaggaacggaacagacctgaatctgacggtcgtgacctattgcattggcacgacaccgcaatacgaaactcccgttgtacaaggaacgaaactctgaattctggggatcgacgatgaccgaggggacggagaactagaagagcttatttgctgttggcaaaaaggcgacgtttggataatcatcgaatgcgaggatggaccgtccctcctcagttcgcccgaaaatcaccactaatgtgtcttctcgcaatctctttctggaaacaatcgacggttgaaagcaaaacggtcaccacaaggttggcacacgccttcgtggaaagaccctacaatgagcgttccaagggggctgaattcttgtgggggcccgatttaaagaccaaatggaac

SEQ ID NO: 606446 - DNA, 134 bp, Homo sapiens
ggacgaggagtgatgaagaggccgcggcggagcgcctggctctggaatgggccctgtgtgcgcggacgcaggacttcctgctggtagcacatcctgcatcctccgtctgtgtcttgtcctagtggtacctgagc

SEQ ID NO: 606447 - DNA, 581 bp, Homo sapiens
gggttcatgcaccaaggcttccaccccttaatgtctttctcgcgcccgggttttttctgcacccttggtgcctgggggttcaaccccagccaaaagttgttttcggttcacctgtgcgaggcctttttattgggctctcgggaccaattggggagcctcctcttctgcccactgatgaggacgccatttcttactggcggctgcgcccaaatattctcccatggtcggggggacatattaaactgtcccccaaagggaccctggggtgttcttggccccaaaaacaatcacgaaatcccaagaggatatctcccagaatcttttgcccaatgttccgaagacatcctctgtgccttaacaagactccccaataattgggcacagaaatggccaaaacacccccagctcacatttcggacacctcgtggcgcctgtcccttagaaatacattagcttctctgtttctacatcttgtcgttttccaaagaaatctttgcctttgtaggccccccggccgggaaaccaaccgggggaggggaccccaaggggtttttaaaaaaaatttaaaggtcccaaaaaaa

SEQ ID NO: 606448 - DNA, 859 bp, Homo sapiens
gagtgttgagggttgctgggtggctggttgagacagcgtgcagtactgggaggctaggtgagggtcgcgaggttgcccgagcttctgagcgagcgcggtgcttttgggaacgctgggacgggcgatctgcgtgctgccaggatgctggtgccgaggcgcggtggctgcgtgctgctggctgccctgtgaagtgggaagttacacgaaggtccagccagcgtttctgaggcaatctgaaggcaaatcctgtttagaacccaggcgaaggttcccgggtgacccgggctctcaccagcccaattgtacccttgccgtcctccttgagggtgcctgggagccttaagcacttgtgtgctcttggcctcaacactggggatgccacttgactcccagttgtccgaggggcttccaggtggattctccgagggcccatgattgttagaaagcttcgccgcaattggggtgcaccaagggagcaggccttcaaccattgcgtgcttgggcattggactattctcaccaatgcttggccaggactcccataaccagggttccctgggcggtgcagtaaggtcgagcccaagttgcacagggaatgtacgcacaggtcccattcgggagtcaaaagtgcccagacatggccattgaagcacttccagtgaccctcatgggcgcccttgagaggttcaccgctaatacttgtccacgcccttgtcggtctacgcccttttcgtgtgacccagcttggtgatctcaccgtggcaaggccacctcagagggtcaaacgttccctgttggagcccattggctggctccccatgatgcggattccgcaaggttgttccttccagttccttcc

SEQ ID NO: 606449 - DNA, 300 bp, Homo sapiens
  misc_feature (173)..(173): n is a, c, g, or t
  misc_feature (183)..(183): n is a, c, g, or t
  misc_feature (218)..(218): n is a, c, g, or t
  misc_feature (287)..(287): n is a, c, g, or t
tagtagaaccaggatgccaccgaagaagtaggaggaggatttcggcgaggaggacgaagaggaggtctaaggtagagcccccatcacctcaggctttctcagctcactgagccgtcttactcaactgcccctcttcctctcccacaaaatgtgtgtgtgctgcctctatctcngttcggtgtntcttcttctggggggggtctagaacagcgcctagnacatagtaggtgctcaataaatactcgggtgttgaatgtctcctctctcataccactctgggaaaaccnaggtttcttacca

SEQ ID NO: 606450 - DNA, 164 bp, Homo sapiens
ctcaacgaaatgtggaagtgtcagaacatgcttcggagccatgtacgcgaactattggatttgcacaagcagcctacatcagaggctaactgttctgccatgtttggaaaactgatgaccatagcaaagaatttgcctgaccccgggaaagcacaagattttgt

SEQ ID NO: 606451 - DNA, 553 bp, Homo sapiens
  misc_feature (553)..(553): n is a, c, g, or t
taaaccagggatgtctgttgaaataaaacattcagtctgacaaaaaaaaaaaaaaaaaaaaaaaaaaaaaaaaaaaaaaaaaaaaaaaagaaaaacaaaaaaagagcaaacaacaatgagacaaaataagtaatgagtcgtacacagtatttatctgttgacacacaatcgaggtctcatatatcgaggagacgcgctgtttgaaaatgacgcatgtgacctttgtattaacacaccctttatgtggaaaacactgtaaatagaacatttttacaaagagaccctattcttgggggggagacaccattctttgtgggaggagcaagaacctacccacaccgaggagaagtaatttgaaccacatccctccataggagagagaaaaaatatctacacctcttcgtgaagcgtagctaaataacgtcgttgtcaaaacaacctatcagacctcagcattaagcaaacttacgcgaccgcattagacaaatatgtcggggatattacacacgaacgctatctgacctttcaacaagaattttttatcccagggggn

SEQ ID NO: 606452 - DNA, 602 bp, Homo sapiens
  misc_feature (333)..(333): n is a, c, g, or t
  misc_feature (337)..(337): n is a, c, g, or t
  misc_feature (403)..(403): n is a, c, g, or t
  misc_feature (419)..(419): n is a, c, g, or t
  misc_feature (436)..(436): n is a, c, g, or t
  misc_feature (549)..(549): n is a, c, g, or t
  misc_feature (602)..(602): n is a, c, g, or t
ggcacgagccggcaccaccatgtcgaaggtttcctttaagatcacgctgacgtcggacccacggctgccgtacaagtactcagtgttcctgaaagtacacctttcacagcagtcttaaagtttgcagcagaagaatttaaagttcctgctgcaacaagtgcaattattaccaatgatggaataggaataaatcctgcacagactgctggtgagtatttgaagctattctaattacacttgacagtattttaaccataatggagctgtttttagggattatataccagtctttacctgtgtgtctgagtaataagttgtttcattgggtatatngatngtagatgttttggctacaagtacagaaacctaatagggttaagcatagagtattatatatatacanaagtctgagatagatngcttctaatgagtattntgactactctaaggagtgtagatatgactgaagtgtcatagtggatattaagaagatcattaggctatattttaaatagcatacattcagggtgagtcatagactcaacgaantatcaggttatgtgctgcagaacagtaagtgtatctataagagtaactttaan

SEQ ID NO: 606453 - DNA, 416 bp, Homo sapiens
  misc_feature (298)..(298): n is a, c, g, or t
  misc_feature (328)..(328): n is a, c, g, or t
  misc_feature (354)..(354): n is a, c, g, or t
  misc_feature (378)..(378): n is a, c, g, or t
  misc_feature (383)..(383): n is a, c, g, or t
ggcacgagccggcaccaccatgtcgaaggtttcctttaagatcacgctgacgtcggacccacggctgccgtacaagtactcagtgttcctgaaagtacacctttcacagcagtcttaaagtttgcagcagaagaatttaaagttcctgctgcaacaagtgcaattattaccaatgatggaataggaataaatcctgcacagactgctggaaatgtttttctaaaacatggttcataactgcggattattcctagagatccgtgttggaagttgttaatatctgctacttggacatacnattgctttcagaataaatattggtattttntgatgttgtaaaattgaaatcaggcntttaacatactatgaaaacaccangagtnaatgattaatgaaaggtgactcatctgtccctt

SEQ ID NO: 606454 - DNA, 146 bp, Homo sapiens
tctagaggatcgcttagaagacgacagaaggggtgagtgtggggcatcaggcagagaaagagaagggaggaagtgggaggataggagccaagctggggcactgaaccttgactagccccactcctgtccagctacagcttctgtac

SEQ ID NO: 606455 - DNA, 760 bp, Homo sapiens
  misc_feature (8)..(8): n is a, c, g, or t
  misc_feature (75)..(75): n is a, c, g, or t
  misc_feature (83)..(84): n is a, c, g, or t
  misc_feature (88)..(88): n is a, c, g, or t
  misc_feature (90)..(90): n is a, c, g, or t
  misc_feature (97)..(97): n is a, c, g, or t
  misc_feature (112)..(112): n is a, c, g, or t
  misc_feature (116)..(116): n is a, c, g, or t
  misc_feature (126)..(126): n is a, c, g, or t
  misc_feature (138)..(138): n is a, c, g, or t
  misc_feature (140)..(140): n is a, c, g, or t
  misc_feature (156)..(156): n is a, c, g, or t
  misc_feature (270)..(270): n is a, c, g, or t
  misc_feature (288)..(288): n is a, c, g, or t
  misc_feature (290)..(290): n is a, c, g, or t
  misc_feature (321)..(321): n is a, c, g, or t
  misc_feature (348)..(348): n is a, c, g, or t
  misc_feature (363)..(363): n is a, c, g, or t
  misc_feature (371)..(371): n is a, c, g, or t
  misc_feature (396)..(396): n is a, c, g, or t
  misc_feature (527)..(527): n is a, c, g, or t
  misc_feature (646)..(646): n is a, c, g, or t
  misc_feature (699)..(699): n is a, c, g, or t
  misc_feature (742)..(742): n is a, c, g, or t
cagccacntacttaaattttgatagttacctctgtttgttcaacacgccttgctcttttcctcttttggttttgntttgttcnngttntngtggggnttgcgccctggtggngtgncacgccgtgngatatcagtttntnggcgagctcggctgtngctcagacccctgctccgggggtctcagccttcctttctccgtttctcctctccttaagcctggcaaacactcggattcttctgccccccgccccctggggcccttgcccctgngccaggctaaggaagcgnancccccgaaggaggggcccttgcaaagccagngctcgccgccggacggtgcctcccggnctcagggtctccgcnggctgtcngagcccggtaaaacaccgctcgggnagtccttcgtcccgggaggcaccagcgggatgcttgcgcgactattccttgtaccatgggcgcctaaatcctaaagaaagtggggagcacttccactcgggggggctggagcccgtgtgcttgtggcttanaagacaccagagtccgacccgggccggcctcgggcagggagcgccggcgccggcggccgtagccctgggggctgatcttgctcctgggggcgacgttgtccttgtccttatctgtgaantggtagatctggtgtgccagcttctgcaccgtgcacgtcccgaagcggcagcnaaagctccggaagccctggaagttgttcatgctctggcggtangcttgactcggatgcggg

SEQ ID NO: 606456 - DNA, 360 bp, Homo sapiens
ccaaaaaagggggtttcccccccttatttgggggagccccccacggtttaaaaaagggggggggggaataaaaggccggggtccttggggaaaacccccccctttttaaaaaaaaaaacccaaaaaccaaaaagggggcccccccgaagggtgggggttaaaaaagggggccgtctttaattatggggggcccggatccccccggccccccctttttaaaaaagggttgttaaaccccccaattccccccagggatttttttggggggggaaggtgggggcccccttacccaaacccggggggggaaaaaccccccgggggaaaagattttttttttaaaaaaaaatttttttcccggga

SEQ ID NO: 606457 - DNA, 805 bp, Homo sapiens
gattgcggatgacgccgctgctgcgggggggcccgggggccctggctggccctgaggatggtggaatcgctggtggtcttccgcgatatggtttcgagtcgatgtggcgctccgtgggtcctgggtgctcgcgtgccgtggtatggggccgaggcccaatgccgacggagcctcgcgggagcgacaaggtccgatgagtaatggagctggatgcctcgtggatgcctaatgttggtgccgtcttggctcaatgtaggccatgaaatgaatcaaaggtccgctgtagagagaatctactcatcttcattccactggcaccaattgatggagagtcagagaatcagttgagtattcttcctggcgtggcctcgtcttatggactcgacggttttgaatgacttactcgccaggtcgcaagaaagtaggaaccacgtagcccgagtgccaagcggtcaaccagttgttcaatcggcatttagtcgactagtctgaggtgaggtacaagttgtggcactgtcggtcgtgggtagttaaagtagctccaaggaatggttgagtcagcggacatcctgtgagttgccactcatcctggaccgtgctctccatcgtccccgtgctcatagggcttctggggcgcgcgagatcgggaagccccactttgtcccttgcggcggttgacattggctgtctgcgagctctgttgctggtacagcctcatccctgtagccaggggcatctgtcctcgtctcgtgtctgtgctaagaagttgctcttgatgggtggtctcgatgagctgttgcactca

SEQ ID NO: 606458 - DNA, 355 bp, Homo sapiens
  misc_feature (37)..(37): n is a, c, g, or t
  misc_feature (54)..(54): n is a, c, g, or t
  misc_feature (78)..(78): n is a, c, g, or t
  misc_feature (169)..(169): n is a, c, g, or t
  misc_feature (216)..(216): n is a, c, g, or t
  misc_feature (300)..(300): n is a, c, g, or t
  misc_feature (302)..(302): n is a, c, g, or t
  misc_feature (315)..(315): n is a, c, g, or t
ttcgaagaaaacgccaaaatcccttccccaagagctnaattccgcccttccctngtgtacctccggcctttttggaancccagcccctattcccctaaataccttcgttttccctcaattgaaccccttcagtcttccaacccccagggttagagggggttcggacganccagattagatttccggtgggttaggggtctggagtcccctctcctngaagtctctccgcttgctcctgtggagacctaaggggtcccgcacccgacagagaggggtggccggcgggatttttcacttgtngntctctgcgggganagggcgagagcccctaacacaagcctgagtcttgggggac

SEQ ID NO: 606459 - DNA, 232 bp, Homo sapiens
gggggggcccccccccccccccccccctttggttgcccccaagcctggggagggggccccttttcaggggggccctggggaccggggaccccccttgggggtcccccctcccccccccccccctggggggtttttttcctgggggccccccctgcccctgccccccggttaaaaaaaattcaattggtttttttttttggggcccaataaaccccccccgggttttccccca

SEQ ID NO: 606460 - DNA, 1189 bp, Homo sapiens
  misc_feature (136)..(136): n is a, c, g, or t
  misc_feature (182)..(182): n is a, c, g, or t
  misc_feature (209)..(209): n is a, c, g, or t
  misc_feature (231)..(231): n is a, c, g, or t
taatgatattggaagaaggtggtaggtaggaataagtggttgtgtgtgtggtgatttaggtagaattgtgtggattataaggagaagctttaaagaaaaagacaaatgaagaaaggaattttataggagcgacgangaacaaggaggaggaaggaagaggaaaaaagaggacagcggagggngggaagtggagaaaagagggggggagnagcgggaggaacgcacagagcnccgcgcgttgcacctatatgatgctatgcatataagccgtttgacgagacgaggtgaggtggacgagaatgatgcgcagagaccatctcagtacctcatcaatcatatatccataactgatttgtaagtaaaccacattacatcattaatattcctctattatttatcttcgtgaatcgtactcgctgcgtcgtgctataacggatgcagcaaggaggcgtcagctgtccatagcatgtcctaccactcaactcctacttcttcactagcatcgaagcgcacaaaacagtcgttaacgacgtctatagcggcctccccccccacctctcctccacacatctctactgagacgcctcgtcgactctcataggaaaatgtcatttagcgtcagagagtataggtaatactcgtcggcgtcctcttatcacttctgctgtccactgtcatgctgtcttcatttctttcgactatctcctctgctttcgtgtcggctgtccatcggttcggttacgtccgcactgtgtttcgtcggagtcgacgcgttttatcgtgcgattcgatcgcaacgaagaataggatataacgttacgagctaacgagtggttctagttttgttgttcggataggtcactgaggcttacatatcgtgccaacgtcaggacgtaatgtcgctgtcgctcattatgactcgcgctaggtaatgatcatccatcctcggtggcgttacaacagacagatatcgcactctggcttccacgtttacctctgtacaccctcctgcgtcgtccgtgtcggcgtcgcctcatgggccagactataccgtatggttgtgtccatgcattataacagcgacgtgactgtgtatattctatggacggagccgattaggagtccgaacagtgtctgtcgctgtttccgcgctgcctgtctctacactccacaccgtagactcatacct

SEQ ID NO: 606461 - DNA, 316 bp, Homo sapiens
ggaggcagaggttgcagtgagccgagattgtgccactgcactccagcactccagcctgggtgacagagcaagaccctgcctggagaaaagaaaaaaaaaaaaaaccccggggcttcacatttaacacacagggacacagggctcagcagttgttttccaggtcagctggaagtatctccgacccaaagctgtgaggggggcacctttaggtgggaaaggaaggtaggtgggggtagggtgaggatattagacagcttgcagagaccaccaagaagggggaatgcaggctctcccagaatgccccacagatccaatg

SEQ ID NO: 606462 - DNA, 104 bp, Homo sapiens
ctgtacttaaagtgtgaaggacacaggaagcttcattcttcctgagtgcttacaggaaaatgtgctcagaacaggcccgaattcccttagcaccagcacgtatt

SEQ ID NO: 606463 - DNA, 708 bp, Homo sapiens
acaggaccacaggatggaggcgaaattaaaattgctaatgaagtttcgggcaccattgtcattgataacatcttatcaggagacagcgttttgagatcaaccggtctgaccaaaatttattaggcgggaatttcctcttcctaataagcctgggagtgctgtgggagactggagtttatttcacctctgcaatctcgaccaaaagagacagatacgccccgcgggggccagttcagagacctacccctaggtgcgcattctctttctcagggacgttccatgctgagaaaaagaattcagcgatatttctcccatttgcttttgaaagaagagaaatatggctctgttctgcccggctcaccggcagtcagagtttaaagttatctctcttattctctgaacaattgctgttatcctattcttttttcaaggtgcccacgtttcatattgctccaacacacatgctggacaatttgtgtagttaacgcaattattacagggtccctgagacgatatacattccttctcgggtgacaggattaagagattaaagcaaagacaggcataggaaatcacaaggatattgattggggaagtgataagtgttcatgaaatttttacaattatggtcagagaatggccgcaaaactagcattagaaaattcgaaaggtcttattttgaggagactaataaaggtccatgaaatc

SEQ ID NO: 606464 - DNA, 1157 bp, Homo sapiens
ggggttgcaggcacccgccattgcgcctggctagtttttggtggggacggggttttgccgtgttggccgggctggtctcgggctcctgacctcatgatctgcccgtctcggcctcccggggtgctgggattgcaggcgtgagccactgcgcccttcctatcacttatcttgtcatgcttacattattccccacaattttaggttttaaatttttattaatatatcaaaggggtgaggagcgccgggatgtcaccgcagtgcgggtggccacaaggacgtggaccatacaaagctatcacgagggacaatcgaacataggaaactacagatgccatacagccaacccgaagaacatacaagcggacttacggggtgaaatatagaccccacatgtgtgtcaccccctatcagcgcgcacccagaaaaagatattacatagagtgggttcccctctcaaatgacggggacaaaaagagaatgcacactcttcacaattcatatctcgtggaggcccgtataaagccccagaaaagctcacattagtagaagaacaatatacacaaaacatttcacgacagacatataatatgcaccgcgcgcccaaacagagagagtttagagaccacaataattccaggggagaccccttacacacaagcgaaacgtcgccccacaaaatgagcgaacagaacatgcgaaggggggccacaacaacaatacatcacaaaggctactacggacacacaaaaaagcgagagatcctgaaccaagaaaatattaccaacataaatctaccggacgaacattctctgaagaacaacaacgaagaacaccaaagataacaggacgtaacaccgcaaactaggcgactgagggcagcacacaaaaagtgagcaccccgggaggaacccccacagaaggcacatagcaaacacacgcacttgttgaaccaccactgagacgcattaacagagggaacgaaccacacaacgtaatactggggcactggcaatcaccactatgtataagggaaacgcaccactccaccctaatactatccagctgaccatcagctggagaacccgaatatgagaccctgagagaacaccagtgaagaagaggagtgcagaaaacggaataccacacgattgactaag

SEQ ID NO: 606465 - DNA, 116 bp, Homo sapiens
aaaaaaaactaataccggtccgtatgaaacctgtatcaacccttcatcaaacctcatcacaccctaatctctcattgcggtaagtctgtgtagtggtctattgagggtttcgatga

SEQ ID NO: 606466 - DNA, 429 bp, Homo sapiens
accctgagaccctagcaaggctcctccatcagctgagagctgcttccactcaataacacttcgcactgattctccaagcccaggtgtgatccgattcttctggtacacccaggcaagaacccaggatacagacagccctctgtccttttgataactagagggtctcattgacctggttaacacaagctgcctacagacggcaaaactaaaagagcaccctggaacacacgcccactggggcttcagctgtaaacattcacccctagacacggctatggggttggagcctgcctgtctgtatgctcccctagaggtttgggcagcagggcactgaagaatcaagccacacccccatcgcacaccctgcgagggggacaagggaacctttctcttttcagttggtcttaataaacactgagtaaagtgaaa

SEQ ID NO: 606467 - DNA, 710 bp, Homo sapiens
cacaccggtggccagttctgcaatcagcatcctttcaacaactcctgttgacaacagcacacctgtgaccacttctactgaagcccgttcatctcctacaacttctgaaggtaccagcatgccaaactcaaatcctagtgaaggaaccactccgttaacaagtatacctgtcagcaccacgccggtagtcagttctgaggctagcaccctttcagcaactcctgttgacaccagcacccctgggaccacttctgctgaagccacttcatctcctacaactgctgaaggtatcagcataccaacctcaactcctagtgaaggaaagactccattaaaaagtatacctgtcagcaacacgccggtggccaattctgaggctagcaccctttcaacaactcctgctgactctaacagtcctgtggtcacttctacagcagtcagttcatctcctacacctgctgaaggtaccagcatagcaatctcaacgcctagtgaaggaagcactgcattaacaagtatacctgtcagcaccacaacagtggccagttctgaaatcaacagcctttcaacaactcctgctgtcaccagcacacctgtgaccacttattctcaagccagttcatctcctacaactgctgacggtaccagcatgcaaacctcaacttatagtgaaggaagcactccactaacaagtttgcctgtcagcaccc

SEQ ID NO: 606468 - DNA, 214 bp, Homo sapiens
gctcccaggaagcccgaaacggatcctgattctggttattgaggttcaaatgcagacgtggggctgcattgcctcccccttgatccctgaatgtgggcgtctcagttcttgagagccttaaacggtaatgaattgtggtgctcacccataagaggtatgaaggagggttcggaggtgtcccttgcacaacttcagtcatgagtgcgcgcgttta

SEQ ID NO: 606469 - DNA, 327 bp, Homo sapiens
gtttatatgtaaataaaactacccatggcccccccccttgcccaaggggttcaaaaaaacgtgcaatataggttaaaaaaatgtttattgaaactttttcccaggctgcccttataattaaactagtggtggggcaagcaacatttgtttcaagtagatcaggggctagcaaacctaaaaggcagcaaacagcctgcagtttgctcaatccttaaaaaaacatggttcatacaacatgctttttctatgttttaagtgtgactttttaaaaaaacaagtgttttgggcaaatttgggtaaataaaaacataattttcccccttgtta

SEQ ID NO: 606470 - DNA, 115 bp, Homo sapiens
atttcgtgaattgaggccatgttcaggtgctaaggtagttcgcctttgacacagaagattgagatagtttcctagatataggtgcagataagtcagcgttgcagtggtgacgtgt

SEQ ID NO: 606471 - DNA, 430 bp, Homo sapiens
gcacgagatggtttagcactatcccccttggtactgtcctcacaattgatagtgagggagttcttgtaagatctaattgtttaaaagtgcatagcacctctctcttcactctctctcttgcttctgctcccaccacgtgaggcacctcactccccctttgccttctgccatgactggaagcttcctaaggcctccccagaagcagatgccagcatcatgcttcctgtacagcctgcagaactgaactatgagccaattaaatctcttttctttataaattacccagtctcaggtatttctttatagcaacatgagaacagactaacacaccctccctggaagggaagggggtatgcacaatggaatgagtactcactctgttaatttccgtgacagctggttgttaaaaagagcctggcacctccctccc

SEQ ID NO: 606472 - DNA, 760 bp, Homo sapiens
ggctccgcgtctgtgaggtccagtggccgccaggcgcgatcagatctgggtgcgcggagagcgcgcatggcggtgtgggaccgcggaccggccccgggaaccggcgccgaggctctagcgctggcggcagagctgcagggcgaggcgagtgctccatctgcctagagctctttcgtgagccggtgtccgtcgagtgcggcacagcattctgccgcgcctgcatagggcgctgctgggagctggccctggtgcgcggggtcttgttggggccagcagcctgagcgcccccttcccactgccctgtccgcagtgcctgtgagccctggcgccccagtcagctgcggccaaccgggagctggcggctggtggccacgctcctgcggcgcttcagccctgcccgcgtgtgccccggtgagagcacgggtctcaggcggacgagggcccagggcagcgggcttgcccgctgcgggccagcgatggcagaacccttcaagctctactgcatggagcgaacaggaaatgcgaccatctgcgatgggtgtgcagaacggagcacgggaaggcaccggggaggcaagcggttgttggcggttggactgagggcgtgtgcaggaggccaaggaggctcttggagtccaagggtgaggggtcttgaaagaaggggaactgggatggattgtgagggtgttccggggtcaggggaagagaggagtagaaggaggttggtgaaaagattggagggagagaggaaaagggggga

SEQ ID NO: 606473 - DNA, 1073 bp, Homo sapiens
catcacagcgctaagctcgcactgattaattacctgagtaggcctagaaataaacatgctagctattattaccagttctaaccaaaaaaataaaccctcgataccacagaagctgccatcaagtatttccatcacgcaagcaaccgcatccataatccttctaatagctatcctcttcaacaatatactctccggacaatgaaccataaccaatactaccaatcaatactcatcattactaatcataatgggctatagccaataaaactaggaatagaccccttaacacttctgagtcccagaggtaaaccaaggcaaccctctgacatccggcctgaattcttctcaccttgacaacaacactagaccccacatcttcaatcattataccaaaatctctccctcacataaaacgtacagccttctcctacacttctctcaatcttatccatcatagcaggcacagttgaggtggcttacaccaaacccagatacgcaaaatcttcgcatactcatcaattacccaacataggatgaataatagcagtctagcggataaaaccttaaattaaccatcttaattaacactataatataatcctaagtacgtaacgcatccatactactcaacttaacagtcccagaacccagaacctaataatatagtggcacctgaaaccagctaccattgctaacagccttaatacatcacactactctcctagaggctggcccggaaaccgggtaaggccacagtgcgccatatcgcaaaatacaaacacaaagccaactcatcccacacaaaccacaaaccgcattaacctataagttacaaaggccaaacaagaaaagcaaaaaagcaaacgggggcgctgacccaaagacataacacaacgttgaggcgcgccaagagaacaaagaagactaaagacacgcagacagcgggcatccaacaacgagaggacataacaaggtgtatgaataccagccactacacggcggcgacgaacgaaacaccgagcagccgacaagcacacacaaacaaaccgacgtagcaccccctcctactggac

SEQ ID NO: 606474 - DNA, 172 bp, Homo sapiens
ggcagatgcctcatcgttctgcagaatgtggggggtggggaggcaggccacacggaaatgagtgctgctgcctgtatgagaggcctggggcatggactgcgccctctgccctgcgcaggactcagatgacttcgaggccctgtgcaatgtgctacgccgtcccaaagcacag

SEQ ID NO: 606475 - DNA, 118 bp, Homo sapiens
  misc_feature (66)..(66): n is a, c, g, or t
  misc_feature (73)..(73): n is a, c, g, or t
atttgggagtaggaagtatcttggagctgaatggacagattggaggagagtgaatatagccatggnagcccanataacaatgtcccctttgaaacacagagagtttagggcagagaga

SEQ ID NO: 606476 - DNA, 139 bp, Homo sapiens
  misc_feature (74)..(74): n is a, c, g, or t
  misc_feature (81)..(81): n is a, c, g, or t
  misc_feature (85)..(85): n is a, c, g, or t
  misc_feature (116)..(116): n is a, c, g, or t
gtaacagtcaatttgtgaccaatgaaggggggtggaaggtaaaagaaggcattttccaagtctgagttttcaanggtactngaangggtttaagaaagaaatttttaaattggagnggttttgcaaaattttaaaaggg

SEQ ID NO: 606477 - DNA, 154 bp, Homo sapiens
tttatttgatgcacacctgatccgaggattgtataaacggctaggctagaggtggctagaataaatagtgaggcctagtgttgaggttgaccagtgggttgggtatggggaggggggttcatagtagaagagcgacggtgagagctaaggtcgg

SEQ ID NO: 606478 - DNA, 124 bp, Homo sapiens
gcggccgactactactactactgctcgaattcaagcttctaacgatgtacggggacatgcataaaggaaatcaaatgttatttttaagaaaatggaaaataaaaactttataaacaccaaaaaa

SEQ ID NO: 606479 - DNA, 219 bp, Homo sapiens
acccatagtaaggtcgacgtcgccatacatggatagatctctagaggtcgaccaggactccaccttagcgagtatttggaggtcacgcacggtgctcactgtgtcgacggaacttgtacagggagtgcatgcacctgcacgtggtgaatacactgtcgaccatggctccagtcttaacagatattttggaggtcagcacgtgtgctcactgtgtctgac

SEQ ID NO: 606480 - DNA, 797 bp, Homo sapiens
  misc_feature (583)..(583): n is a, c, g, or t
ttccctccccagaatcaagctttagcttgatccatgaagagcccatatcactaagatggcatatatgtgatctgggcatgtacctcctctgcctacagccaggtttagcggcaagactttccccgcttagcgagccttcagggcgtgagttctgggttgtctagaggtcaaggacggcgtcctctagagcgcctaggaagccagagccccaagcaggacgaaaaagaggcgatacacacagcagtgtgaatagcctggccaccagccatcctccctccacctcaagacccccgatttgtccagagactaaaggatccagagagcagctccctttctcaggagcttgggcagtgccccagggagtccagggtttctctgcagatgtgcggagcgggaggcgggggtacgagcgagatcacacgggggagttcctctgatgtcggttcagggattgtacttgtcttacatttgtatgagacagggtctgtgctcttgtcccccaggctgggagtgcagtggcgtgatcatagctcactgcaggcctctatactccgtgggctcgaggcaatcctcctggcctcangccttccgaagctagctgggcacctacggtgcgcgccaaccgtgcctggtaacttttcatttggtccgtagggacggggtctcgtgggtggccaagggggggtctcaaatgtgtggctccagcaattccactgtctgtggcttcccaagtgctgagattgcagatgtgagcccacgtgcttgggcggattgtttggaacaccctgctcttcctg

SEQ ID NO: 606481 - DNA, 371 bp, Homo sapiens
gaggtccagatgatcactcactattccgtttctaaattttctgggctattctatttattcttccatgtgaacactaagatcattttatctaattctccattccctaaagaatcttccatgggagttctaatgggactcccattaaatttatatatatcagtcttctcattcaggaacacagtacagttggcccgtccatatcttggggttccacatccatggattaaacaaacctctaagtgaaaataggtggaggaaaaaaagccatctgtactgaacatgtacagattttttttttccggtcatcactctctgaattataaagaataacaactatggacatagtatttccacggaggtgatcttcggca

SEQ ID NO: 606482 - DNA, 256 bp, Homo sapiens
  misc_feature (59)..(59): n is a, c, g, or t
  misc_feature (80)..(80): n is a, c, g, or t
  misc_feature (126)..(126): n is a, c, g, or t
  misc_feature (176)..(176): n is a, c, g, or t
  misc_feature (186)..(186): n is a, c, g, or t
ctcaatatccatggggaattgtttccatgaccctctacagatatcaaaaccaatggatnctcaagtgccttatataaaanggtgtagtatttgctcatagcctacatacatccttctgtatacttnaaatcatctctaccttacttataatacccaaaacaatgtaaacagttgtnatactatatngtttagggaataatgacaaggaaaaaagtctgtatatatttggtacagagggaacctttcatttaaaaaa

SEQ ID NO: 606483 - DNA, 341 bp, Homo sapiens
  misc_feature (6)..(6): n is a, c, g, or t
ggtgancctatcgcggatgatgcggaggtgatcggattacggatgatgcggaggtgatcggcattccggcatgatgcaggagatgatcaggcttacgcgatgactgctggaggtgcatcggagttacggcatgatagtggaaggtgatcgcgattacggaatgatagtggagagtgatccggattacggcatgatgtggagagtgatcgcgattacgagatgatgctggagagtgatcgcgattacgagatgatgcggcaggtgatcgcgattacgcgatgatgcggcaggtgatcgcgattacgagatgatgcggagagtgatcgcgattacgcgatgat

SEQ ID NO: 606484 - DNA, 1420 bp, Homo sapiens
tctcggtcgtgcacccccctaaagagcttggtgcaggaatttagctgtgttgtcctgaccctcaggacaaactcatctaatgcaggctcagcttgtactgaaggctttgtaaacaaggaaagttctgtagggtatcagcatggcatttccagagagttcttaatctacagatttatcaagaaccagaaccccatggacgtccctgagggagattgagccaacctggatttgaggaaagaatgagataatgtgtgctcaacgtgtaacagacaccccagaagtcaagtggcagaaggttttatatgagcggcagccgttccctgataactatgttgaccagaggttcctggaagaactccggaaaaacatctatgcccggaagtaccagtactgggctgtggtatttgagtccagtgtggtgatacagcagctgtgcagtgtctgtgtttttgtagtgatctggtggtacatggatgagggtcttctggctccccagtggctttttgggaccggactggcatcttccttggttgggtatgttttattcgatcttatcgatggaggtgatggacggaagaagagtgggcggacccggtgggccgacctgaagagtactctggtctttatcactttcacttacggtttttcacctgtgctaaagaccctgacggagtctgtcagtacagacactatctacgccatggcagtctttatgctgttaggccatctcatcttctttgattacggtgccaatgctgctattgtatccagcaccctgtccttgaacatggccatctttgcttctgtttgcctggcctcacgcctcccccggtcactccacgccttcattatggtgacgtttgctatccagatctttgcactgtggcccatgttacagaagaaactgaaggcgtacaccccgcgaagctatgtaggggtcactttgctttttgccttttctgcctttggaggtcttctgtccattagtgctgtgggagccatactctttgctctcctgctgttttccatctcctgtctctgcccttactacctcattcatctgcagctttttaaggaaaatattcacgggccttgggatgaagctgaaatcaaggaagacttgtctaggttccttagctaatctagggaccttcatttcattattaagaccagcggaaagacttcgagcctaaccggtgcaacatttaaaggcaggggtccactcttgaagcagccgactgatctagatggtagagctgagatcagaagaaagcatttaaccaagggcttaggggagggtgcttgtccttcagttattttgtgactgaaaaagctttctggtgctgttatgaattattgtcctttattccctgtaacaaatgatgtaatgtgggttctgcttattaaaaaagtaatatcc

SEQ ID NO: 606485 - DNA, 1074 bp, Homo sapiens
ggctgcccatgtcctgctggtgcctgctgcctgctgctccctgccgctccctgccgctccctgcatgcctgcccctgcctgcctgccctggagccccgcgtccctagtgcctggctcccgcctgccctgagacccgcccagcctgccccagctcagcctgccagagaagatgcgtgctgctcccggaatggttcctcttgctctttggccctgtggctccttagtgaagtgccgtcagtgcccatgataccagagtcctgtgaatggccgcatgtacctagtgggctgctgccccagactgctggcctggatgctgggtgcccccggccatgcatgctcccagatgccaaggtcttcgtgactggccataggctgtggtgcctgctgacctgcgacgctcgtggcctgagcctgaccagaccacaccgggggctgctaggcccctggggcaggggtgcaagcctgtgggctgttagccctgctggcagcgacaccaaggagtgaagccgtaccatcaaggtcgtgctgcgcgccaaaaagatcttcggctgcgggggaccttctactttacgggtgccataccctcaagttattctgctgctaggtgaccggcaagatcgtggaccatgtagaacaggtaccttcagctgtgtattaccgccacaactcgtccagctgggcaactcagtgtcagcatcgtgccgcctcaaagcgtgtcgagtcgcacgagtctggctgcccgggccatggtccccaagcctctgcacgtttacgctctcccctgcgaccgtgttggatcttggcgctaggtgtgccccggtgcggattgcaccctcacctgcgcggctccgtggcttgggggctcactctggtagccaatgctgtcgctgttattgtcttgccctgcctgggccaaccagccgcgctcactcgccccttgccatgaacacaacgggcggagaccgacgtacgttacaccagcacgactcacgcccacaaccagacgtaattacgcaagccagccgtgtcccagatatttagctccaacagtgcctaaatccccgtacccccctc

SEQ ID NO: 606486 - DNA, 902 bp, Homo sapiens
ggaccttgagccctcaggagacgatattggcggtctctctgtaggctgagtgccgttgcagggtgccctacgaggtcgagctctgtggcttcgaactccagtggtgagacctgctcatatctcagaatgtcttcaggagcgagctatcccagaatggtgtggaggtgcagcacatacagctgtgtcaccgacgtccgaccattctggctccacaggctgcatctctcctgcgtggggctagcgagagggtgttcagtgtttttgctcctgggtctgcttccggctgcttacttgaatcctttgcgtcgtgtgatgagacgtacttccgctgtgcattgcgtgatcctcatctcgttcactggtcactgtgggccctttgtgacccagggtgtgttactgccatattgtttcatggcgggatgccatcggaagaagagctgcccaaggagcgcgggctttttatggcgacttgtcaagctttacccgttttgcctggagttattgtctcattctcaactactcacagatggggggccttctgtcctagtcgtgtgcgccagtgtcctgtggaaaggctctggacctttgtttgaactttccattaacttgtgtaagcaatagtatgtgatggcctctatgcttcttgctttgtggtcatggccttttcatagtctcacgataagggatggagataccggtaagtccattggtcgaacaaggctttcttcgtcgttgatcacgagattattgcaggaatggactccttgagtgaccaaggtgtgggacgggacttatagtctaacgtgggagaccggggcatgtccgggggagcaagggagcctccagaggtcaaaagacccagaaaattgacatgaattgaacgctggcccagtgatcaaacc

SEQ ID NO: 606487 - DNA, 240 bp, Homo sapiens
gttccctttgtctgtgtgtggtagagcacagctgtgctatattcaaactcaaaattttgttacatctaagaaaagacttcacatgatgtctgaaaagccagcttagcaaagagggtaacataaaggtgctaggtctgggcttggtataatcccacgacaccgaggcccacctcctgggacaatgtggtagaaggacagaccccttccctccgggtgtctgtatggagacaaagggaaaca

SEQ ID NO: 606488 - DNA, 474 bp, Homo sapiens
caccaatcttaccatggacactgaaattcgcatagagtgtaaggcgtacggatgagaacatgggtacagtgagaaagaccgttttcagggacgttattgatgtaaaaattgaagttaagagctgatccacaagcacaaatctttccacactagccatcttaatcaagttaaacaccaagatacaaaaacaacaaacctaatagatcttgaacaacacttgtcatacgtatgggaccctacacttaatcatatatgcttacaccactagactatccctgcacttcaagtacggcgaagaaaaggataccactcccaagctgtagccacacgagcccaccaaaacctactaatagtcacatacctgacaaactggaccacacaggaaaacagcaaccacataggagacccataggggcaacgcggccgcacaccacacccggccaaacccatgaaagcaccagaaactgaactggc

SEQ ID NO: 606489 - DNA, 615 bp, Homo sapiens
  misc_feature (27)..(27): n is a, c, g, or t
  misc_feature (61)..(61): n is a, c, g, or t
  misc_feature (71)..(71): n is a, c, g, or t
  misc_feature (82)..(82): n is a, c, g, or t
  misc_feature (86)..(86): n is a, c, g, or t
  misc_feature (121)..(121): n is a, c, g, or t
  misc_feature (124)..(124): n is a, c, g, or t
  misc_feature (126)..(126): n is a, c, g, or t
  misc_feature (133)..(133): n is a, c, g, or t
  misc_feature (137)..(137): n is a, c, g, or t
  misc_feature (145)..(146): n is a, c, g, or t
  misc_feature (149)..(149): n is a, c, g, or t
  misc_feature (153)..(153): n is a, c, g, or t
  misc_feature (159)..(159): n is a, c, g, or t
  misc_feature (162)..(162): n is a, c, g, or t
  misc_feature (172)..(172): n is a, c, g, or t
  misc_feature (177)..(177): n is a, c, g, or t
  misc_feature (184)..(184): n is a, c, g, or t
  misc_feature (201)..(201): n is a, c, g, or t
  misc_feature (204)..(204): n is a, c, g, or t
  misc_feature (240)..(240): n is a, c, g, or t
  misc_feature (242)..(243): n is a, c, g, or t
  misc_feature (251)..(252): n is a, c, g, or t
  misc_feature (256)..(256): n is a, c, g, or t
  misc_feature (261)..(261): n is a, c, g, or t
  misc_feature (264)..(264): n is a, c, g, or t
  misc_feature (271)..(271): n is a, c, g, or t
  misc_feature (278)..(278): n is a, c, g, or t
  misc_feature (296)..(296): n is a, c, g, or t
  misc_feature (316)..(316): n is a, c, g, or t
  misc_feature (322)..(323): n is a, c, g, or t
  misc_feature (331)..(331): n is a, c, g, or t
  misc_feature (342)..(342): n is a, c, g, or t
  misc_feature (352)..(352): n is a, c, g, or t
  misc_feature (376)..(376): n is a, c, g, or t
  misc_feature (378)..(378): n is a, c, g, or t
  misc_feature (382)..(382): n is a, c, g, or t
  misc_feature (384)..(384): n is a, c, g, or t
  misc_feature (484)..(484): n is a, c, g, or t
  misc_feature (521)..(521): n is a, c, g, or t
  misc_feature (551)..(551): n is a, c, g, or t
  misc_feature (603)..(603): n is a, c, g, or t
tacccatctcacacaccttccaccctnttttcaatttctcactttctccatcatccaattnacttaaatcnaactaaattcnaatntcaatctccatctacacaaccatattcccaatctnatnancaatatncttnccatcttnnttnccanaatcanctnccattccctnaactnacacaanaacaacttatctccctnatnccaaaaatgcacctactctttcctctaactctggtnanntcattctnnagtnacatnatngactccncacacancttcataacctcttcatngactttttatcttcaagccnatgacnnaaaaatanttatattccantctaagccanaaatccactacccaccacatttcnancacnancctacaaatttgagagaatcatctctaagcaaaatgtcctcagatctgcaaatgagaaattcacaagcgcacaggaattttcttgaagatggagaaagtnatggcttttttaagatgcctctctcttaactctgggnggattttaactacaactcttgtcctctcgntgatggtattgctttggatttgttgtgcactgttgctacagctgtggagcantatgttccctct

SEQ ID NO: 606490 - DNA, 824 bp, Homo sapiens
  misc_feature (167)..(168): n is a, c, g, or t
  misc_feature (178)..(178): n is a, c, g, or t
  misc_feature (180)..(180): n is a, c, g, or t
  misc_feature (198)..(199): n is a, c, g, or t
caccaagtgccggaagcggaagctggagcgcatcgcgcgcctggaggacaaggtgaagacgctcaaggccgagaacgcggggctgtcgagtaccgccggcctcctccgggagcaggtggcccagctcaaacagaaggtcatgacccacgtcagcaacggctgtcagnntgctgcttgngngtcaatggtgacacgccnntctgaacgtcccctgcccctttacggacaccccctcgcttggacggctgggcacacgcctcccactggggtccagtggagcaggcggtgggcacccaccctgtggacctaggggcagccgcaaaccacactggactccggccctcctacccgtgcgcccagtccttccacctcgacgtttacaagcccccccttccacgtttagttctctggtactgtctatttattcctgctggaaacagacctcgagttcatattgaatataatatatccgtgtatttcaacagggcaggggaagagggggcgatcgcggcggagctggccccgacgcctggtactcaagcccgcgggggacattggggaaggggacccccggccccctgacctcccactcatctgcacccgtactgtggcaaaacgcaaacacgcacttagtcctctaaagaggtcgaatgttaacgacagtgtaacggcgtaggagtgtgataaggacctatgcaattgaaatctatataaagtaaagacagaaaattgggaacatgtaggaaatatacaaacaaaacagaaagaaacaaatatagtaatagtacagaaaaacaacaaacaaaaacagcaagaaaagacac

SEQ ID NO: 606491 - DNA, 416 bp, Homo sapiens
cacgaactgagggcgctgatggacgagaccatgacggagttgaaggcctactctgaactgtaggaacaactgaccccggtggcggaggagacgcggtcacggctgttcaaggagctgcatgcggctcacgcccgtctgggcgcggacatggaggacgtgtgcgggcgcctggtgcagtaccgcggcgaggtgcatgccatgctcggccagagcacacgggagctgcgggtgcgcctcgtctatcacctgggcaagctgtgtaagcggctccttcgcgatgccgatgacctgcacaagcgcctggtagcgtaccaggcctggtgccacgagggcgccgagcgaggtcttaacgccattgctcagcgctctggggcccctggaggcaggggcgcgtgcgggccgtcctgtgggcttct

SEQ ID NO: 606492 - DNA, 285 bp, Homo sapiens
acaccactgagtcatatacaattctctttttttttttgagaaaactattttcaataccagtgaaatttctattgctaaaaagccagcactttaactgattatttaaaattctaagagacattggaaactagtctgaaatttggacctaggaacactgatgaaatacaattggaattttaactgtctctgggttgtttacattcaaaaattctttacttttccttctttcctatttcaaggtttcagcaaggtaagtcaagtgtttttgcgtgacaaggtgagttg

SEQ ID NO: 606493 - DNA, 912 bp, Homo sapiens
gctctccccgagcgccgctccggctggcaccgcgctcgctccgagtatcaggctcgtgctcatagctagcagccgtcgtcgtctccctctccagatacgccatcatgattatctaccgggacctacatcagtgacgtatgagatgttctccgcacgatctagaagatccgggagatcgccggacgggttgtgcctggaggtggaggggagagatgggcagtaggatataaggtacaattgatgactggttcataagagggataatgcctcggctgaagagtcccgagggcagataggtaccgtacagcaatagtaatctactggtgtagatattgtcatgaaccatcagcgtgctaggaaacaagtgtcaacaaaagaagcctacgaagaagtacatcgaaagattacatgaaatgcaatcaaagggaatacttgaagaacggagaccagaaagagtaccaccttttgatagacaggggctgtagaacaaatcaagcacatcctgtgctaatgcaagggactaccagttcttttatttggtgaaaacatgaatccagatggatggtttgtctattggactaccgtgaggatggtgtgcacccatatatgattttctttaaggatgggtttagaactgccacacactgttaccaatgtggcattatttggatctatcacctggtcatcataactggggtctgctgcatccaacaaaccagatttagaacaatggctgatggtaccttgagccctcattattttgacggagtaatgggggggcgtgtgtttagaaaaatgtctggtgggcgtcaaacagggcttttgaaaaaaaaaaaaggcgaattttttacacctactcttgaccccacaggggcatgggcggaacgctgttttacgccgcgcgcgtataac

SEQ ID NO: 606494 - DNA, 449 bp, Homo sapiens
  misc_feature (371)..(371): n is a, c, g, or t
  misc_feature (382)..(382): n is a, c, g, or t
  misc_feature (429)..(429): n is a, c, g, or t
tcagctccctcctctctggtactcacctgccaattccagctgtcttagccttgccaaactcccagtctgtcttctcagcttagcatggctgctgcattccacttctgcttgggttcctcccctaccctatacccctgtccataaattgttaccaagtaggaagattggagagcttaccttttctcacagctcatggtcctatacctgttgttctaatgcctgaaatagttggttcatatgctttaattttctagttgtttatagccagagggcaagtgccataccatttggttggatggggaagtagaaacttgccctttaatgagtgtaccatgtattttttaacacaatgtggccctcacacatgtggntccctctatcnaggggtgtggttgttaaccatttcatctagtgggatttctaagtaantccttcaagggttcaggaat

SEQ ID NO: 606495 - DNA, 1001 bp, Homo sapiens
tggaaatgcaaatggaggctgtcaactggtgtaagagaaatgagggctccgtatagagcagctttcttcctgtagatgttaatgcataagtaatcatctcgtgttcactagatagaagcggatgaagaataaagaaaaagcaagttctttgatcagtgtactcagacaggaagggataggcacaagtgacaacttcatgcaggctttccgtgaatgtattggaccagatgtgccgaactggaggtgtgacatccctttggtgaaatcctatgttagcacagtttgcagcctcgtgccatcacttgcagagctggtgagcatttcagagagcatagctcaaccactagaaagtggctacccatttgcctctcttcctacttggtcttcaggcagttagcgttaacattacaagatcgagaatggttaacagaactttttcagactaaagcaaggtcaatatgcagaaacgtgctcccagagcatggatgcagaataaggaccgcatgttgggtaagattgggaaggaatggggactgggtttcttattcccatctcctcaaatgcgggaaggagctgttgaagcagataaagtcggatccagtccctcaaagcatatattagatggctgagagataacatctctccgaacttcatgtagattaagggtgggtgacatctgtatgactaggttttaccagtgtcatttctagtgaagtagactgctcagggatgaaacgatttatactctgtctgcaagaaagtgtgagaggaaaagaggactagtatttgagcgtaaggagaagttttctggtgacgtggactcaaagtcgggcgggtggtgtcaggggaggtgttaaagacatcacaaggatgtattggtgggggtataaggaaattaggaagattgggtggacataaagtgtgaagaaggtgtggaaagggttatgtgaaaaagagagaatgaggggtgggaggaagaaggagattggtgatagtagaag

SEQ ID NO: 606496 - DNA, 151 bp, Homo sapiens
cctcgggtctcctgtgtgcaccttctcagaacccttacgataccacatgcctaacatcatgcctcacaactggacttcgatgctcgatgtaggcagatggtggtgtcctgggtggcttttgtattctaccacccgaacccactagcagaga

SEQ ID NO: 606497 - DNA, 446 bp, Homo sapiens
tatgtgggatggtagataattaaaacaagaaatgatgatgacatgagatatatggtaaatgaggaaaaatgttaaggtgctttaagggcaattattgagagtaagaaaaggcttctctgagaaaaatgagttttatacttattcttgggggatgattagggcaattagaagttaattgggtaaatgggtaatgggtgtagtgggttatatctggtaatcctagcattttgggaactccgaggcaggtggatcacttgaggtcaggggtgtgagaaaagcttggccaacatggtgaaaccccatctcttctaaaaatacaaaaactagccaggcgtggtggcacctgcctgtagtccaggctcctggggaggctgaagcaggataatcgcttgaaacaggaggtagaggttgcagtgagcaaagatcgtgattcagtctcaaaaaaa

SEQ ID NO: 606498 - DNA, 354 bp, Homo sapiens
tcactggtctttatcagctagcaaaagatcaagtttaagcccaaggaggcaggagaatggcgtgaacccgggaggcggagcttgcagtgaaccgagattgtgccactgcactccagcctgggcgacagagtgaaactctgtctcaaaaaaaaaaaaaaagcccctgtccacacctccagcagttgccaacacgcccggctaattttttgtgttttcagtagagacagggtttcaccatgttagccagaatggtctcgatttcctgacctcgtgatccgcctgcctcggcctcccaaagtgctgggattacaggtcgacgcggccgcgaatttagtagtagtagtaggcggccgc

SEQ ID NO: 606499 - DNA, 431 bp, Homo sapiens
ctggcattctgcaaatcagttgccgtaatgcaggatcctcgggctttattgttcatggtctgttgtttttatgcaaaccatgatgttttatataagcttatagaatctgaagtaggtagtgatgtcccagcttgttctttgcttaagatgctttggcattaagggtttgtggccattactgcagtaaaaggcctggtcatgttctgggcttacagtctttaggtggggaagtctgtggcccacatgtccaacaggctgtgtgtggcacctgcaggctttgtccctgtggagcaggtgttactccctcatcaatttaggattattttatttatttcagtgaaaaatgtcaataaatttatagggtgcattaatctgtagattgtttggggttgtatggacattttaccatattattttcattcataaaaaaa

SEQ ID NO: 606500 - DNA, 143 bp, Homo sapiens
atcacctcgtaccttcagcagacattgagaagtcacaaaggaattggcattgacatatccattatttaaatgatgggctgtggcatatgaagacgtataaatgagcctcagaaggaatgcacttgggctcaatatgggtattg

SEQ ID NO: 606501 - DNA, 186 bp, Homo sapiens
  misc_feature (90)..(90): n is a, c, g, or t
gctttttgggggaaaattttttccccttgggggtggaggcccaaggcctcttggaactctttttaacctgtttaaaacccggaagggggntgccccgttttttaagccccccccgccagggccgggtttgggtttccccctttccagcccgggggagcttttttaatttaaatgggtttccgggga

SEQ ID NO: 606502 - DNA, 1408 bp, Homo sapiens
  misc_feature (1408)..(1408): n is a, c, g, or t
cacaggtgtcgtgagaactaccccttaaaagccaacaatgggaaaggaaaagactcatatcaacattgtcgtcgttggacacgtagattcgggcaagtccaccactactggaccatctgatctataaatgcggtggcatcgacaataagaagcacttgaaacacattttgacgcaacggaggcgtgcgtgagatgggaaacgggctcctctcaagatactgccatgggtctgtggcataaagcgtgaagacgcgtgagccagtgagatcggtgggtactcagcgcatatgaacttagtcgtcacatgtgttggcgtagagattctcgatggaccaaggcaaaagttcatctcactggtggaacatattgaactctggaagtgcaccctaggtatctaccacgtatgcacttctttactcaaagaaaagcaattgatatactatggtgacgaatctcatggctagactcggtagcgtcgtcctggtagtctgttagcgtcgctttggtgttgggtcgacatgtctgaagcgctcggtactctgccaagcaactgcggcagaccgctgagagcatgccctgtcttggacttacacacgtagggtgctgcacaacaatctaagttgctcgcgagttgagacgaaaatgggatgtccacttgtagcctagccttacagcccagagagagatatgacggaaagttgtctaaggcaacatgtcgagccactgtgacacttcaagagaaattgggctcatcgaacccgtacacgggtagcataaagtgccaattgctcggttcggacatggttgaacaagctatgctagtgagcccaaagtgctaacatgcctgaggatcaagggatggcacaggtcacccccgtaagggattggcatctggcaagtgggaaccggcagcttggtttgaggcccggggacctgcattcctaacatcaaagacgtccactggacaagaccttggggcgctggctcttcccaggaggttaccgacagtcggggggaaggtgaccgtggccctggaggccgcagtgtcaacaagggggagcctataaaccacgggaagatgttggtggcccccataggtgccacgacacaaaggctatacacggggagacaaaacgagggcggtaaacatgggactcgaaagcatggtgagaacaacaccctcgggggacaacgaacgcttccagctactacaggctatcgttacaggacaatagcagcgacaaccgaggatgcgtagcgaaacaccctacgtaacgcaggccgctggacgagatcaacgcagcaacgaacacgcatgatcgtctgagccgacgatcgaacaaagacgagacacatacggtggcagctaatggtagctacagagtctctctcaacggtctagagctan

SEQ ID NO: 606503 - DNA, 1334 bp, Homo sapiens
atctatggttctgccctgacagattctccatatcggggtcacagggacgctaagatcgctacctgcgactttcgattgaccatgctgatcccgggtggtactttccagccgccgccacagccgggccccttcatctgaagaatgcagccattcctaggatccagggcgctattgcagtgcacacaaggaccttctcatacagggacagccacaccttgctccctgttaccacactcattcctgcaatacggagcgacaaagctctcgtcatggacctgactcccttgaggaattcgttccaggttatctatatatccctaaaccctggtgtcaccagtgacccctatgctacatcgcgaactcgggacttcatcttgtaacgcctctgtatctcacacgcacaccctactactgctgcatccacgcgcacgagcaacccttacacctgcgcccctatcaggctactagcgctgtacactggatcctactggaccatcaacaacacttcatggctccccgtctccgccttgccacgcccctctactggctctgactcacaccctcacactgacgcccacagaaacgtatgccacccaaactaagtacccgcagcgcccacaccgcaacggccttcgccacttcccaacccaccacttcccagcgaaacttgcaccccttgactacatggacgacacggttcaccaacccacgggcccccttgtcttttcccccaacaaaccccgccccatttcaacccttctgacttcgcactcgctcggccccaaggcggacacttagcccactttggccctacattgggcgccttccggcacacagtttcacctcttcaccccgccggccacacccgaaccctgagttctctagcacccgttccatctttcacaccgcgggcacgcgtacacccagacactaccgcccccccgcgccacacccgcgtccacacctatcctactagctccgaccagccacccaactgaacacgtagtctccaccagcggacacgaccaccacaccccctcgctccctacccttggctctagctaaacatccactcctaccttcccctactctccccccaccaaactccaccacacacgcctgcacaccctatcccaacccacattcctccacactaacaccttttccctccaccatcgcctcccgcccccaacaacccatcacaacagaccaacctcccaccacacactatctccaaccacacactccttctctcccccaccactcctatccacaattcacacctagatacagactatccctaatcccacacaaccaccacctattcaccgcat

SEQ ID NO: 606504 - DNA, 201 bp, Homo sapiens
ataatctggattatcttgccctgacgtttccgtcgccaaagccaatggctcttccatcatcgcctgcatcagacactgatgccggtgcgcttgctggcttaggggtcgacacagctggtgccggcgttggtgctgtttcagtcggcgccactggtccctgccatttaatttccggttcgacaaattcagtagccggcgcgg

SEQ ID NO: 606505 - DNA, 287 bp, Homo sapiens
gcgcaacacacacattacccagaatcagccctgtagggttgtgttgggcgaagcggctggagttcattctctcacccccttatgttggtgtatggcgtgtgacagcagttctacagacgctctgctgtaggggtcatggatgacgcggctctcttggctcttaaaggcaggcctctctcttcttgcctttaaagaatcctccttcctcacacctggcctcctctggcttcagcttctcagcagcaggaacccgccttccacaacgacactatcattactatgctact

SEQ ID NO: 606506 - DNA, 371 bp, Homo sapiens
cgagaagagtgtgcaacaagctgtatagctattacagctaaggttccaagctgtggttcttcgttatgtgtgggtctacatgtctagatgtgtttatttgtatgtacacctattgttatacattgtgtctaccaaattggcttacaagtaaaagagcactcataaataaagtaaataagtttaagcaattttcaagttcacctgacttaagtataactttgctaaacaagctgactttaaaattattggtagaataaaaacagaaatgtaggaagggcacagtggctcatgcctgtaatcccagcactttgggaggctgagctgggtgcatcacctggggtcaggagtttgagatttaaaatgctactact

SEQ ID NO: 606507 - DNA, 1360 bp, Homo sapiens
  misc_feature (762)..(762): n is a, c, g, or t
  misc_feature (939)..(939): n is a, c, g, or t
tgctcacctcacaccgtcttctgttgtgtggccgcccctctgtatgtgtatcgatcgtcgcccaaaccacacggagaatcggctctacaaataaagagggaaaaatggggtgttaataaaaaagaaatgatgatataaaagagggggaaatcttctgctgcacaacatttctctgtcgccccgcccccgccggtggtgttgaccccccacgaacaactatgtctgttccccccgcctttgggttgaggcccttcccccccccgcgttttattttaagggaagggggccctccccccgccccttggcgcgcccaacagggtggagaaccgaagcaagaggtggtttttaagacggggcccccgcgggggttaagcccccgtttataccccgttgcgccacaaaaggggttaccgccaatgtaagaattgccagaccgtgttggtttgcccgtgttagatttttagggggcaacagccgtcggagagttggaaaattggggcgttccccacaacggaagggggcttttcacagagcttgttgtctgccgtttgaaacgtgtgtggtataaacccacagctggagaaaatgtggagcccctggccccccgttggaaagagaagcccgccgggccacattgacacccctctgccacaggactccgaagggataagaaccccccttatttgggagagccttctatagtgttttaattaaaattgcccacacacacggtacccctttacccacaatacccccccacgngtgtcctataaacactaccccacaacacctcggcacttataaaaactttttcgggtttgtggggcgacccttccgcgagtgccacgagatcccacacctctctccgagagtcacgtgacaactgcgctaaagagactttcacaccacgtcacaaaagcgagaactatctaatagacntcacactgtgagtcccccactaacaccttgaggcccacacggagacacacacgttatcccctatagggagtataccacggcgcacaatcctaatttctagaggtcccacaaatcacaccacaataggggttatacgaccctccgaatgttggagatccacggaacacttcccgaatgggccacgcccgcgctatttaaaggtttcgctttgttcacacacgagattaaagtcctacgtgattctgaggttcacgaccggaggtaatccacggtcggtttctatctaacttcaaattcctccctgtacgaaaggacaccaagaggaaaataaggcctaacttcacccaagcgccttcccccgtaaatgatatcatctcaacttagtattatacccacacccaccccagaaccgggtttgtta

SEQ ID NO: 606508 - DNA, 119 bp, Homo sapiens
tgtacggcaggagctcatcagcaattgagtgagcccatcagattcgttatggatgaatgtgtgattactggaggcattgatgcagacaccagagtccagagctggtacgtggtacagca

SEQ ID NO: 606509 - DNA, 215 bp, Homo sapiens
aaaaataaagtgtttgctgagagaatgagttggattgctggacttcaatgtgtgtggattcagtttgtgacttaaaaatgaaaccagtctattgcttgtgtggcttttctcaaaatactgttattccattacctatctcttaccccaagagtagtcacattcttatttctggttattttaattcctggtggtatatttatgtgataatgtgatag

SEQ ID NO: 606510 - DNA, 322 bp, Homo sapiens
aaatagtgggtggggaagcgtcccgagaggttagagggggttggggtagcacccttatgctctgatcagtaccgcaaaaacttcttgttgaggaggaagatgagaaggtcgacattgactttggccttgtagaagagtttcatgacagccacaccctcatactggagcggcaggagatcctgatagtgaagctgaaatcgctccatgtccacacccaggaacttggcatttacttcaaactttcctgcctcatctcccggcgtgatgtcaaagatgacgtttctgaagtgagaggcgggaagatcttcaatttccaccaaga

SEQ ID NO: 606511 - DNA, 247 bp, Homo sapiens
tcgtaaactacgacacgtggagtatgctagaacatgaactgcacttctttctaggtcctgggctctacacctagcacataattaaaatcccaaacttacaaggttttcaacaaaagtaaagtttactaaaagttaacagcgtagccaagatggccgaataggaacagctcctgtctgcagctcccagcatgatcgacgcagaagacggctaatttctgtatttccaactgaggtacctggttcatct

SEQ ID NO: 606512 - DNA, 326 bp, Homo sapiens
  misc_feature (51)..(51): n is a, c, g, or t
  misc_feature (53)..(53): n is a, c, g, or t
  misc_feature (61)..(61): n is a, c, g, or t
  misc_feature (68)..(68): n is a, c, g, or t
  misc_feature (95)..(95): n is a, c, g, or t
  misc_feature (113)..(113): n is a, c, g, or t
  misc_feature (152)..(152): n is a, c, g, or t
  misc_feature (174)..(174): n is a, c, g, or t
  misc_feature (176)..(176): n is a, c, g, or t
  misc_feature (178)..(178): n is a, c, g, or t
  misc_feature (190)..(190): n is a, c, g, or t
  misc_feature (202)..(202): n is a, c, g, or t
  misc_feature (214)..(214): n is a, c, g, or t
  misc_feature (232)..(232): n is a, c, g, or t
  misc_feature (258)..(258): n is a, c, g, or t
  misc_feature (264)..(264): n is a, c, g, or t
  misc_feature (308)..(308): n is a, c, g, or t
gcgttggggactgttttctctcggaggccgagagcggaccgcgtctgactnangcgggcancacagcngccccctacgctccctccctccctccnccgcgccctccccgccgncaccagccgtccaacgccaaccgccgctccaggggaggngccgcggctcgacgagagccgnancnaggcctgcgtcnggcccaccgccngcgccggagcgngagccggggcctcagcgnccccgccctctccccgcctcggccancgtccnacgggcccccgagcgtcgcgccaatggactcaaaacaagggctnctacatatacaagttaga

SEQ ID NO: 606513 - DNA, 136 bp, Homo sapiens
cgtttccatactagcaaaatactttatttttataatgataaaacaaggaaagtaaagatttctttttggggttcctccgagttggtgtttgtcgaagaatatggggattaataggttttttatgaacttttgctga

SEQ ID NO: 606514 - DNA, 297 bp, Homo sapiens
gcaatcagtctaattggttgctttccacaatcagaggctgaagtgaagttacaaagttaccctcctatgcaaatgtctgattggttttggaaagcaatctatcagaggtactttcaattttctatctgccaagcagaaaggcagggtggtttgcaaagggagtagcctctgtccttttgttgcttaggtgttgaaagttggggttttccttttgatttagttctaggaattcagggtgaatcagccttgggttccctgcctccagaccctattctcctcctcaggctcactgcaacc

SEQ ID NO: 606515 - DNA, 958 bp, Homo sapiens
ggtcggaaaatcgggtcgcgatagtagatgttatagatcagaacagggcttgggtcgatggaccttggcattcaaggtgaggagacaggccatgcctttcaagtgcatgcagctcactgatttcatcctcaagttgccgcagagggcccaccagaagtatgtcggcggacaaagcctggtggaaggcagactagtctaaataacgaaagagtgggcagccgacactgcatgtggccgaaacgaagatctcgtagagccagagtacataacgcgatacagcccaccgaatgaccgattgtgcgattcgtgttgtgaaacgttgattgaggggcagaaagcaaaatggaggacactagaataagtcgaacgaatagagagttcaagaacgcttcatgaggcacgctctcctgataagcttctgccaaacagagcatccgtggttaccgtaacgggtgtagctcgtttagccattggctggcttgcattggcatggcgtgtcgtagtcatgccgtagtctaacaagttcccagacatcagaagcagtcaccgtccgctgaggtaaccatgggggcttccatgtccgcacgaaaggggtttaccctgccgcatgacacaggtccaacaaggggcaagcataagcagtaggccgtggctcccaaagaaagctctagggaaggggtcacatgatgctccagaccataaaaagctactctggctaccaacaacgtcgaatcctggctcggacaaaggcatcaagtggcaatcaatttaccgaaggtaagtaagaagcgtttcttgtttcgaacctgtttggcatacaaacaataggagtattattcgccaggggaaacaattacccggggagttggaagcaggtggaggtatatggaatggccccagggccatatgtttttccggaacccattttttttttcacacttgggtaaatttggcggac

SEQ ID NO: 606516 - DNA, 116 bp, Homo sapiens
aagggacacatgaagaatccctgctaaaaattaaccaacagaaatagaaactagaacaggatatgactacagtcagatgaaggtgatgaggggtagtatgcccagccgatctagcc

SEQ ID NO: 606517 - DNA, 291 bp, Homo sapiens
acattataccaatatcaaggaacaaatgtcagtcaggcaatggcagatattacccagaactcttgctttcctggaatgctatttttacatctttcagcagtaaggtctagctcacagtctcaagtggcatctcatgattctcattcattcagtgaatatttacagaacacccactataagaaaagtaccatataagcacttggaggtacaaaatgaagaggcatcatggctgcccagaaggcacacagagcccaactaaagaaagcagaaaaaccagtcaccaaaattctt

SEQ ID NO: 606518 - DNA, 202 bp, Homo sapiens
caacgcttggtacttgtggtgtgcctggggatctacaaaggcaaaaaggaaaaaaaaggagaaaaaggagaaaaaaagtgggggggttctataaattaacgaacaaaagattgatcagattatttgaagaggaacctcatcatatcccacactttttttctcctttttctccttttttttcctttttgccttagtcacagct

SEQ ID NO: 606519 - DNA, 161 bp, Homo sapiens
gggcgtcgatctagaggaccccctcaacgctttatacttccgtagtagataatattaagtatgcagggacctctagagctaaggaagtataaagcgtggaggaagtataaaagcgtggagctcaacgctttatacttctccccggcgccgtcgcctacgca

SEQ ID NO: 606520 - DNA, 334 bp, Homo sapiens
gtgaatctacttctgatccttacctttgttgctgctgctgttgctgccccctttgatgatgatgacaatatcgcggggggcctcctctgtgaggagaattctgtcccctaccaggtgtacttgaattctggctaccagttctgcggtggctccctcatcagcgaacagtgcgtggcgccagcaggtcactgattcagtcccgcatacatgtgagactgggagagcacaacatctaagtcctggagtgggaatgcaaccgttcatcaatgcagccaatatcatcacccaccccaaatacaacagccggactctggacaatgacatcctgctggtc

SEQ ID NO: 606521 - DNA, 142 bp, Homo sapiens
cgaagcgcgtcttgagtcgtcaagggcttgctggttggtttcagctgttaaacaacaacaacaacaacaaaaaagaaccagaaaaaagaaaacaaacaataaaaatctgtctagcgagacagaaagagcgggtttacaatag

SEQ ID NO: 606522 - DNA, 329 bp, Homo sapiens
  misc_feature (50)..(50): n is a, c, g, or t
acagagaccgagacttcagcttcaaaaagaaaccctggccgggtgcagcnagtcacgcctgtaatcccagcactttgggaggccaaggcaggtggatcacctgagctcaggagtttgagaccagcctggccaacatggtgaaaccccatctctactaacaatacaaaaactagccaggcctggtagtgggtaccagtaatcctagctactcgggaggctgaggcaggagaatcgcttgaacccggaaggtggagtttgcagtgagctgagatccagccactgccctccagcctgggcgacagagcgagactctgtcgaaacaatttaaa

SEQ ID NO: 606523 - DNA, 739 bp, Homo sapiens
  misc_feature (739)..(739): n is a, c, g, or t
ggctgctttcgcctccgcctgtggatgctgcgcctctccgatacgcaaatgaaggtgctccttgctgcgctctcatcgcggggtccgtctgcttcctgctgctgccgggaccttctgcgggccgatgagaagaagaaggggcccaaagtcgccgtccaggtgtatttgacctacgaatggagatgaagatgtaggccgggtgatctaggtctcttcggagaagactgttcctaaacagtggataattgtggccttaggctacaggagagaaggggacttgtggttactggaatcagcaaattcccatcgtgtaatcaaggacttcatgatgcaggggggagacttgagcaggagagatggtgcaggaggaaagaagcatcttaagggtgagcgcttccccggatgaagaattccaaaactgtaagcttattacgggcccttgggtggcgttgagctatggccaaactgcagtgcaaagaacaccggtgtggggtccccagttcttcatcacgaccagtcaagacagccttggctagataggcaatgccattgtaggtcgtaaggcaaatgtttcttagatgcggcatgagagcgttggtgctgggaaggtggggaggaggcaacgtaaagacccttagggctcggggataggaacctctgattggtattgtgatcatctgcacaactgccgggtagactgagccctggtggaggaagcccttatgacatcgcccaaggn

SEQ ID NO: 606524 - DNA, 787 bp, Homo sapiens
gcgggatgagctggctgacgagatcgccaatcattgcagtcggctaaggagccctggcgttagaggagaacgcggcgtctggaggtcccgcatcgccccagactggaggaggagctggagggaggaggcatggtgcaacagcggagtctgatcaacgaccggctgaagaaggccaatcctgcgagatcgaccagatcaacaccgacctgaacctgtgagccgcagtcactgcccagtaagaactgagaatgctcggctagctagcttggaaatgccagaacaaggagcttaaggtcaaatgctgcagagtagatgtgagggcactgtcgattcctaaagtactaaggtcctccatcgagcgtcctcgaggccatgattgctcagttggaggagcagctggacatagtgagaccaatgagcgctcatggcagtctgctaacaggtgcgtcggaccgagaagaatctgaaggatgtgctgcttgcgatggtggatgatcgcagcgtgaggaactgccgagctagtataaggaccaggtcgataatggcatctaccctgccttgtaagcaagattcatagctggcagactggaggaggccgaagaggaggcccagcgggaccaagcgtcctcccgcgcggtaaactgcagtcgcgagctggaggacgccactgagacggcgatgccatgaaccgggaagtcagctccctaaagaacaagctcaagcgcggggacctgccgtttgtcgtgccccgcgaatgggccggaaaggcgcggggatggctccgaga

SEQ ID NO: 606525 - DNA, 104 bp, Homo sapiens
aggctgattgtgttcgcttcattcattacccccacaatcctagtcctagccgccgcagtactgatctattctatttccccctctatgattcccattcagcctct

SEQ ID NO: 606526 - DNA, 366 bp, Homo sapiens
ttgaaaacaaagccatttttccccctttttggattttttaccccccgtttggagtgatggttcctgtagaaaggtaatagccctcccatgtgctcctcctcttgcaaaggccaaaaaccatgtcccccggatgttttctttatttcggctttggaaattgagacccccccccggtttcccatggcctttctaaaagaaattggtttccccaaagtaagaacagttttcccctatcatgggtggttaccaaatttccatccccgggggccaagcggggcaacaggaggggcggttggatcccattgatctggccccttgtttttcttcaggtaagatggctgcttttttgttttcttatccggaaca

SEQ ID NO: 606527 - DNA, 847 bp, Homo sapiens
  misc_feature (608)..(608): n is a, c, g, or t
gcttcgatgccaagaacatgatgggtgcctgtgacccccgccacggacgatacctcaccgtggctgctgtcttccgtggtcggatgtccttgaaggaggtcgatgagcagatgcgttaaggtgcagaacaagaaacagcagctacttggtggaatgagatcccgcaatagaatgtcaaagacaggccggtacgtgtgacatctccagcttcgtggccttctaatgatggcagtcgatcctttcgattaggcaaatagacacagcctaatcgcagggagactcttgcgaagcggcgatcgtcgggagacctagattcgactgtccaatgttccgggtcgagaaaggccgtgtcctcccatcatgggtagcacgagtggcggcagagagcaaatggtacgaaggatggtagattcgacgcgagggtcgtgcagaagcaactaatgaacagaaccttcggatctcgtgaagctcatcaagcaaggtcacccaggcatggccaccgcgagaagaggaaggaggcatttccggctgacggaggcccgaagacaggtaggctctaaggtgcacgagcccactcgaatcacgcgtcacgtgcattcctcgaggtnttacccttgatggccagtcgttagcgtcaatcgttgccaccattttcccattcatcgcacgtctaggagagttgtgatgcttttggcatggccatcatactcctgtggtatgaataggtatattatttctttcgtggaggcggaggtatcgtaggaaactagtggccatggccgacagtaaggtagggccggcttcgagaattaaaattacgtttggtttttgtttcgcacacgacaga

SEQ ID NO: 606528 - DNA, 930 bp, Homo sapiens
ctcagatacagatagcgaattagggtaaagagcaataactaagaggtaaatatcacattaatctgtattatccattctctcatagacatctgtgcctcaaattgtgaatttcaatatgacctgcgtcaagtcttctgatctcagtataacttcagatacagatagacacattagtcagctgattggattacgagggagtaaccgacaagatatttattgtaaataaagcaacatgattcataataaacagaggaagaatatctagagagaacccactcttaacgctagaggagccctctcctgcaacatcacacataaatgtggctattccaaaattagttagtcccttaaggttgtacttaaaagagcatgtcgaaccctgtatgtgaaggaaaaatggcgcatggtccaaataaagttgaagttgtgagacacagaataacaccaaccaggacataacaatatacaacacacaagataggaaacctgaaacagatatataggataagaagcacaccacggaacacattaaccttcactcatatgtagtatataggtatgcgcaacagattcctgtgggggacgtggagccgtgagttttttccatttgggaaagaagttcagtggtcccattgtttaaactccacctcaaatctcaaaggtgtcgagggccctacaaaggaaaaatggagagcctctatctggtggatgcttatggtcccctctgagactgggccatgcatgggtctggcaaacacaacctttctgcttgtgctttcaacaaaagtaaatgtgtacccttttcccaacccttggagtgaaacctcaggggaagtcagctgcttccatcccaggggtgtggcaagacctagcacaaagggaagagcaaaatcaggaaaggaattttgggaaaaggtgaaataagcggaa

SEQ ID NO: 606529 - DNA, 730 bp, Homo sapiens
gtgagcaggcgtggagtaaagggacttgagcgagccagttgccggattattctatattcccctccctctctcccgccccgaaataatctattatcagcccattactcccaccctcgctcgcgtagccaatggcgagagccgtcggcggcactcagtcccattccatctcctccgtcgtccttcaggagaccgagccgatacgcagcccggcgagagggggagcccaggagcctgccccgccctggggacgaagagctagcagatcctcctgtgcggtgcacgatctgattttctggagcagatgtgaagaagaatggggtaatgtcttaggccaccacgctgatcatgctgctttccctggcagctttcagttgtcatcagtgtggttatcttacctcatcctggctcttctctctgtcaccatcagacttcaggatctacaagtccgtcatccaagcctgacagaagtcagaagaaggcatccattcaaagcctacctggacgtaacattacgtctgtcctcagaagcttttccataacttacctgacatgctgccatggtgcacatccaatagggcccttgcaactcatcattacgctcttactggtagaaaatctggttgactccttgaagatggatgtttcatgtggagatgacaattatggggtgcccacacatcccttctaatcttgtgaatgacattacatagccgatggcacaaagacaaca

SEQ ID NO: 606530 - DNA, 506 bp, Homo sapiens
tcatcagcagagtacagcacatgcgcactgatcgttgtcgcggccagccaacccttccttgctgaagcatgaacacgacttcagctgaaaaagtggagaaggttgtcagcccgccgcgagaaatccgtagtgataagaagcttccaagcggggtctaggctaggactttttatgaagaacgctatagcaccgccaatgatgaagcccccgatcaggtttaccagcagcgtgccgattggaagatttgggaacaggctgttgagtttgagtgcgagaagccagcgtgcgacacagccaacagatccaccgatgattaccgcgagaagagagctatacatagtgtcagtccatttcctgaagggataattggaaagacacgcacgagcctacgtccctttccagggttcgtaggcatcattagccagaggcggttgaggaggaatgccatctccttgcatgtagcttagcagtcggcttcggggattttcaacgccccaacgattggg

SEQ ID NO: 606531 - DNA, 863 bp, Homo sapiens
  misc_feature (37)..(37): n is a, c, g, or t
  misc_feature (61)..(61): n is a, c, g, or t
  misc_feature (80)..(80): n is a, c, g, or t
  misc_feature (84)..(84): n is a, c, g, or t
  misc_feature (86)..(86): n is a, c, g, or t
  misc_feature (95)..(96): n is a, c, g, or t
  misc_feature (99)..(100): n is a, c, g, or t
  misc_feature (105)..(105): n is a, c, g, or t
  misc_feature (112)..(112): n is a, c, g, or t
  misc_feature (124)..(124): n is a, c, g, or t
  misc_feature (130)..(130): n is a, c, g, or t
  misc_feature (136)..(136): n is a, c, g, or t
  misc_feature (142)..(142): n is a, c, g, or t
  misc_feature (203)..(203): n is a, c, g, or t
  misc_feature (209)..(209): n is a, c, g, or t
  misc_feature (214)..(214): n is a, c, g, or t
  misc_feature (219)..(220): n is a, c, g, or t
  misc_feature (323)..(323): n is a, c, g, or t
  misc_feature (363)..(363): n is a, c, g, or t
  misc_feature (365)..(365): n is a, c, g, or t
  misc_feature (392)..(392): n is a, c, g, or t
  misc_feature (394)..(394): n is a, c, g, or t
  misc_feature (398)..(398): n is a, c, g, or t
  misc_feature (557)..(557): n is a, c, g, or t
  misc_feature (669)..(669): n is a, c, g, or t
  misc_feature (756)..(756): n is a, c, g, or t
  misc_feature (770)..(770): n is a, c, g, or t
  misc_feature (773)..(773): n is a, c, g, or t
  misc_feature (777)..(777): n is a, c, g, or t
  misc_feature (826)..(826): n is a, c, g, or t
ttgaacacctactttgtgctaggctttgttgtaagtnctggggacacacaaaaaaaaaacncaatcctgccctcgagganctcncngtctagccnnggnnacacntaggttnacattgattttnaaattntaaaanttattnaacaactttataaacttcatttgcaatcaaacaaactttgggtgttatgaatggatggtanaccggnctgcngtccnntgccgtgaaaaaccatctgcttcgatatcatgtgacttctgcgaaggcagtgatgtggttctgtacagatgttaccttttccaaaggactttctactcgaggnatgctgatcattggcatctgtgccagattatccatgtgtntntgctcattttctgcttgtctccctttnanattnttcaccacgcacacaaccagaaatactgctatagatattccaaccagaaagcctgctataacatctgaccaatgatttcgatattctgctactctgttgagtccagtaagaaatgccaaacacattaagcccaagcatagaactggcttagcaagtctngttcccttggctttgtttgtgttggtgatgtacatggtcagatacatagctgcatacacactgagagctgcttctttggatggaaaggtttttcgggctctcatgatgaganctgggttgccagtacaggcctcttccccactgatgaattgtgtatactgctgacatccaagtgctgtataattgggctacacagggnaaggaatgtggggncanattnctgtgactacttgtccagcatttacaaagatatctgtagcaaacagtcnaatgtataattccaagaatcggacagtcggcgcacag

SEQ ID NO: 606532 - DNA, 638 bp, Homo sapiens
cgtgacgcgctgtgctgcattgcgggtccccattgccagaagctggaggctgtaatggttccattgcctgtgccctgcctggccgggtcggagcaacctgtgccgatgatgaatgagcccctgccatgcccaacccctgccatgggttgcggctgccctgccgtgtgctgcccgagggtggtgctcagtgcgagtgccccctgggtgcgtgagggcccttctgccagacgcctcggtgcagtgacggctctggtgcccttcctggctagacttcaacggcttctcccacctggagctgagaggcctgcacacctttgcactggaacactgggggatgaagatggcgctggagagtcggagtaccttggctacagaggcccacagcggcacctggtactaaaaagtgggcagaatgaccggactggcacaggggagacacacgatgtcactggcactgcgggactacacgacactgaaagttcagctaaacgacctgtgacaagagggcagcggtcatcaggagcagagaagacagtaaaacctgagagcctgtaccagtatatacagtggagagagaacgggcgtaaggatgcactgagtgtggccaacggcccacgagtgtcggagggagtccccgg

SEQ ID NO: 606533 - DNA, 561 bp, Homo sapiens
cagtgacagcagctatactttccaactttagaataaccctccctccacagctacacaaaagcacacaagctgcaaccctcctgatgtccacttgcacaaaccaacctcagggcttctatggtgcagtcattattttttaaccatttacatgtggactggtataaatcttacgttcctatcttttttcccattgtgtcgctgatgaaggttctgagtattgtgtccctgttttctgcacaagccctgtggtgtttattcatcatgctgtaaggcacggtgatttttttagaaacacacgggttgcatcatagcaggactcagtgcattgactttttatttagatatattgctggactcggtaagatttaattaagatgtccatgtctagctcgtgtatatgtaaaaagtagaggctcctctttaaaggctttactccccgtctaattaggaataatactaacttctcttagaagcataatttattcaaagacctgtgctaacattcttaaatatctgctggccgtaatgaggaaatcaaagtactttatgttcttagctcgc

SEQ ID NO: 606534 - DNA, 312 bp, Homo sapiens
gacacaacctagggtcagtttcgcaggtttaagccatttaccaagatagttgtaggtaaagaagggcagatttattagagaaattgtgaaaatatgttgcagtgggcagctcagcagagaaggggctacctgcaaagaggcaagggctggaggaaagttttatagagtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 606535 - DNA, 488 bp, Homo sapiens
  misc_feature (11)..(11): n is a, c, g, or t
agagaatactnttttgcctgacaagcaacagccctcttccccacaaagcaggacagttccttataactaagagtaagttcacttacacatgattaagaaggaagaaagaaatattataaaggagagaggaggcggagtttttcaagatcgacctaaagattaactttcaggtcagcacgagtgaagcgtggtatcttgagcttgaagggctctgaattcaggaaaggaatgagtactttttccagagaacactggagcttgtggagttccattgatgcattggattaacactgcatggctaggatcaagaatcctgaaccacattggttgacagtaactgcaggccccatgtgaattgtgctggcaatcaggctctgccagctacaagtgtcaatatcattcagagagtgtctatatatatgagttgccgccatatcattcgtctatatattcccttcccctccaggaggctcggtcaccatgcacac

SEQ ID NO: 606536 - DNA, 392 bp, Homo sapiens
ttagcaatcgagctcggtaccggtgtttcccttggtctgttttaggggtaggttttttttttcatagtctatctctgtcacccaggctgaatgcagtggcagaatctgggtcacggcaacctccacctcccaggttcaagcaattctccggcctcagcctcccaagtagctgggactacaggagcccgccaccacgcccagctaattttttttttttttttttaagtagagagggggttccagggtgtaagccgggagtgtctcgatctccgtgacctcttgatccgccgtgcttgggcctcccaagggtgcgtgggataacaaggtggtgagctagggcgccggcccacccatttcctctttccagaggggaggcaggagacaaggggaac

SEQ ID NO: 606537 - DNA, 910 bp, Homo sapiens
agcggggggacgccagaggtagcagctaccagcagcaatggcagtgactggcgtatgtgcgtgcgcggacgtaggcttggctgtgtgggtgcgtgaggaccatagcaagcccgaggctatcggctcggatcagtccgacgaatagtctgaccgggagcgcgggctccatccgggaagcctggtggggccattcgccaaagagcagagcagcgctgaacgaggaacgactactttccgcgtgaggctcagcggtgtcccaacgtaccagaccctgggatactaacccaataggaccttaccaatacctataaaactagccacattctgcaccacaccccgtatccctaacactaggtagcactatggtgtacgctccccattaccacacctaaccaggaagcataccctggcgcccactaagtacgcgacgtacataacaccttgacacacacatatgagttgctccctgtacacagctcatgcaacacctgtactacgggggcaccatcgccaggagttaagccgcactagacagccaaatacatagcttcatccatgaagcacccccccctaagaccacctggtttataccataacaccgcactcacaacaaacatacacaaacacaacaaactcacccaacgggccgttcaacacattaccatacactataacactacatctaaaaccaaatccatagctcccgcagtacggtatggtccagctcatcttggtttccaccttcagcagggtctcacgatcagctcagatacagacacactcgtcgccacgaatgaaattttccttgccgggtcgcacagaggactgaggcatcctagctcagttccccggaacccgggaccgcagaaacagatagcctggcaggtcactgcaagtgacacttaggcac

SEQ ID NO: 606538 - DNA, 267 bp, Homo sapiens
ttcatcgatagtagtatccgcgcgtaatatcttcagggaccagacactgtgtcacctggagtgaaccgatccttgattagctgtgggaccatcagtgcggggatcttgagtacaccatgaagacaagttgagcatacggcttccacatgtgggccatgccagagcaatactccacaagcacactttgggaaaatagcagtaaaagctgatctttggggtaaagcacaaattcacgatcactggcacaggcattcatttgggcatagc

SEQ ID NO: 606539 - DNA, 606 bp, Homo sapiens
tcaatgaacacttgagtagatttttattcaaagaagataatataaatggtaatactaaaaaaaaaaaaaaaaaaaaaaaaaaaaaaaaaaaaaaaaaaaaaaaaaaaaaaaaaaggggggggcccaaaaatacccccggggggggccaatggcccccccatgtttttttgatcaaagggggcgccccctaaaagagaggagggcgactatatataaaaaagccagagcgagagagcggggcgcgcggttaaaaccacagcccgtgggtgaggggaaacaacggtgcgcacggtgggagccaagttgtgggggaggagaggaccccccaacttctctgggggggggggtgccaaccaatatgtgtggcgcacaacaactctacccctcaacaggagaattattaaaaccgcgcccacgggggagggaaaaaaaataaatacacatttcagacggcgcgttattatgtgtggtgtggtcaaaaccaaccagcagggtaactatagttgtagtgggcgcagaagagaaaatatggtcggctcaccagagaggagattgttacttagtgcagaacatattttctccgcggggggtgtagaaaaaaaagga

SEQ ID NO: 606540 - DNA, 1414 bp, Homo sapiens
tctaccaagcccttataatattcacttaaaacagtatgaggcaacaagcaatacataaaactggcatttttaactgttacgaaaaagattttggttagtgttaatctggctttgattataccatattttctaaaatctacttctggcgaataacatctgctattacccactctgggtcccacatgtacgattaaatacaagctcagaagtggcaggtgtggacaggagtggctaacaattaacacttaccagtggggcaaaaggaaccaaacatttacacggagttgccgacatatgcaagcctcactacatagcgtttcacacactttacattaacagcgttgacacccataagtactaggtatatcacgttaaccgggccaaacattggcatcaaccgaccagttagagatctagtgtccacacactgttcattcgcgctagtaagagttacacaatttgggtgtgaaccaacgaacctacatcttctttgtgcccagagagaaccagcaaccttaacaccgtggttgcccactaaataccattcacatgtccacaattatcccaacggcttccacgacgtacgttgttggcacaattatgagccccagtgagaaaagcgccacaaaacgagggaacatcagatccacgcggacaaaactcgggaggaggcccagccggagaccacacacacgtggcgaacgccaaccatatgcggcccagaacaaacccactacaaaaaaacgcagggataaagcaatcaacctacggacaacactataacgaatgcgcggaacacaacaagcgggtccggcccaaaacaacacaatctactgagacaaaacaaaaacgtcgccagactatacagcacgttaaacacacgaacaacagttaagcctcaaccaacggtggcaccccccaaaatacagagcaaccgacaagtggtcacatacaaacaccaagacaaaccgtcaccggggcatacgaacaagcgagcacagagcacaaccaagcgccctacaccactgcacgcaccacgcagatgatgtaaccgaccacagaacacacaggaaaagagcacaccctcccaggaaacgattatacaccaaaaaagaagaccaacaacaaaaaggccttttacggcagtaatacggagaaataggcaacgtcgacactgaagctcaaagccacaaaacgcggcacaaccacgcagacacaacccatcatgagccaaagcagagcacaccatcagaccgtagctaaagatataacattagcacgcaacaacacgccccgagaccaaccaccacacacgacaacacacacaagaagcacgaaaaacccggagaagcaccggaacacgaacgacgcggagtcagcgcacacaccaacagcagagacgctaagccacacc

SEQ ID NO: 606541 - DNA, 263 bp, Homo sapiens
tttttttacattgcctgaatttgaagtttattgtagaactagagacccgaaacagcatggtactggtataaaaacagacacatagaccaatgtaacagtagagaattcagaaatgaatccacacatctgcaatgaactcatttttgacaaagctgccaagaacatacattggggaaagaacagtcttttcaataaatggtgctgggaaaactagatgtctatatgcagaataatgaactagacccctatctctcaccatataa

SEQ ID NO: 606542 - DNA, 848 bp, Homo sapiens
cgggagtactgcgacgcggcctggagtcggccttgtaggggcgaatggtgcatgggagatctgcggctgggcgcagtcttgagcgccggagcgcgtcctgcccttagcggggcttgccccagtctgcaggggcacatccagcgcgctgtggctgacagcagcctgctgcgcgccggtgagtctgcggtggtctgcggcagcacgcacctgcgctggtgcgaccagctgcaaggtcccctgcccgtgctggtgcgggcagcaaggtgcctggggagagtggtgcgggtgcaaggctggggggccccccaaaaggggccacccttctttgccccagtgctggacttgccagcttggacaaatgtctacaggacgaggcccacggttactacctgtgcaggaagctgaaacaaagacaatcttgggagtgtgcccgagacgttaccagaaacctgtctccagtggggctcttggcgcctatggctctgtgtgtgcttgcttattggacacaaaacaacgggggattaccgtgtggcaccttgaaacgaaagcgtctccaagaacccattttcaggtccactcatttcatgcgcaaaaggaaccctacgcagagaacctgcgggttacttaaaccatattgaacacaatgaaaaatggtgaatggggtcatggtagggaacggttataatacacccttgcaagggctctcctgggagggaaatcccaaggatggtggtatctgggctgaaccatcatcatgggggggcagaatcatgaacacaaacattggtcgaaatggtcacgaaagcttaaccagaatgaaacaggtaccaggtaccttattctacaca

SEQ ID NO: 606543 - DNA, 138 bp, Homo sapiens
agttgcatcgtagagttataggtgctcgccggagtgtaagttatgcaaggatgggcattttgggggaaaaatactaatcctaaaatcggttacctccggggtctttcagatgtcataaagcagtttgactaaacgggg

SEQ ID NO: 606544 - DNA, 375 bp, Homo sapiens
ggctataaatatttttaaataacagttgtattgagatataattcacagaccataaaattcacccaactaaagtatacattttaaaagtttttaggccgggcacggtggcttacgcctgtaattccaacactttgggaggctgaggcaggcagatcacctgaggtcaggagttcgagaccatcctggccaacatggtgaagcccctctctactaaaaatgcaaaaactagccgggcatggtggcgcacacctgtaatcctagctactcgggaggctgaggcaggagaattgcttgaacccaggaggcggaggtagtggtgagcaaagatcgtaccgctgcactccagcctgggtgatagagcaagaccctatctca

SEQ ID NO: 606545 - DNA, 303 bp, Homo sapiens
cagaggatcgccagtatctgtgtcccatcagcataataaataaaagtcataggttcaacaacagggtttaaagaaaaatgtcttcagctttaatgcaagaacttcaggtttctttttcttccttttgttgggaaattattttcctgagcctttggtttaacggtatattgtaaactttgatgttaaagaaaaaatatacatttacaaatggtgagattttaatgagaaattttctacgatgtatacgggcttatttttaaaattaaaacggggtttccgtcggcactgatgggagaagactgg

SEQ ID NO: 606546 - DNA, 812 bp, Homo sapiens
tactgctggacgcgctgggtctgcaatgcctccgtgagcgcactgtcggacagtcggctccctcgttgaccgaatcaccgacctctctccccagctgtatttccaaaatgtcgctttctaaccaagcttgactgcatggaccacagcttggcacgttcaacatcgggacagctgcggtcgttcatcgcagcatgtccgcacttcacatgttcctcatgcacatgacaccaacccagcataaccaacaccacacccagcagtgattacaggcttgctgtcccaatgcatcaaattctgcttgtgcacaatggatgccaatgtcggtagtccttatgcagccacctagtgccgtgacttgatggtgtgcccatgcctgacacagtactccttagagccagttgctgtagaactcacaatctctgctgggccaggatgttctgttctatgacaggactgtgtaggcccagcaagtggcagaacagcctgtgccaacccagctgctgggtctgtcatcctgtctggctgcaacctccgcttttcatgtggagtgaagtcacgtggacaggtgaccacagatgcttcttgcgaccaatggttaacatgccgtacccagtcaacatagaagctctccgagcttctcttctccaaagccttactgggcactagtctattctcacttatttcactttgggcacctgatttcacagagcccatcctgcttcactggttagtcagtcaatatgactccaccatggtcctgttgcgcacacccactgccccacagatatgtacatactttcgccaatgtcctt

SEQ ID NO: 606547 - DNA, 366 bp, Homo sapiens
gactctagaggacccccacaccacctagtcaaggaacaatggcacaaaagtcagagaggttagcagcagttagagtgatgctacagagtgaagttcaagcatttggcacagtgtggatgacctcgggccccatttaacagagaaagaatttcatgcagtctagcagtgacacactttgaaagctcttaagaagggagcaggccgtggccggcatatgcactttagcaaaggccacgttggctatcatagggagcacagggatccagagctaggaccacagactgggacttgggagtccaagagaggacggtgctgctagtaattagaaggggaaagtgaaactacactaagggcaaggggttttgc

SEQ ID NO: 606548 - DNA, 379 bp, Homo sapiens
cacgaggtcagaaggcacaggaggtggttgctgtagcaatcatcttttattttatttatttgagacggagtctcgctctgtcgcccaggccggagtgcagtggcaggatctcagctcctgacctcatggtccgcctgcctcgccctcccaaagtggtgggattacagggattaccgtgcctgggcagcagtcatcttttacaatgaacaaatagggctgggcgcggtggctcacatctgtaatcctagcactttgggagatgggcggatcacgaggtcaggagaccagcctggccagcatggtgaaacctcgtctctactaaaaatacaaagattggctgggtgtggtgatgcacgcctgtagtcctagctactcggga

SEQ ID NO: 606549 - DNA, 378 bp, Homo sapiens
taggacttggcctgggagagccagagtttcggaattttcttaactatcctttaaaaaaaaagtccactgtgtagagaacatatatgcataaccataggtcaataatatgtctccataagaaacactaatattgggaaaacatgtccaagacctatttccaaaaataatttagggtgaaatctctaatatttatacaagtagcaacaataaatgcttaataaacagtatatagggccataccagacctggatgcagatgatacagactcctttattacataatcaggtaagtgtaagaaatggccattggacacaatccatttggtacctgacccttatgaaatatatgtataccagggtagaaccgacgggggaccct

SEQ ID NO: 606550 - DNA, 140 bp, Homo sapiens
agcacagtcactctacattcccaaccatgcctactcagtatccactccataccacagcccttggccagccatctgcacccacttttgcttgtagtcatggccagggcaaatagctatgcagagcagagatgccttcacct

SEQ ID NO: 606551 - DNA, 258 bp, Homo sapiens
gtcagcatctgtcactataattgtcggcgaaatcaatgtatgcgtatgtcctgtatatgtctgaaattagtgctaaagctggaaactgtgtttagctgtctcagctcaattcttagaaggatatgtcagagccaacaatgcagaattatctttactctttaaatggttcttcacccactttggtttgcctttttgttttgttgtgtctgtttttcgtgggaaacaaaggggcgggggactcttaaagacgaccagccg

SEQ ID NO: 606552 - DNA, 682 bp, Homo sapiens
ccgaaagatccggaggcctcctgccgccgtcgggcagggaggccggcggaggcggggccgtggccgccccgagaggcgcccaggcggcggaggaggcggccagcttcttctttcctcgcacagcagggggcccctgctcgagtcccgcgtcgttcatggcgcgcggttcccgagattgctgcagcatgcaggaggaggaccgagcaagtcatccagggtgccctttgccctctgtaagtccattaaatcttttgaagaggcagcttgtgctggtagagtcgccaacgtgaaatggggaccaaaagtgagtattatagaagactggtgggcaggagcccaacaagcgtgcagggttggtcctgcagccaggtgtctgatgtgccccaggcctgggaagctgatgaatagctgagatctgtatctgtggacctgaatgtcgatccctcgcttcggaattgacatacctgagtgcgctcagtgagagagacaaagtcaaatttacaggtggacacaaagaacaacactgcccacgtattcacagcccagaagtttgcttgttacaaggggaacatgacgaatttgtgtggctaacatgacactctatttgaaacaccagactatgctgcggctatattccacctgctcctagaagccgaattgatggtcctcagagaagatggaa

SEQ ID NO: 606553 - DNA, 506 bp, Homo sapiens
tacaagtagactcagtggacccacgcatcgctaaacgtcttaaccaatgccttcctgctgcggtcacgccctcatccaacaccttacatgttccgcctggacaatcggtatcagcccatggaaccccacccccgtgtccccctcagcagggtcttttttgcctcctggagggtcgtgctgcaatgtggcattgactccatcctccgtggcctcattggcctcctttgccaagctgaatctgtcagaaccacatcgccgtggatgacatccggtaccgattgtgtgagcgggttatgaggcttaggcctggacctgtctgccctgaacatgctgcaccgagggaccacgggctcccaggatacaatgcctggaggcgcttcttgtggcctcccggagccctgaaactgtgggccagctgtgcacgggctggggaacctgaacttggctagaaaactgatggagcagtatggcacgcctaacaacatcgacctctggattggcggcgt

SEQ ID NO: 606554 - DNA, 179 bp, Homo sapiens
cgtttgtggatgcacagcctgtatacaacgtcagtgctggggtgttgaaggtctcaatacatatctgggtcatcttctcgcggttggccttggggttcagtgggagcctcgagtcagtcagcacgagggtgctcactcgggagacaacacgacagctcaattgctcaaacgccttctga

SEQ ID NO: 606555 - DNA, 413 bp, Homo sapiens
gtggactctgagggctaccgataccggcactgatgcggaaggggcgcggagggcagatggccgcggtaggccgtagttgctaacatggctcatagcatagacggcggatacctgttcgccgagcccatcgagcttgacaacccctttgaggacccacatgcgatccatcaccgactcagccggcagtatgccacgctcgacgactacaaccctttcgagacccggtagccaacaccagcctatgagcctccagccgctggccgattggcttcaccctcagctcactccttgcagccctcgagaaagctcagccccacagaacctaagaactatggcttatacagcactcaagcctcagttgcagcagtcacagctgagctgctgaagcaggaggagctcaatcggggcagagg

SEQ ID NO: 606556 - DNA, 175 bp, Homo sapiens
ggtagtgaggaattccttaagactcagtgttatgtttcctagggctgacataagaaagcaccacaaaccgggtggcttaaaacaagcagaaatgtattacattacagttctggaggctggaagtccaaaattggtgtcagtagggtcatgctctcctgaaggctctgtaggagga

SEQ ID NO: 606557 - DNA, 115 bp, Homo sapiens
cagctttttgtttttttaaaaaagctaaaatggaaatggattttatcataaaggaggacatcgtttttttctccaattaaaacatgttcattgtataaaaccccaaaagcggcta

SEQ ID NO: 606558 - DNA, 497 bp, Homo sapiens
ggcacaggacctcaaagatttggagcatcaccccactctactggttaccaattgctgtatgggtccattttcatgctgctgataaagacatacctgagactgggcaattacaaaagaaagctttattgggacttacagttccatgtagctggggaggcctcacaatcatggcggaaggtgaaaggcacgtctcacatggcagccgcaagagagagtgagagccaaatgaaatgggtttcccctttatcaaaccatcagatctcgtgagacttatgcgctgtcatgagaacagcaagggaaggacttgtccccatgattcaattacctgccactgggtccctctcacaacacatgggaattcaagatgagattggggtggggacacagccaaaccatatcaaaggtagtatatccttctggtttggattggtatttccctgatgatgttgagcatcttctcatgtgcttattgaccatttatatgtatcttttgaaga

SEQ ID NO: 606559 - DNA, 104 bp, Homo sapiens
atggagagccaggggagaacaaatatttgtccatgggaaccagtaatcatgctctaaaggaccaatttccattcgcaatcccattccatattcctatttcatgc

SEQ ID NO: 606560 - DNA, 179 bp, Homo sapiens
acatgctaagattcacacagtccaagcgcctactatactcactgatccaatacactgaccaacggggcgggttaccctagggataacagcgctatcctattctagagtccatatcaaccatagggtttacgacctcgatgtaggatcaggacatcccaatggagcagccggcaaagaca

SEQ ID NO: 606561 - DNA, 207 bp, Homo sapiens
tgcgtgtcggtacctgcatacctcggcgtatgcaggggtttgatcatgactctctggaaccacaatctcctgggctcaagcgaccctccgacctcagcttcctgagtagctggaactagagctgcacaaacaccatgtcgtagctaaatttttatggttgccagttgtttgttttaatgtttggtagagcacgaggtcttgactatg

SEQ ID NO: 606562 - DNA, 1058 bp, Homo sapiens
ggggctccgtgttcctactggacatccagccgcttgtgtgtctgcctactagggtctcatggggttatctataggcatagcggtgtggcgcgtgcgcacggtcagcgctgatcttgcggaactgcaacatctgggcgggaaggcaggagtgtttgtcctcacctaggtccatgggcacaggcctcgcatagggaccacggcacttctcttcccagcacttccctgccactcactccctgtgtaagtatcatgcacttcaaaaatgtacgcaggtgacaaaggaggctaaaccaagaagttcctgaactatgatttacacaaatcgctcactgtccaccaggtaaattgaagaccccttatacaacttctgaatctcttacttctatatttcatgtcctaccatatctacttcagcgggccaacactatggcacagtgaacggagaacgagcacagacgttcgagttcaaagccctaaggacaattcagcctgatcacttaaccagtctctgacttcaagggcactaacgtactacctacctaccaatacttggaccatcactatactggatcactttcctctaatcagattgcacactataccatacacttatctccatcacctggttcacaacctgtacaccaatttatctactccctcacatgttcactggataggtacctggcccttaaccgaccggtcacgcgcttaatcaacgggatcacagtgcggtcctctggtactctaccgagagtcccacagacgcactgaccctcacgctcggctttggcggctccaatcacatactccgttgtaacgtgtgtttgtccattggcaacctatatttgcaagacggtgatatttggcatggcaggacaaccactacacatctggccaatccgcgtcactcgcatgtgcaccgacaggcgcctactcgccccaacgtgcgctatcaacagcgcaatctaaacacgaacaatattcaacgcagtctcaccaccgcaggcgcgcatactaccaacgtccagcacatgtcagatctaaccacacgcctccag

SEQ ID NO: 606563 - DNA, 120 bp, Homo sapiens
cacccagcatcttcagctgacgaacaatcagaattggtttggtatagaatggggtctcctcctccggcggggatcaagaaggtggtgttgaggttgcggtctgttagtagtatatgctga

SEQ ID NO: 606564 - DNA, 210 bp, Homo sapiens
tgggtggaatcgccatccattccaggatttcacttcgagagaatcaggagaggcttccttaggagttcccgtcgtggtgcagtggttaatgaatccgagtaggaactatgaggttgcgggttcgattccaggccttgtcaagtgggttaaggatccggcgttgccatgagctgtggtgtaggttgcagacgtggctcagatcccgcgttg

SEQ ID NO: 606565 - DNA, 739 bp, Homo sapiens
aactaacgacagctatggattatttgcggttgtgatgcatagtggcattacaattagtactgggcattacactgcttctgttaaagtcactgaccttaacagtttagaactagataaaggaaattttgtggttgaccgaacatgtgtgaacataggataagccagaaccattgaatgaggagcgaagcaaggggtgtggttgagaattataatgatgcaagaacgatgtcaattagagttggtggcaagatacacagccaagtaaagtttcgaacaaaacaaatgtccaagctattggacttcttggaggacaaacagagcaagagcagagttatgagctatacaacaaagcctctaatcctgataacggttgctagtacagcgttcgctgaaattagaacattctgagactagtgatactactgggacccatgaattctgataggaaacaaggaagtccagtgaccaatactaggcattaatgattgagtcggagttctgatgaagcaaagatttcatacgtagtgcaaagcttagaggagtatgaggggaagtggtttgcttttccgatgattctgaatgtcaagagttcctgaatgagaaggactcgtctgaacttctctgttccccttctagcatcttcctacattctacctccttgacttgcttattttataagacattaatacgagtgagtgtatttgccttgggtatatatctaaacaatgcatacaacttg

SEQ ID NO: 606566 - DNA, 254 bp, Homo sapiens
tgattctagaggatcccttcggggtggtgatccccagacattatcgggggatgctgaagaagacaactcaggaggctgagaggatcctgctccgaacacagacaccattcactccaaaaaattggttccttgctatgctctctgtggtacatggcaacttacgcaaggatgtaaagccagaaaacaagcagtaactgctatgcctgacaaaactgtggctgcacacatctgtactcgtcaatcaacaaacccgg

SEQ ID NO: 606567 - DNA, 675 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 606568 - DNA, 951 bp, Homo sapiens
caggagctcagctggcaggcaagtgacccagcaggagctgcatttgctgactgacaaatgggtggcggctgaggtccacccccaccctcaaggagggaaggcaagagacgtgtgttcccacccgaggacagcagcaggacctctcttccgggcacaggatgaagcaggacaatctgacttgaggaaacaaaacaaagtcacagccaaggatggtctggctcctgccctccaggctccagaggccgctcctgaagctgccgggactcctgcaggcacccctacaaggctggggtgcttcacagcctggggtctgcgggggcagcctccctcggcaaaccccaactccaggctgcctttgggagcaaccggacggcacgcgctgcccagggtcagagctccctacccacccctcctgtgactctgagcggccgacccagcctaatggccacagtcctgaggctggcaggggcagggagggccaccacttcggtaccttccccaggtactgctccttggggacaggtgacaggggccacagcctattccctcggcacccaggaccctgcctctaagcaaataaaccaacaagcatccacatttgcctccaggccacaggacccttcgggaccaggccagctctgttcaccagctgcgttctggaggcagatggccacagccctcttgggtggcaagggttaaaccacacagtggtaaggaccccgcacacaggcgctggccggcacacacgccttcagggtggcggcagcaaggcagcaacaccagcaccggccttggtccccaacgctgacccagcagacagaagaactcgcctctctgcctagggatgaacggcatccagccaggactcatttcccaggaacagccgggttggcctggcactccagaactttggtgcttgcctgtgccctctgtcccggcctgcccgaaacg

SEQ ID NO: 606569 - DNA, 122 bp, Homo sapiens
ggggacgttgtcacgggtttagggtcggggacagagcggtgaccctggccaggatggcattgtctcctgtacccagcccctaggatgggtgggcgttactgctgctgctctcagctgagcca

SEQ ID NO: 606570 - DNA, 159 bp, Homo sapiens
gcggccgcctactactactactgcttgaattcaagcttctaacgatgtacggggacatgtgaagtaacaaactggtttttggtttttttttccccttcagttttaatgttatgtgtaatgtatttaaacccttatttaaataaaacttgttttcagaaa

SEQ ID NO: 606571 - DNA, 1319 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 606572 - DNA, 1511 bp, Homo sapiens
gcaggcgtgagccatcactgcccagaccgagggtatctttctagtaccaatcagaacttagatgactgaggtgtaatggacaaatcctatgcacaaagtgagggtatctgacatatgtgggcgggagtcagctccattattaggctacttcatgcacgtaaagtcaaactaacagtagcttcaacaatcgacttctcaatcactgcagatatgggcactgctgagggctcatctgcggatgaccgaaccactgcacttacacgaacaagaacagattccgctcgtcgaccacagggcccgccaagtgaaaagcaacacgatgtgacactacaagcgctcgacgtgcaaaaacctcgagacctccccaggggttaccacacggacgcagaaacagtccccatgggactaggaacccaccctcacaacctcacgccgtcggggacacctaaccacgggcaaacccacggcccccaccccaacaagccccccacacctcacagcaccgacggcgaccacaccacagctcacgccgcaccgcgcctagacccacccacacgaaccagaccaccacacagaccacgaatcaccccacccgctatcgacgccccaaacacaggcccctcaccacaccaacctgtcacccgaccaccacccaaggaacacgggccaccggagaccccagcacaccacgcccacccggagcaccacacgccgccaagcccagccccaccaacccctggggcaccacaccacccccgctggcgccctacaacctcaaacacacaacgcgcagatctccagacctgcgcgccgtcccccacctgcccgcaacaccccgccccacccacacgaccacccacaccggccacgccagcccaccccaacatcccgacccacacaccacccaacaaccatcaccccccccaaccccccagacgcccaccaacagcaccccccagcagaccgacctccccacacccacccccgcgaccacaacacctacggaaacacactcgagcgcccccaccaaaacaacaaaaaacgccacacacgtcacacacaccgaacccacaccccgacaagcacacaccacacacaaccccgcacaaacaccacccccccgagcacacaacacaacccccaaccacccaccaacccacaccccccccgcaccacccccacacaaccagacaacccaagaccaacacaccaaacgcgcagaccaccaccccatcacaccacggcccccgcgccaccaccacccaacacacgacacctcaccccccgaccccacccgcccccggccccacacaccgagaaagaacacaacaacaccgaccccaccagcaacacccacaacactaccaccacaaacagcacccagccccacacgacctacccagccagccggccacaaacagacgcgcccaaacaacaacagaccgtcacaacaacaacaccacccaaaggcaccgcgacgaccaacccaaaacaccgcagaccataccccc

SEQ ID NO: 606573 - DNA, 2172 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcggtaagctatgggaaaggtcgcgggcccgggtggggcagcggggccttccgggcccggagacgtgttccgggaagttgccaagcgctccgggccttcgtaagctcgggcaggggaaacttgaccagggtcgcagggcagcgggatcaaggcctgggccccggggtcggaccctgagcgcgaccggaaggagcaggcggtaggtcagcccttgggcgggcccggcgtctcagtggcgcatttactaatggctcctgggcctcctcgggccacacccgcccctcccgtcaccattgcgtcacgtccgttacgtcaccacccgttgtcacggatccggagggaaaggcggtgccagccctaagtggcaagcgggtgcaccaatgggggtgggaggcttagccccgcctcgggagctcgggttccggcgggttgcatcagctgggtgcggcacgagtggcagcccggactcccccgacatgtgatcggcttcccagggagggcgggaggcccgggcgttccccgagcctggggaagctggccgtcccggactgacctgctcggggagagccagcaaaggacacattcggcctggcccaagccctgacgatttcagtgttgttttctgcacgcgcaaaacacctggggaccgaggggatggcagtggcatcctatctttgacagctctgaacgagcttaaccttttttttcagacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaagtaggtcttcagtgagattttgggaaagtcataatggatttgtccacaagggggtgccagctgtgttgtatgtattgttagcggaaggggtgataaatgcgttcatgctcttgctaggcctaattcgttttcctttgtgcttgcagaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtcaagcaataggcgcctggcagtgtcaagcctgaaaccaagcaataccgtcatgtttcagccaagcccagagccctaagattacaaacaactatggccggaacctcctcagctctccctctgcagagttccctaccctaagagaatgttaccacctgaacagtcctcggtgaatctgagaggagaggatggggtaaggcagaagcaccagctgtactactagaagggagcttttggtggtagatcccctggtgtctccaacctgactaggtggacagagctcaaagaggccctcttaccgctagcgaggtgataggacatctggcttgccacaaaggtctgttcgaccagacatatcctagctaagggatgtccaaacatcagaatgtgaggccaaccttctatcagagttaaacttttgacaagggaacaaatctcaaactgatccatcagtcatgtagctagctgtagagcttgcaacttaatagcagcagctgcccaatgccatgtgaagtaacaaactggtttttggtttttttttccccttcagttttaatgttatgtgtaatgtatttaaacccttatttaaataaaacttgttttcagaaa

SEQ ID NO: 606574 - DNA, 90 bp, Homo sapiens
ggtcagccatcattactttatcatcatgatcaacaggaaagaccactgtcctcacccaatccccttctgtcgtcttctcaaaaccgtata

SEQ ID NO: 606575 - DNA, 275 bp, Homo sapiens
  misc_feature (20)..(20): n is a, c, g, or t
  misc_feature (74)..(76): n is a, c, g, or t
  misc_feature (95)..(95): n is a, c, g, or t
  misc_feature (97)..(97): n is a, c, g, or t
  misc_feature (104)..(104): n is a, c, g, or t
  misc_feature (106)..(106): n is a, c, g, or t
  misc_feature (111)..(111): n is a, c, g, or t
  misc_feature (113)..(114): n is a, c, g, or t
  misc_feature (120)..(120): n is a, c, g, or t
  misc_feature (152)..(152): n is a, c, g, or t
  misc_feature (191)..(191): n is a, c, g, or t
  misc_feature (209)..(209): n is a, c, g, or t
cttgctcctcagaaccagtngggaagaagagggaaggcaaagaaagaaactgagcatagtaaacacagcatttnnntgtaggctcttatttaacntngtgtgtntntctcntnntatgtntgtgctttctgagtaagtattgactgggaaangagaagaagtcatcaaagtatactgtgccattgcagcanaggctggcccagatttanacctcctgtgggtaatctaactgtgcagtagataggatcggccatatgacgaatgagatcaatagg

SEQ ID NO: 606576 - DNA, 1001 bp, Homo sapiens
  misc_feature (342)..(342): n is a, c, g, or t
  misc_feature (394)..(394): n is a, c, g, or t
  misc_feature (463)..(463): n is a, c, g, or t
  misc_feature (566)..(566): n is a, c, g, or t
  misc_feature (600)..(600): n is a, c, g, or t
  misc_feature (655)..(655): n is a, c, g, or t
  misc_feature (698)..(698): n is a, c, g, or t
  misc_feature (761)..(761): n is a, c, g, or t
  misc_feature (840)..(840): n is a, c, g, or t
  misc_feature (871)..(871): n is a, c, g, or t
  misc_feature (919)..(919): n is a, c, g, or t
ctgctcactatctcatatcactcctcaccttcgtgttagtatttggccgcggattttagcaatgcaccagtcctgcacatatcagatcagaatgaacagctttgtgtcagacttcggaagacctctggagccagattaggtcttatctcgccaaggcaaccacggagtccatgcctctcctttcactgctcactccatagaggcggaaccgctcggacaacagccaaattcttgccaccacaccacacacccccaactgagacctcccagattcagcacagacacccctgaccaccgggcacaacgacgtgagcaccataacctctgcttatcccagagccnacctcccccatctcttgtaggtcacgtcaacttcatgcttatttctgtgacncaatcctatccttctatttgtctctccattattcccctcccctccacaacacctccaaacccctccccnccacctacgcctcaccacacaccgacccctcacacccccacttccacccgcagccggccatcctcacctcttacatggattgtctgatctcatcaggatgctnacggagcgtgcttctccaacctttctccgtcgtnaagccacgacagataatctagggacggttgtatacgtagcccccacatcctcccncccacggcttgccctcagcgcccccccgcgttttatctgagtntatctagatatataccagagtagttgtgtgacgtttgatccccctccctcacctctcgttctntatcccgtgcatagacgtctgatacagtttctgcaagaatggacgagggatcaccgtccaccttctcatcgtccgcacnccaccttcacctcaccctcgatcagtcgcgntattcgacgtcaatcgtcctctccaccacacgtaccttccgcagcatncccagcgtacatacgcgccccgagacgcccgactacacgccttacatcctatcgcccgttacgtgtaagtaggtgctctcag

SEQ ID NO: 606577 - DNA, 819 bp, Homo sapiens
  misc_feature (777)..(777): n is a, c, g, or t
  misc_feature (779)..(780): n is a, c, g, or t
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccatgctgtctagtcttgaagtccctcatttaaacagaggtccagcaataggggctggagggtcagctgaaacaagatacgcatgttcagcaagccaaagctagantnnacatatgcggacttcatctctcggagtcctacctaaaag

SEQ ID NO: 606578 - DNA, 735 bp, Homo sapiens
  misc_feature (731)..(731): n is a, c, g, or t
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccataaaaaaaaaacaaaaaaaaaaaaaaaaaaaaaaaaaaaaaaaaaaaaaaaaaaagnaaga

SEQ ID NO: 606579 - DNA, 152 bp, Homo sapiens
  misc_feature (36)..(36): n is a, c, g, or t
  misc_feature (141)..(141): n is a, c, g, or t
gtccgcagctgctcccatcagtgatgcccacccagncacggaaacgacatggtttatatatgtggtgtcctggtattcggcatagatgcctccggtgtagttagccagtctttctgttgccattattccacagctgatggnacgcaagatgg

SEQ ID NO: 606580 - DNA, 746 bp, Homo sapiens
agcgggccccagtcactgagccgccgccgaggattcagcagcctcccccttgagccccctcgcttcccgacgttccgttcccccctgcccgccttctcccgccaccgccgccgccgccttccgcaggccgtttccaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccattaggcaacttatgatgcggccaattcagctcactggcaatcgccttaaggagcgatttctgccggcgttac

SEQ ID NO: 606581 - DNA, 562 bp, Homo sapiens
tcgtgccgaattcggcacgagcaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 606582 - DNA, 699 bp, Homo sapiens
ggagaaagggtggccagtggtcttccaaggctccatgcgcagggcagaaggaggaatataatcctatcccaccctcccattctccgtagtgtggctgccctgtggtgtatccctctcctcatccttttttgttttttttttggtttttggagaacggggtttcgctttggtcgcccaggctggaattgcagtgctgcgaatctcggttcacgtgaacctcgcgcctccgtggattcaaacgatattccgtgcctcagcttcccaagtaacctctcttcatctctatatccagcctcagactcttcccgcctgaggatggagcggggggacaccgcggggcgggagagaaggcctgagatgagagtgcagggccaacacaggctcctcagggagctgtcgccgggaggcccaggcaggggcatcagaactccatgcaggtccgtgacagccctcctctgaggctcgggtactccctctctgtgagccttccggtggatctcaacagttgaccaacacccaagtgtgaggcactattgcagagccatcgaacagtgtgacacttgggagccagacgtgctcctcagttagaatctcagctccaccttggctagttctgggaaccctggatgactgattaccttccatgtgtctggccttcctcatctactaaacgggttcctcctaagggtcatggatgaa

SEQ ID NO: 606583 - DNA, 585 bp, Homo sapiens
agcgggccccagtcactgagccgccgccgaggattcagcagcctcaccgaggaaaaggaatcgtatcgtatgtccgctatccagaacctccactctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 606584 - DNA, 109 bp, Homo sapiens
  misc_feature (77)..(77): n is a, c, g, or t
  misc_feature (93)..(93): n is a, c, g, or t
  misc_feature (96)..(96): n is a, c, g, or t
gcctccattccggccgtgcacatcaaccaggccacgaatggcggcggcagcgccttcagcgactactcgtcctcagnccctccacccccagancanccagcgggagctg

SEQ ID NO: 606585 - DNA, 624 bp, Homo sapiens
  misc_feature (10)..(12): n is a, c, g, or t
  misc_feature (19)..(19): n is a, c, g, or t
  misc_feature (55)..(55): n is a, c, g, or t
  misc_feature (103)..(103): n is a, c, g, or t
  misc_feature (116)..(116): n is a, c, g, or t
cgagggattnnncagcctnccccttgagccctcgttccgacgtcgttcccctgcngcttttccgcacgcgctgcgcttcgcatggcgttcaccgagaaaggantcgttcgtatgtncgtatccagacctccctctttcgacccctttgctgatgcaagtaagggtgatgacctgcttcctgctggcactgaggattatatccatataagaattcaacagagaaacggcaggaagacccttactactgtccaagggatcgctgatgattacgataaaaagaaactagtgaaggcgtttaagaaaaagtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctctcccttgtcacaggtttaaaaacctcacagcttgtataatgtaaccatttggggtccgcttttaacttggactagtgtaactccttcatgcaataaactgaaaagagccat

SEQ ID NO: 606586 - DNA, 1284 bp, Homo sapiens
tgagaccgtttccggcaatactgatttgcgagttatcgaaggggtgggactcgatactcacctatgtgtagtgcctaactattcgatcacacatgaagcagaaattctcaggaaaagtgttgaaccagaggccgccagatgcgatgccagtataatttgtcaaaaaaactataaaacaggtaagggtgtacggattatcgccaggagagacaatgagaacatccaaggtggataccgtgagaaatcactcggaggtggcattagtctatgcaataggcactctatagaaatttggagatttaatggagaagacgtgaaagagataatttaagggacatggctagatagttattgacacgcgttatcgagtatttttccgagtacacgcatccacattgagtacacaacaaaatgatacttaaagtgccagggcatagagtatatgttcgcgtgggcatagaaaatagataggcgacaacaaaaacttgttttaccagtggtagacacagtcgaatctcgtcctcaagatactgcatgtaccatcacaaagtgacactgcgcaagacagtctctatgtcagactgtgaatatgaggcagcagtgagctgatacaagtgagacaacaatgtgtggccttcctcacactctcaaagctgcaaatactgtgctagggccatgtgaagcgattgggaatacgaaaggaactttgggtaaagcgcgaagagtacaatagtggacaactgctctcatcatggtgtagtcaaccataaagacttggtgaataggttttcgggtcgaaaattaaacaattttaacataaattcgttaaacataccacaatggtttggttatactgggtgtattttactttggctatatacaagggggcgagtacgttaaacttttacttggttaacaaaacaggttggggaaggttgcccaccacttgtttaattttaacgcaaattggtgtttttaaaaaaaatacccaagcgcggggaagaacacttaccacaaggtgggggaaactgtgtttgaaacacggaaggggccggcggggggaaacagtaacaactggggcacttcggggggggttactaggtcccgtttaatacaacaggtggtgacaaccttttgacaacgggtgacttgtgcccggggaggacaccaaagttgggggggcgaaggcacgatgtggcaataaacatgaacaggggttatagcccctaaaagttttttaaaacaggggacaatattttaacacaggcagagtagggaacaggg

SEQ ID NO: 606587 - DNA, 244 bp, Homo sapiens
ttacgtgagtgacaaggagcaccaggagccttgcctgacttactgtctgttggtaggatgtgacatatgaataatacaaaatacccgtcatggtttgactgtgcagattaaatcacgtgctatgactacatgccttgactgccactcttcttgcttgacccttagccaactataaccatgtcttccatggaacacataccagtgttttaacatttgcttgacggtattcactaccgtgcttgtc

SEQ ID NO: 606588 - DNA, 468 bp, Homo sapiens
  misc_feature (288)..(289): n is a, c, g, or t
  misc_feature (304)..(305): n is a, c, g, or t
  misc_feature (319)..(319): n is a, c, g, or t
  misc_feature (335)..(335): n is a, c, g, or t
aaatccaattaacaattttacaacataagatagaatggagacctgaataattctgtgtaatataaatggtttataactgcttttgtacctagctaggctgctattattactataatgagtaaatcataaagccttcatcactcccacatttttcttacggtcggagcatcagaacaagcgtctagactccttgggaccgtgagttcctagagctggctggtctaggtgttctgtgcctccaagactgtctggaatgactgtattgccaccaacttggggggggggggnnttttttttttttttnnaaaaagggaggggnaaaaaaatttttgggnttttaaattaaattaattgggtgccctttctgatgctaagactccagaccttttgtttttgctttgcattttctgattttataccaactgtgtggactaagatgcattaaaataaacatcagagtaactcaaa

SEQ ID NO: 606589 - DNA, 234 bp, Homo sapiens
gcctggctgtattcactcgccaccaccacccttggccccaagtcgcagagtccagtgtgtcattcttacacatttgtgtcctcatagcttagctcccgcttaggagtgagatcatacgacgtttgattttccattcctgagttactgcacttagaataatggtctccagttccatccaggttgctacaaataccccttttttgttcctttttatggcgagtgaaattacggcca

SEQ ID NO: 606590 - DNA, 1144 bp, Homo sapiens
gtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaagggataccttcatttcgggactcaatatcctagatccaagggacgggaaattaggggaagggcttcacccggggggatcaagataagaagatcccatacttcttcccagggtaagggagggcctgggggcagggtcatggattcaaagctggactgggaatgggcagaaactggctgagaggccacccttgcagatttggtggccttcaaagatggggttccatggagtctcagagaggacaaagactggtcagcggggtggatttggccatgattattggaactagagctgggtagaccacgagcttctcagatggcaggggcagatcctccatcggtgagaatccggcacttgacagtggtgtcctgagagtggtgtcctgtggcagttgctgcgtttctcaaggcccatctggaaaggtcttcggcggggccttccttcaaggtggccttctttttatcccaggtcgtctcttacttgcaactggtaccctcctctaaaaaattcttcccttttgggcctgagcacagggatacaaaactcgtgttacctcgggggggaccaggtggtgttgttagggggaaaaacgcagcgacaagttgtgccggaaaccccacatttgtggcgaactatgggacatgatgacggggagaacaaggaggaggtatgaccaagcagacatagaacaaatttgcagaagcaggcaccgaagttgagcacccataaggtgcggtgagaaatactatcaaggaggcgagcagcggcataagaagaggggctgaatactgatccaccagcgtttgctcttcttttctggttgtcgtagcgaccctcttcgcggcgctgtatcataagaggagggggggagggggtc

SEQ ID NO: 606591 - DNA, 309 bp, Homo sapiens
  misc_feature (156)..(156): n is a, c, g, or t
cggcgtgtcggctctgtaattgtgggggaggtactgagaggtgagagccagacacaggaagtggccggccacagccacagcgaggggctgctcggcagtggacacctgcttgacgacctgcacccgggcctcagacaccagaaacatctggatggntgtgcgatagacagagatgatgcaaactgctacacagaaggggagcccactcacagggttctcgttcagtgcaaacgtggctgcccccttgatgcgggcccccgaaggcactggctcgaggttcagcatgttgaccaggctgatggagctgac

SEQ ID NO: 606592 - DNA, 173 bp, Homo sapiens
gcagtgttggatccatggaatgtctacatctgcctgaggcccagtagcccaagaggcgtggtgcaggagatagcctggacgcttgtgagtatacccggattcatgactgatattctgggcgcctggggctcccagcttctgccgctggcagctagtcctccaacgtctcagtc

SEQ ID NO: 606593 - DNA, 414 bp, Homo sapiens
tacttccgtgtaaacacagatgcagagatatcagcagtaagaaaggccacgtgaggaagatgctgcggcatgcggatgcctcagccatcgtggagtacgcatacaatgacaaagccatgtagagaagcagaggaacatgctgacggaagagctcaatgggaacacattgcagcatttacaagccagcagatcacccaactctggacaaagtgtaagaggtacagccagaaaaataagaacatattctggatgaaatgaaacagattctaaatccaatgggccaaaaggaagcagtgattaagcactcataggtgcataaagtatactaggactaaaaaacctatgcaccccccaaactcagatcagacatgatagcagccatccgcgaagcggaggtctacctggcacaaaaac

SEQ ID NO: 606594 - DNA, 492 bp, Homo sapiens
cttgaaatcatgctttgcagcaacatggattgagctgaaggccattatcctaagtgaaacaactcagaaaaagaaaatcaagtatcatgtgtcctcacttatatgtgggagataagtagtgaagacacatgtgatcgggcacagtggctcatgcctgtaatcccagtactttgggaggctgagacaggaggatcacttaagcctaagagtttgagacaagcttgggcaaaatagtgagaccccatctctacaaaaaacatacaccaaaatttagctgggcatagtagtgcgcacctgtagccctagctactcaggaggctgaaatgggagaattgcttgagtctgggaggtcgaggatgcagtgagccgtgatggtgccactgtactgcagcctgagtgacagagcaagaacctgtctcaaaaaataaaaaaagaaatcctgatcctgtcagttgcaacaacatggataaatctgaggacattatattaagt

SEQ ID NO: 606595 - DNA, 955 bp, Homo sapiens
  misc_feature (147)..(147): n is a, c, g, or t
taaatagatgttcactgatatacgattagtgtgtgaggatgctgcggaggcgtagagcatgggaagcgccgtcgtacccccgtatgtttacccactatgcggctgccacggaagcaggcgcatactttgtgggagtcgcccaatttngtttaacctaataagatcgtgtcggtcgacaaaattcgggggtttgcccctccccccgggtcaatgaatacttaacaaacggttttttcaaagagggtgaaaacaggggcgttcattattggctacctaacaatattcccgccgtgttagtcgaaggagaacacgcttgttttgtgctgggcacactcccgccgctgcctcttgtggttaacacctctctccccgctggttccaaaggacaaaggttcgagcctgtgtcgtaccctcccccctgcgccccctctgtgtggtgcgcccagccgccggtctagttctgtcggacaaaatcagctgcccggtattttcctgtaatgggccgcgtcataaaatggttaatccccccagggtccccaactctttgtttaaaagtacccaagcgcgtctttgatgtgtccactgttatctcctgtgcgagcttgcggctccccgtgcccgaaatgttgggaattttttgctcgtaatcaaacggggtcttcttctcagggcaccccacaccgggcgcttttttgcacggggattcggccgcaaaagctcttcttgggtggggggggaaatgttgtacccactgttgtgtgtgtccagctcttgtggccctcaagagcggttcccattgccgctccccccgtcacgtccggtttgcgtcagaatcacacacattgtctggcccatgcgtggccccctcgagcccccccaccccgggtttttttcccatgtccaaaaaaaaaatttttcctttctcccaaataacaaaaaaaacaaaacataaaaa

SEQ ID NO: 606596 - DNA, 349 bp, Homo sapiens
  misc_feature (51)..(51): n is a, c, g, or t
  misc_feature (102)..(102): n is a, c, g, or t
  misc_feature (189)..(189): n is a, c, g, or t
  misc_feature (271)..(271): n is a, c, g, or t
gggacttcaagaaaaaatctgaatgggaaaaatgacactagaaggaaaacnccacacattttatgccagagaatggtgtgttttctaaaatatgtttcgggnggcgaaatgtggctttcaaaaaaaagtgaccttttcttctttgaaactttttgttttgacaggaataattaagggttgggaaagaancacaattctcagagaggtttgcaaccaggagagacaaagaagtctcagtagtaatcatgatcaagagctttaacagccagcnacatttaagaatgtattagtaacagaaattatatgtctgtgaatgtgtctcaactcaaaaaagaacacgcctcccccc

SEQ ID NO: 606597 - DNA, 374 bp, Homo sapiens
acaggggggaaagtcaatctaaaaggataatcttttagacactctctactaatatcctaagaaggccagaacaattcctcttttcttatctttttaaacgagagaaagaagggcaagctccccagaatcttagaacctgaaaaggtccttaggaaactatctagtccaacatctttgtcttacgggtagaaaaaagtaagtgcaaagaagatgaatgtttggaacctaggctctaaagaagttgtggcgtcagagttctgacccaatccaatgctacctctatcccaccaaattttgcctttctttggattaacaggtcaaccaaatcactatcaattcctcctctattaggccatctggtatcccaacctatg

SEQ ID NO: 606598 - DNA, 171 bp, Homo sapiens
  misc_feature (154)..(154): n is a, c, g, or t
  misc_feature (156)..(157): n is a, c, g, or t
tgctctctttctttctttctttctttctctttctttctctttctttctttctcgctctcgctctctcgctctctccctcgccctctctctctctctttctgtctctctctctctctctctctctctctctctctctccttctgtcgtcttctcncnnccgtatagtagtag

SEQ ID NO: 606599 - DNA, 144 bp, Homo sapiens
caggacacagctattccaatcagattttgggtattattgttacaaccttttccttcacctctgcgatcatggtgatcaagctaaagctgcttattttctggcgcacattcgttctccagtgtaacagggaaaaacaagtgaacc

SEQ ID NO: 606600 - DNA, 204 bp, Homo sapiens
tgcccacacggagaaacctgtctctactaaaaatcaaattgggctgggcgcggtggctcacatctgtaatcccagcacttgggaggccgaggtgggcggatcacgagatcaggagatcgagacaatcctggctaacacagtgaaaccccgtctctactaaaaatacaaaaaaattagccgggcatggtgttggggataacatca

SEQ ID NO: 606601 - DNA, 956 bp, Homo sapiens
aaaaagctcagcaaccaagataaaaaatattttaaagcaatattttgttttgggatttttttttttggagaatcagagtatcgcctcgtggcccaggcgtggaggtgtagaggcgagactctcggcctcacgtgaacccgtggtgccttccccgggttcagaggcgattctccgtgccacagaccctccgtgagatagcgtggagattacagggcatgtgcgcccaccatgtgccacagcttaaatttttctcatatttttataggtaagagacatgtgattttcacccactccgtgggcataaacagtagggtgaaacaccaccattactcatacctaagaaaataacaaaaaaatatagacgcggggtggtgaggagggatgggacaccgtggcggatccgcggagtgcatgtgggaagcgcatggagcgcgggaagacaggtgcgcggtgaaacacgtgtggaaggcgggaagacatgtgcgaggtggagcccggagaagtggcgcgccacgtggcgactccaagccgtgggtcaacgaggaggcgagaacttccgctctcagaaaactaaaatataagattaactataagtatattgtaacttacaaacacaataaaacacatctaagacgtggtggactaatacctagatagccgtccctcttagagggtcaggggctggagcctagagggtgaccattctcccaggggccagcacataatatacaagaggacaccaaagaaaagctcagacatcccaaaggtgcatgaagactgcaaggcaatgagccaagggagcctgaacctttacagacaagaagtaagaaaaaaaaatcaaaaataaatggcaaaaaatcccatgatcgaggacaaggactagagagagaacaggcgggaagacacacgaactagaggaaggaacccatgaccacagaggtacgaaaacaatagcg

SEQ ID NO: 606602 - DNA, 263 bp, Homo sapiens
cttattttgggtctgtaatgggtcaggctctttcttcagagggaagcctgcttgtggcttctgcaggttggggagggtcttgcgttacccaggcgtatggtactgaaggggtcataaagggcaagtccgtgcagctggctagtgcagctggcctccaggagtgtggcccagtttgagggctgtgcctgccctgcggtctaggctgatgggataattctcagtgagggcggggtctcacaggcttctgtgggtgaatggccgtg

SEQ ID NO: 606603 - DNA, 309 bp, Homo sapiens
  misc_feature (105)..(105): n is a, c, g, or t
  misc_feature (234)..(234): n is a, c, g, or t
ggagagcaggcggagcaaggcacgagtctcaaagggccgcaggtccaggggcttgaacatcaggcccttgtagaatttcaggaggatatcattcagagtctggtnaaaaacagtgagaacacgggcaagggattaccggacgaccgggatctaagagagcagggaggccgcaccgcctgtcactttggccacgcgcagaagggacagctccaccttcaggtaggccagctgggncagcagctcctccttcttcttcccgcgaagatctcgagccttgatcttggccaatgctgcacaagccgcgacgac

SEQ ID NO: 606604 - DNA, 335 bp, Homo sapiens
ttcttcttctcttgagacagagtcttgctctgtcacccaggctggagtgcagtggtgtgatctcggctcactgcaacctccacctcttgggttcaaacgattctcctgcctcagcctcctgagtagctgggattacaggcacgcgccaccacgcccggctaattttcgtatttttagtagagatggggtttcaccatgttggccaggctggtcttgaactcctgacctcaggtgatccgcccgccctggcatcccaaagtgctgggattacaggtgtgagccactgtaccctgcctggtatgtagaattttctaacaaatagtttagtgcttctc

SEQ ID NO: 606605 - DNA, 224 bp, Homo sapiens
gacatctcatcatttgcatacaggatttgcgtgcaagtactatattctaccaaccacgtgagtagactcaaagtgtgatggttgagtttaacatagtcttctttgtatcgaatccaactggctgaccttgtaaccattctagaggctgaactgtatgaagacctcgagtaccattcacaaggtgctagtcaagagactttaggagcagattcacagtgtcaaca

SEQ ID NO: 606606 - DNA, 308 bp, Homo sapiens
ggcccacagtacttttatagccctgtaggataactataaaaccccagaacttgttcttcctatctagctgtaattttgttttttaacaaatctctcttatcccctcctccctctaccttttccatcctgtaactattctgctttttatttctataagatcaactttttagcttctacatgtgagaacatgcagtgtttaatttaacatgcagtgtttaattccctgttccttatagcggccttttttttttttttttttaactcattaattaggtttactgtttactatgggcactgtttggactctg

SEQ ID NO: 606607 - DNA, 462 bp, Homo sapiens
cccgatcacgcacatgaatagctcattataaagaagggccttctgattccccctgctcccaaattaaataaaaaggaacagtcatttgttttcatggaaaaaaaaaaaacaaacaaaaacaaaaaaaaaccagaaccatcttaagcaaagtttaacatgaactttatataaaataaagtacaatttccacttaaattcagtcttcaaatattttttatgggaaggccatgcatggccttcatttatggtatttcaaatcacggtacttttactttggtgaaaacactgccggcattttctagtacaaaaaaaacctaaaattggtttcaggaatgtagagaattatccaatttaaatagcgaaaaagtgcaccatatttactgctgcacggcagtcatctctgcaattcccatgtttcttaaataactatctggtcagataacacacaatataaagagcaat

SEQ ID NO: 606608 - DNA, 351 bp, Homo sapiens
agatggctgaagtgcagtcaccatccttagggagaggcgagaaagacaggccatagagctgaaaattacaacacagtatggcctggcaacagtggaactcagagcaagaaacagaggagggatccatcaattctggggaagtttcagaataggagggagcttcactccacgcagaggaaggggctcctgcaaacactggaggaaagaacatcctctgtgacgtcacagagtatgaggctcctagttctaataggattggatgggggttgtgctgctgtgagagatgcagtgttgctcacattatcttccaaatggattcactttcattaaaatgacaattgttttacagtc

SEQ ID NO: 606609 - DNA, 684 bp, Homo sapiens
tctggctgaagaaggttcattgcaactaagtttacgacccccaacactcggctctgaagggactcctccaaatgatcagcagttcaagaccacttaggcccagcgtccacggatgctacaaagccttaggacaccataagctcatgtcccctagaatccaggcctctgagcttataaccatcactcagagtggccttatccgttgcaggagcaccatcagcagcctgttaggtctcattgttcgctgttacacaatgactgttgttgctcccagcttcattccccacccctgctagtgcctctgccaaccatgttcacaggcgcttccatagcactacagccaatgcatcatgtaataataaggttctccgtcctattaacgttccctgcgacatgaaagccagagtaacccacatggccctacatgctatgtatgcgactgcctacagtatagtacaggtccgtgcctgggctcagttaccacgtgtcagatttgcaccctctctcatgtagtaagcgcgaatttagtcacacctaaggaagatcacatgaatttctagattacaagtgcatgttcccaagcagcctctcccatctcccaggtttatgacctcgcatacccctgtatatttttctcactgtcacttttgtgaaccctctcaacgccttaatttaaacttgtat

SEQ ID NO: 606610 - DNA, 123 bp, Homo sapiens
  misc_feature (2)..(3): n is a, c, g, or t
  misc_feature (122)..(122): n is a, c, g, or t
gnncctggtgagctcagatagtctcctctgacactgtgtaagaagctgtgaatacctaacttccccagatgttgcgaaaagttgaaatgtgtaattgttttggaataaagggggtaacaatng

SEQ ID NO: 606611 - DNA, 341 bp, Homo sapiens
taccacagtttaaaaaaaaaagaaaaaaatgcacaatcttttggacaaaagaattaaaggcagaaatttaaaggaaaaatacatattcaaagaacatagggaggtataaaaaaaggtttctttctttttttgagttttttttggtaggtaggttgttttcctctaatcttgcttagagtcccttactaggaatattgaatagccaggcctatgaactggggggctgtcccatttgcaggggtctcacctactttagtaaggggcgaaatcggttgtagccccctggtttaaacctgccacagaggcaactcattacttgcggaaggggcagaggctggagg

SEQ ID NO: 606612 - DNA, 346 bp, Homo sapiens
ggtggcgagccggtgcatctgtggcgaacattcgacgttactacgacattcttgcctgggtgacccagccgcagctggagggcaaccaggtggtggaaggcaacctgcatgtgccgggcgtggacaagaccaagccgccacaagacaccccacaactctgatcacggcagcccgcacactgcaaatccctgtgggagccggggcttgcccgcgatagcggcctgacagtcaaggtcatagccgcctgccggaccgctatcgagggcaagcgcggctcccacatgtgatcatcgtcgcctaataggacggagagcagatgaagtaccccacgccgtcaacagcatca

SEQ ID NO: 606613 - DNA, 274 bp, Homo sapiens
tgcatcagcctcctgagtagcggggactacagctgtgcaccatcacacctggctaatttttgtatttttagtagagacagggtttcaccatattagccaggctggtctcgaactcttgatgttgtgacccgcccacctcagcctcccaaagtgctgggattacaggcatgaggcaccatgcccagcatcatctgaacttttctaggttatttgttaccagcaaaaagttgggatctacacatatggtaaatttacaattaaacgagttacaaag

SEQ ID NO: 606614 - DNA, 199 bp, Homo sapiens
gacatcgccaaaataggtagactgtataaagcaataccattcacaacaacagcactaattattggaagcctggcattaacaggaatgccttatctcacaggattctactcaaaagaccttatcattgaagcagtaaatatatacttcacaacaatcctaatcctaataccaactatctccctaattgaaaacaaaatac

SEQ ID NO: 606615 - DNA, 696 bp, Homo sapiens
  misc_feature (3)..(3): n is a, c, g, or t
  misc_feature (66)..(66): n is a, c, g, or t
  misc_feature (98)..(101): n is a, c, g, or t
  misc_feature (122)..(122): n is a, c, g, or t
  misc_feature (144)..(144): n is a, c, g, or t
  misc_feature (155)..(155): n is a, c, g, or t
  misc_feature (163)..(165): n is a, c, g, or t
  misc_feature (170)..(170): n is a, c, g, or t
  misc_feature (177)..(177): n is a, c, g, or t
  misc_feature (185)..(185): n is a, c, g, or t
  misc_feature (189)..(189): n is a, c, g, or t
  misc_feature (193)..(193): n is a, c, g, or t
  misc_feature (207)..(208): n is a, c, g, or t
  misc_feature (210)..(210): n is a, c, g, or t
  misc_feature (226)..(226): n is a, c, g, or t
  misc_feature (388)..(388): n is a, c, g, or t
  misc_feature (406)..(406): n is a, c, g, or t
  misc_feature (508)..(508): n is a, c, g, or t
  misc_feature (511)..(511): n is a, c, g, or t
  misc_feature (514)..(514): n is a, c, g, or t
  misc_feature (524)..(524): n is a, c, g, or t
  misc_feature (527)..(527): n is a, c, g, or t
  misc_feature (570)..(570): n is a, c, g, or t
  misc_feature (578)..(578): n is a, c, g, or t
  misc_feature (583)..(583): n is a, c, g, or t
  misc_feature (596)..(597): n is a, c, g, or t
  misc_feature (599)..(599): n is a, c, g, or t
  misc_feature (617)..(617): n is a, c, g, or t
  misc_feature (695)..(695): n is a, c, g, or t
gtnactgacgcttacgactcacaggtcctcggatccacgagcgcgggagaggaagaccgacatgtnagctgcttgtccccatccatgcggccgtcctnnnnacacagagccctccgtggtgnccggggattggattggagccangacctcacttnctcctctnnncctgnccctgcncctcccancacntggnccacaccctgcaanncnccccaatggtctggcnctgggtggcgatggcgtccaaggtgagggtcccctacatatggcctggctccgtgcatagcctctggctcctgggggcagtccttctgatggaagcgtactgcaacggcctaccaaccactcgtaccactcagagagagagtagccaacagggaggagaatnagatcctagcccccagancacctgaacggaggtgaagcatggagatggacgggcacctcaatcgcggcttccaccaggaggtcttccataggcaaagacctgggtggctttgataaagangangancgcggcgganganagaagctgatggatcatcttttccaaggtggatgtgaacactnaacggaanatcantgccaaggagatnnancgctggatcatggagaanaaggccgagcacttccaggaggccatggaggagagcaagacacacttccgcgccgtggaccctgacggggacggtcant

SEQ ID NO: 606616 - DNA, 265 bp, Homo sapiens
gtttgtcgtcctcgcaagcagactcaccgtgcctggggcggagggatgctttggatggcttaatcgtcgtggctacgttggcgcatgagttgttttgcacctgtgactgcttggaggacccccgccggtgtgcggccgactcctatcgccagcgtcctgtcattcgtgctggcaccttttgcctgctgcattgacgagtgcttgcgtgctgttacctgtcccacgggaagttgcgttcggttacatgttgccttctttgagccca

SEQ ID NO: 606617 - DNA, 95 bp, Homo sapiens
  misc_feature (83)..(83): n is a, c, g, or t
ctctgtgtaggcagaggggtgtgcaacaacaggaagaactgccactgcgaggcccactgggcacctcccttctgtgacaagtntggctttggagg

SEQ ID NO: 606618 - DNA, 170 bp, Homo sapiens
  misc_feature (71)..(72): n is a, c, g, or t
tagtgcattgggagatgtgcaacttcctgaaaatcttttctgtttctggagtacttcaggggtggcctctnnccaggagcctttgccacagtgctcccaccagccccacctcatccgtctgtttgcagagcctcatctacaggttcccagcgttgccttctttactcact

SEQ ID NO: 606619 - DNA, 239 bp, Homo sapiens
  misc_feature (4)..(4): n is a, c, g, or t
tttntctcaaaccaccattcacttttttacctatttaacaaaccttcactttcttcacattcatcccataaactaaattataataataataataataataaataatatataaattttcttaattaatttaaataaattaaataaaattcattttttctccattacatctttcatcatacttttcattttaaactttacattccattatatatttacataatttatttaaatttcttaat

SEQ ID NO: 606620 - DNA, 1544 bp, Homo sapiens
gcagaggaccgcagctggcaggcagctgggtgtggggtgcgttgtggctggtgtgggcaggcctcagttttggtgtgccaagtcaggtctgcattgcagctatgtgtaaagtgctgcaagggcacagctcctggtgtctaagagggacgagagtccctgagatgtgaagacccgcacttccccgagtcccagacacacctccacagataacccaccaagggacaggagcactatccacaggtacccacagacggcaacgcatggctcgaagcaacaacacagcaagcgtcagacatagatgcagagaaggactggcacgatgactgggcgccaagcaattgggcacatgcaccaatatctcccaagaacgactgtaacaatcgggaactgctggcctcaagggacgatcacactatcaaattgtataccacccgtttgacaccccaacaacggcggcaccagaagcaacagatgcacgcaagacctgtgagcacacgcgtgggcgcaagctccccaagatacctaggactgtcactgagccaacatgacacgtagcaacaccaagacggaaccccaacacaagagaatctcaggaagcgaacattgagactcagggcaacgggccaccgctagacctcgtacgccaccatcacccacaagggagaccacaccaacagaactagaggacacagactacttgaaacaacaccaggcaagttacccaaacagaacacgccctagacagcctcgggcacaaaacttatcaggccccacacaactttcgcctcaggcaaccatacaccaaatcacaagcgacaaaatgccgcatcacacccagcccgacaccacacatacagaaacatgtacccaaacattccctggcccgcacgcacgcggtgccacagcgccccatgtagaacacggcgaccgccagatgaacaggggaaggtacaggacaacacatagtcaaccgatcacatacacacatgcgacgcccagcagccgccgaacaacagcaaactgctcggcacctagcaacaccaccgactcgacgcaggacccacgcaacaccaacaggtcggcattcacctcagacaagcggaaacccagcgtcacgccgtcctccggccacacgcgcagccatcaacacgcccgcgaccacagcactcgaacgaccctccactcagcaccacagcaccacccgcacttcggaacagaacgtgaatcaatcacacacaccgcacagcagcgagaaaacaacagaatcgaccgcaagcaagcacaaccggacggacagcgagcactgggatcctagccacacaccgaccaacacgcagcgtaaagactacctataaccaagcacacaagcagactatgaacaccaaccaccacacgacccacaatcacacgcgcacaacagaccgcgccacgcacacaccaacaacccagccaacaacagcagcagaacacagacacaaagcacacacaagatagcacaggaaccagctaccagcagaagacacagagcccaacgtggacgacac

SEQ ID NO: 606621 - DNA, 196 bp, Homo sapiens
gatacgtattgttatagcgccatttgcgagaagtcatcggatgaccatgtcagagtaatagtagtgagtcatgtgagcgatagatgaggcgtcgtctgaggcgtctggtcagtagtgcaatgttacttataatactgtagtgagccgaagtcgtaggcaggcaacaaggtgctagactgtgattagaacaatttat

SEQ ID NO: 606622 - DNA, 110 bp, Homo sapiens
cacgaggtggactgagatacatcttgatccccgtcccccagcaataatcccgtaacggagggaccactgcaggccggaaacatttccaagagtttacgaaggtcgcggta

SEQ ID NO: 606623 - DNA, 595 bp, Homo sapiens
accctattttttgacacttccatgtttaaaaatacacatggaaaaaaaaaaaaccctatatgcttacggtgcacctagagcttttttataacaacgtcttttggtcggtggtttgggattcttaaaatatatataattctcatttagtgccctctttaagccagaaatctcattacggcttcattttggtaataacattcaactttagatattttccatatatgggcacggctaaaactagaatatagcatctttcatatggggtacggaaccaacaaggaaactttcctttaactccctttttacactttatgggtaagtagcaggggggcgaaatggcattcatagatcatttctaggcaaacatggtgaagctaatgaccaaccggttctacctatatgcagcctcttcatttactagaaatggggaatcagggcctctgtgaagagaaacacagtcaccatcctgccattaagctgtatccatatatggcatttctgtatctgcgtgcgtatggccaaaacacaaccacacacaacaaacacaaacacaactcttaggcccccccgaccccacaaaactatcttcacacag

SEQ ID NO: 606624 - DNA, 184 bp, Homo sapiens
tggaaatgaagtctcactctgctgcccaggtggattgcgtggcactaatctctgctcgtggaacctccgcctcctgagtcaagcgattttcctgcctcagcctcccaagtagcggggattaagggcttgtgccaccacacccatctaattttattttattttaacgtagagagtggggtttaac

SEQ ID NO: 606625 - DNA, 174 bp, Homo sapiens
ggttctagtctaatggtaccagttcttctgggccacatgggcctggtgtaaacacgcaggtctcaccagtctccatgttgcagaagactttgatggcatccaggttgcagccttggttggggtcaatccagtactctccactctgactggaagagtggagagtactggatagac

SEQ ID NO: 606626 - DNA, 315 bp, Homo sapiens
tgactctagcggatcctaacggtctgttacctggggcacctgcaatgatccaacgcgttcctgcaacagttctgtcagcttgcaacagctgctcagcttgatctggtgagcaacatgaatatctgctagcgaagcacccgtctgatgcgacggcggtacgctacgaagtgccgggcaaaggcttcttctggtgttgatctgccaacgatgagcgtacccggttcttgctgtagcttgttcgcgggttgcggttgtcctccaccggttgggttgcatgggtggctgtctgtccatcaatcgccattatgtcggtga

SEQ ID NO: 606627 - DNA, 1027 bp, Homo sapiens
  misc_feature (1010)..(1010): n is a, c, g, or t
gtcaccataagcttttgatagggctttgtctttccctttctcatacatttttctgtcctagagaaagtgggagatttaaaaattatgtattctgtctttgcttgggtactgtgaagtcaggtatatttgtagagttgggttagcgaggtagtgacaatttccttttaaagatgtatatcttctttctccccaattctttccaaagaaattactgatgctgaggaagatcctgaggataaagcaacaaacgcagtctggaaccagtgacattaaagacctgaaccctgcacctcatcttgggacaattctaagggctacctgagttccacatattatcaaggactcagctgaatcttttgatggaaaacttgagaccagcgtcagagctagacaagggccatggagggccaaggtcatggcagagcctcaattgtctccacagggagcggttatggacaacctaagagtcttgctctgttgcctaggctgaagtgaagtagtgtgatctcggctcgccacaacctctgcctcccaggttcaagcgattctcctgcctcagcctcccgagtagctggaactataggtcatctaggggaaaacagaagtatgaggattgagacttcttctgaaaatcagtgagtggctctctgcagtggttacagaaatgccacagcatggactccctcctgtaaactggctctgctgtcccagcagtgacggaaagcactcaatttgttttctcttggaagagacagagtggctgtcagtttactgcaatattttggactgcctggaaaattcaatgtacaacaggagaaaggagaggcaggagacagactctggaatagaagtcaaagacaaagaggctcgtaaacatcaagattctggggctaatctagccattcacagctttagaaccatggacagtaaaacttaaaatatatactatgttctaaccaccacaaggttattcactctagcaactaaaaaagcactggcctcagcaggcngcattcaggatccgagc

SEQ ID NO: 606628 - DNA, 281 bp, Homo sapiens
gggttctaggtgtgagtcaccgagttgagcccctaaacacatgtttttctttttagagacagggtctcactccagcctgggtgacagagcaagaccctgtctcaaaaaaaaaaaagctgggcgtggtggctcatgcctgtaatcccagcactttgggaggccgaggcgggcggatcacctaattagccgggcatggtggcacatgcctgtaatcccagctactcgggaggctgaggcaggagaattgcttgaacctgggaggcggaggttgcagtgagctg

SEQ ID NO: 606629 - DNA, 263 bp, Homo sapiens
actaactagctagcaagcacgcttgctcctcagtcctagcaacatcaaacactagtacctaggaatcctagtctgctgctgtcttcctagatacactgaatccacttgtgtatagcacctgaatctgctgtcaattaatgctagtcctcaggatttaaaaaataatcttaactcaaagtccaatgcaaaaacattaagtaagtaattactcttgatcttaaattacttccgttacgaaagtccttcacatttttcaaactaag

SEQ ID NO: 606630 - DNA, 393 bp, Homo sapiens
  misc_feature (16)..(16): n is a, c, g, or t
  misc_feature (190)..(190): n is a, c, g, or t
  misc_feature (367)..(367): n is a, c, g, or t
tactactactaaattngcggccgcgtcgaatggaggtggggcacagggactacaggtcaatggaggtggggcacagggactacaggtcagtggaggtggagcacagggactacaggtcaatggaggtggagcacagggactacaggtcaatggaggtggggcacagggactacaggtcaatggaggtggngcacagggactacaggtcaatggaggtggggtcacagggactacaggtcaatggaggtggagcacagggactacaggtcaatggaggtggagcacagggactacaggtcaatggaggtggagcacagggactacaggtcaatggaggtgggggcagggactgcttcagtttctgtcnacgcggccgcgaatttagtagtagta

SEQ ID NO: 606631 - DNA, 456 bp, Homo sapiens
  misc_feature (16)..(16): n is a, c, g, or t
  misc_feature (190)..(190): n is a, c, g, or t
  misc_feature (430)..(430): n is a, c, g, or t
tactactactaaattngcggccgcgtcgaatggaggtggggcacagggactacaggtcaatggaggtggggcacagggactacaggtcagtggaggtggagcacagggactacaggtcaatggaggtggagcacagggactacaggtcaatggaggtggggcacagggactacaggtcaatggaggtggngcacagggactacaggtcaatggaggtggggtcacagggactacaggtcaatggaggtggagcacagggactacaggtcaatggaggtggagcacagggactacaggtcaatggaggtggggcacagagactacagggcagtggaggtggggtcagaaggactgcatatcaatggaggtggagagcacagggactacaggtcaatggaggtgggggcagggactgcttcagtttctgtcnacgcggccgcgaatttagtagtagta

SEQ ID NO: 606632 - DNA, 943 bp, Homo sapiens
  misc_feature (352)..(352): n is a, c, g, or t
  misc_feature (368)..(368): n is a, c, g, or t
  misc_feature (528)..(528): n is a, c, g, or t
cagactatgtgcttgtgaaaaggtcgggtaataaacagtgcaagtcattacagtggttttattcccgaatgggtttttttggtcgtttgttttttggctcataactggtccttgtggtgccctcgtggtgcatactgtctcatgcaaacacgaagtactagtatcgcttaattcttctctgcttccacgactgatgagtcatggccattcgggatatgtgacagcatgtttagcagactaccgatacaattggccaccgtagagaggacaatacatggaccctacaagcaataattggtccacactctatacagcttgtcattttaggactctgtgcgcgtccacagtaaanagagtttggctagganaaggcatgtgtgatgtctgtgacagatcggtgggataactgcttcatgaggaagatgcagaatcctcttaaaccgttgtggtggggcgcttatgatgtatatgagtgggtcgcggtaggccttcatttggaaggttttctgaacaatcctcgtgtagaanaaagctcggtttctatcaccagtcagtgatccactccactagggagacgtgcacgagagaatgatataagcagtgatcaatagcatagaactcggtgggaaaatctacaactactcgttgcgacccgtggggacccatctgcccacgagggcatctcccaaggacaaggtcactttgcccctagcctttcgacgaccgtcacttttgagaagtattagaccctggggagccccatcaggggggcagaggggacgcaactacgcacctgcgacccggcagtggcaaacacacttgcgagggcgtaaattgcggctggagcacgaacttggcaaggaattgccaacccttatgtagatttgtcggccccggggacagtgggggtggtgccagaaaccacgcccagtgggacggggca

SEQ ID NO: 606633 - DNA, 405 bp, Homo sapiens
  misc_feature (16)..(16): n is a, c, g, or t
  misc_feature (190)..(190): n is a, c, g, or t
tactactactaaattngcggccgcgtcgaatggaggtggggcacagggactacaggtcaatggaggtggggcacagggactacaggtcagtggaggtggagcacagggactacaggtcaatggaggtggagcacagggactacaggtcaatggaggtggggcacagggactacaggtcaatggaggtggngcacagggactacaggtcaatggaggtggggtcacagggactacaggtcaatggaggtggagcacagggactacaggtcaatggaggtggagcacagggactacaggtcaatggaggtggagtcacagggactacaggtcaatggacatggagtacagagactgcaggtcaactgaggcagaccacaggacgggtcgacgcggccgcgaatttag

SEQ ID NO: 606634 - DNA, 179 bp, Homo sapiens
ctccgagatctcgacggataggggatctgacgtacaagcgctaacataagcattcttaattcacagctagtttatattatcctaactactaccgcattcctactactcaagcctaaactccagcaccacgaccctactactatctcgcacctaaaacaagctaacatgactaacaccct

SEQ ID NO: 606635 - DNA, 472 bp, Homo sapiens
gggtcagctgctgtgctccaacgtcggtcagaaaatgaagagtttgttaaagtgggaagattggggccctctgattattttggtgaaattgccctactgatgaattgtcctcgtgctgccccagttgttgctcgtggccccttgaagtgcgttaagctgggccgacctagatttgaacgtgtttttgggccatggtcagacatcctccaacgaaacatccagcaggcaacacgttttgtgtccctgtctgtttgaaatttgcctcctgggcctccctttttttcctctccccaatccatggttcactcatgcaaactgctttattttccctacttgcagcgccaagtggcccctggcattgcagcttcctgtttgtttatatattgaaaggtgcttttattgcccccttttcaatttggagccttaactaaatggtcatacccagtttaataaatagaaagagttttatgga

SEQ ID NO: 606636 - DNA, 1301 bp, Homo sapiens
gacctcgaagtctgagcatttgttacggggaacgcgtcaacgcggtgagtagccgtctggtcgtggctgccactgttccgctctctcggctcctcctgaaatcccgtacggccactcagtgtccgatggaggtagcatctacacgagtgccacgttgggcacgagcgtcgtgcggtagattcctacagtaagtcctaatagccgtggcatgggtgcagcatcgtaacgtagctcttagtcgacacaacaggacaatcggcagcaccgactgggcgacgaggccgaatgatggaccaaggagcgatgagggagggagggagcatagacatcccgtagcgaaacaacctgtcgtagcgaatagtagatgggagacagctgggacgagcgacgatgcccggcgggcagtgtataccgtagacgttggaaaaggccgaacagtcattggatgaacgtacgcgacgtgggcacgcataccctgcacagcatccgttccgacccctagagcatgcatcatcaagcacggcgaatggaaggatgctagcccacatagacctatgcccagagcggcgagctaagcaaccaattgaggacaaatgggcagaatccattgtggaggctaatgttcgtatagagcaccccgacatttgctgcgacaggccttaggtcgtagaactcaagggtggacaacacggggttgctttcaagcgggtcctttcatatgggttattgcgcaccatgactatatggggttgcgggggaaaccttgggtggacctggggggttcggaacccattcccccttaggttaccaaattggggaaatccggttaccttcgttccaaggagactggcagtgtcgattggtggccataaaggaaagaatgtcgcaataaagcgtgggaacgagtattccatacaccaattattgaaaacccagcggggatagaacccccacggagggttattcccagaacaagtggcaatggttagggtttgaaggcccccgttaaaagaaaacgtcacaagtacgcctttgcaagccgaaccacaatagaaccgaacccccggtgggggagcgccaccttccttgacgtctttgtgggcccctatgccagttgtcggtaaggaaccaacacttggaaggagcccacattctgaaatagaacagatacgttggtgcaggttcagcgaaacaaggcgttgccggatagaatcgaagggcggcgccgaaaagcgttaaacaggtgagagagccctataaaaccctggggctttatttgaaggcccccggacatatggtgg

SEQ ID NO: 606637 - DNA, 119 bp, Homo sapiens
agcgatagactgtgcgacatggatcgactgtattaaacaagcatcggaagccgtgtggtgtgacgcgattgatttctgccagtgtctgaatgtcaagtgaaaattcatgcagcgcggta

SEQ ID NO: 606638 - DNA, 232 bp, Homo sapiens
ggtagtcccagctatgtagaaggctgaggtaggggaatcgcttgagcccaggaggtcaaggcttcagtgagccatgatcacaccactgtactccagcctgggtgacaagacagattgagactctgtctcaaatcagacaagaccaaaccagccagctaaccagaggacaaaagaacctgttgctgagacccagtcttcagagcgacactagcttcttcaccttgctctcttg

SEQ ID NO: 606639 - DNA, 638 bp, Homo sapiens
tgattttgtatatttattagaaacaggctctccctctgcgtctccctccccacagtctccctctccccctctttccacggtctccctctgatgccgagccgaagctggactgtactgctgccatcttggctcactgcaacctccctgcctcattctcctgcctcagcctgccgagtgcctgtgattgcaggcgcgcgccgccacgcctgactggttttcgtatttttttggtggagacggggtttcgctgtgttggccgggccggtctccagctcctaaccgctagtgatccaccagcctcggccttccgaggtgctgggattgcagacggagtctcgttcactcagtgctcaatggtgcccaggctggagtgcagtgccgtgatctcggctcgctacaacctccaccttccaactcgctgccttggcctcccgtgccgagattgcagcctcttgccggtcgccaccccgtctgggaagtgaggaccgtctttgcctgggcgcccatcgtctgggatgtgaggagcgtctctgacaggccgcccatcgtttgagatgtggggagtgcctttgcccggccgtgaacccgtctgggaagtgaggagcgtctttgccccgcgcgcccctttgagaagtggg

SEQ ID NO: 606640 - DNA, 211 bp, Homo sapiens
atctagaggatcccgggtcacgaccaggagccgcaggcgcggtgaagagcgctccaggccaaggagggaggagatcatcaagacttaatccagggaggaggagaccaagaaataaaacctcccatttggtctggtacattacgggcctcgtgtgataacattagatcagccattaaaataagaacaggccttaatctggcgcatgtgccta

SEQ ID NO: 606641 - DNA, 198 bp, Homo sapiens
tggaatgggctcaaggttcctgagacacccgcttcctgcccaaacaggtgtagaaagataagcctgttacattgtcataatgatgtggggtgaccttcttggggacccgggggctggtgtgatggacctgtgtatgtatttacaactctcgtcataaaaataaagctgtctgtactggtttaaacaaaaatataaaaa

SEQ ID NO: 606642 - DNA, 463 bp, Homo sapiens
acgtacattccaaaggactttgcgaccctctaccagggatggggtgtcaacggccctgggttggagcacaaagggacactccggacgcaggcccggccaggagagttcgtttgcctcgagtgcggaaaaagcttcccccagcccggccccctcagggcccccatgcgggccccctcaggggagagacccttctaacccaggttccgtcccgacagtgcctcttagaaagggaacctaaaggcgtgtttcccacgcccccccggtccccgtaacggcccttagcagtacccccccgatgtccccgcagcctcccccctgtgacctggccgctccatggaagaaccgccggggaactcctgagccgaccccccccctccccagcccctgccctggagtggaaactgaaggccgatgcccccccctgtttaacgttccgaaataaatgaagatgctattttctaga

SEQ ID NO: 606643 - DNA, 934 bp, Homo sapiens
  misc_feature (934)..(934): n is a, c, g, or t
ctcttgggtgactatgtgcattgtcgatgagcagtaacattttgaaaggaatctttttttttctgagcagtaggtctcaacagtaggcataaaaagatttagtaaaccatgctgtaaacagatgtgctgtcatcagggctttgctgttccatttctatagcataggcaaagtagatttagcataattcttgaaggtcctaggatttttggaatagcagatgagcattggcttcaccttaaagtcaccagcatcattagttcctagtaagagagtcagcctgtccattaaagccaggcattgacttctctgtagagaaaatctgttgtttagtgtagccaccttcaatgatcttagctagatcttccatataacttgctgcagtttctacatcagtacttggtttttcaccttgcacttttatgttatagagatggtttatttgcttaaacctcatgaatcaacttatgctaccttcaaatttttcttctgttgctttctcacctctctgagccttcacagaattgaggagagttagggccttaaactagattaggcttggcttaagagaactgttgtagctgggtaacagagcgagactccgtctccagaaaaacaaaagagagaaagcgccagggtcttgctatgttgcctaggctggtcttgaactcctggggctcaagcgatcctcctgccttggctcccaaaagtgctaggattacccggcgtggaccatgcacacgggctaatttgttcaaagcacctacgcatgttccctgggattatgttcagctgcttgaaggattcaggggtcctcccttcatgagtatactaatctgggcctaggaatgcacatgttcttacgcacagttcacaaagaatcttgtaagaaaaatctaaattaaagaggaaaccttaacaacttggatggacctn

SEQ ID NO: 606644 - DNA, 309 bp, Homo sapiens
gcccctttgtttgtcaattttctgccatttggaatgactgtatttacccaatgcctatacccacattgtatctaggaagtaactaactagtttttgattttacatgctcataggcagaagggatttgccttgtctcaaatgagactttggactgtggacttttgagttaatgctgaacttagttaagactttgggggactgttgcgaaggcatgattggtttcaaaatgtgaggatatgagatttgggaagggccaggtgcagaatgatatggtttggttgtgtgcgcacccaagtatcatgttgaatt

SEQ ID NO: 606645 - DNA, 300 bp, Homo sapiens
  misc_feature (199)..(199): n is a, c, g, or t
  misc_feature (206)..(206): n is a, c, g, or t
  misc_feature (230)..(230): n is a, c, g, or t
  misc_feature (250)..(250): n is a, c, g, or t
atggactcggggctcatggactcggggctcataaactcggggctcatggactcggggctcatggactcggggctcataaactcggggctcataaacttaaaggtgtaaaatggggtttcaccatgttggccaggctggtctcaaacccctgacctcaagtgatccacccgccttggtctccaaagtgctgggattatangcttganctaccttgcctggcctaacatgtnggggcaactttggcaggcancctcaggcacagttcgaacactctggccacacctgttttgccctctgacc

SEQ ID NO: 606646 - DNA, 178 bp, Homo sapiens
gagcgccgggccaggctgaggaagcgtcaggctcagctccagtcgaggaaggagtacgagcaggagctgcggtgatgacttgaatgtggagcgctacgcgacagttctaggaccaggacacaagaaggaccagaggctccagccaccccggacatgtaagataggcggtgtcatactt

SEQ ID NO: 606647 - DNA, 839 bp, Homo sapiens
  misc_feature (256)..(256): n is a, c, g, or t
  misc_feature (278)..(278): n is a, c, g, or t
  misc_feature (291)..(291): n is a, c, g, or t
  misc_feature (300)..(300): n is a, c, g, or t
  misc_feature (322)..(322): n is a, c, g, or t
  misc_feature (342)..(342): n is a, c, g, or t
  misc_feature (364)..(365): n is a, c, g, or t
  misc_feature (378)..(378): n is a, c, g, or t
  misc_feature (388)..(388): n is a, c, g, or t
cagagaaccccgtcaaacttgaaattgttcaaaaccgaagcaggtaaaaggtggcatgacaaacactgggcttcctagacttttgttttaaagtattaaatatgacttgaaactgactttattcacatactttgtacagtggagcattacccactgtgtttgtggttacagttagagtgaagtgacacaagtgacatgcttgttccagtgggtcggaagccccagaccttcacaaggcattgaccctttttgcccntgaagtttttgggtgtcccaanaataacatctaangatataccncatgtacctacgagcttactcnctttagctattctatctttntaaattatgttgcattcaaacnnatagttgtttttntgacaatacnctgaatgacaaacacacctgagaaattcctgccctttaaaaattctcaaagttactttttctctgcctcagatagaagggatctataaatactgattagaaacagtacaaaattgaagtttctcctgttgggttcaaaacagcttaatataggggctggtggctggatgcagtggctgacgcctataatcccagtactttgggaggccgaggcaggcggatcacttgaggtcagaagttcaagaccagtctggccaacgtggtgaaaccccatctctactaaaaatacaaagattagctggacgtggtggcaagcgcctgtagtcccagctactgtggaggctgaggcaggagaatcgtttgaacccaggagacagaggttgcagtgagccgagatcgcgccactgcactctagcctgggtgaccaagcaagactatgtctctaaataaat

SEQ ID NO: 606648 - DNA, 314 bp, Homo sapiens
tagttttgttttttcagataagagttttgctgtgtcacccaggctggagtgcagtggcacgatctcggctcattccagcctccacttcctgggctcaaacagttcttattgcctcagcctcccaagtggtgggattaaaggtgcaagccaccacaccaggctaattttaatttttttgttgtttttagtaaagacggggtttcaccatgttggccaggttggtctcaacctcctggcctcaagtgatcctcctgccttggactcccaaagtgttcatgtcaccatgcctggcctggaattttgctttaaaaagg

SEQ ID NO: 606649 - DNA, 1525 bp, Homo sapiens
cggatccttgtaacctagtaggacacttatgcgtgctgatggaagcatacgcctcacagacatgctgttgtggctcctagaatcgttgctagtaccggctcctgcgttctggcggagttcgtggcctagcatcgtagcgtggtgtccttgcacaggattccaggtggggttagtcactagacgccacgtgctggaggaagtgagcaaccgtgttacgcatgtactacgacacgctgagtgcacctcgctataaaccagtcacggacaactaggtcgtgcgtactacaagactcactgtactcgtcgactcctcgaaataccatcttacatgcactgggtaggtccttaaggtgaatggactccatgtgagccacggacggtgtgagatgccaaggcctagtcatatgacgttcttgatacgtaactcttagccatcgggactggaaggtgagtacgttagaccgggacgtctccagtaaggactgaagtgcctctcatcggatcgcaagggcacagaggcaacgcacgtacacgacacctgcgcagacggtgaacggacgtgcacacgaaatagcaccgcgaaggacattaactaccggaccagacaccgcgaagcgcttacaagaaagtgcatcgcatcgggaactcgaacagccgatacacatgcgaatagaggaccccacgcatatacctaatgagagaaacggtttgacatacaccgtaatcccacgccagttatatccaaacacttcccctgtttattgttcgccattaaacagccccaacaccgagaagagcggcacgacaggaacgatattgtgggacgctcaataaaaagcctaatggactgcgttgcgagtaaacgcttgtgggtgtcgtatataccggacgttggagtttcgataccaatagaaccgaatatagatccccacgctgatagaggcattaacgtcggtgaagacggaagttcagtgccatggcggccaatgcacaggcacatcgttagagtacgacgtactcccaatcacgaggacaaggagtatgggtacaatttgtgctcacacatctatggccgcgatttcactctggacactaacttatctgcgccagttttaagtgtccttagccaccacgaggctcccgtcacgaccaaagtaagactggatagcacgccgtcaattaggccacagagccccaaattacgtactgacagtttgcggcacgggcacattacacccataggcaattttcccagtattatcccataaaacttaattgtccttaagtactaatcagcgcatcgccaaagccttctcgttgaaaaaaagatcaccccgatgctcctagaacctaagaactacctatttgggcgtgttgcatagcaaacaactgcacttgtgacaacacattgctattgacacgcgtactgattggtcacaacatatcagttatcaagacacacaaacacaacctacgggatcatatcacacagacagtgattcccaacatttcaggacaccaaaat

SEQ ID NO: 606650 - DNA, 737 bp, Homo sapiens
gtgattcccgagcagcgtgcaaaagctaagcgagttcctgtccagtgcatagatcctgtgaggatgcagtgtgccccccatgagcccacaacttagggcccagccagcaagtaccaggcggtgcccctcaggtttgttgaaccgcaagcagtccagcccggcgaggattgtcggggcctcaccggaccactgtttagcctggtccccagtgcaaatggcgatgctgacaactgctgtgtccagtgggacacgcctaagtgaagatcatggggtagtgctacctatctacgttggacccctagatggaatccacgcgacgactgtccataacatcagcatgtcgtatcccccccgagggccagaactgactaatgcattcagtggggcaaggttggggtcttgcgggcaaagtcctcgtctcctttctaggctcgactgtgtgcgggagtatgccgacaggtctacaggagggctgtcttcgtggaaggcaggaagccctttcccttgacaggccgaagactaagagacgagggacccccaaggcccaagacggcggggagacagcggacccgaacttgggaatacatcacgggcacagtgaagaagggcccacgttgggccccatattgccttacgacatcaaataacccaattgggtttgcctacaatgtggcccaccttgttggacggaacgaacgagtccttcttttgagaagtctcctttcaaagaaaacaag

SEQ ID NO: 606651 - DNA, 102 bp, Homo sapiens
ttcactggtgaaacagggtgtcagcaaggcgcttaatcatggcagcagggtcagggggggggcaggggcagcctcacgtcccagtcccccttgttgggcatg

SEQ ID NO: 606652 - DNA, 121 bp, Homo sapiens
ataatctggcacggccattgggttgaagaacatttgtggacagaacaatggaaggtgacggacagaatgacacaggtgctttacaaacaggcatccgtaaatgcgggttagggatgctgtg

SEQ ID NO: 606653 - DNA, 336 bp, Homo sapiens
  misc_feature (55)..(56): n is a, c, g, or t
  misc_feature (137)..(137): n is a, c, g, or t
  misc_feature (159)..(159): n is a, c, g, or t
atacacaaatcaatatatgtgattcatcacatcaatggaactaaaaacaaaaacnnatgatcatctcaatagatgcaaaaaaggctttcaataaaattcaacatcccttcatgttgaaaacctcaactaattaggcnttgaaggaagatacctcaaaanaataagagccatctctgacagacccacagccaacatcatactgaatgggcaaagctggaaacattctccttgagaatctgaaaaagacaaggatgccaattctcaccatttgcacttcaaaatagtatgggaagtctaaccaggacacataaggcaagaacaaggagacacaggtgc

SEQ ID NO: 606654 - DNA, 533 bp, Homo sapiens
  misc_feature (6)..(7): n is a, c, g, or t
  misc_feature (399)..(399): n is a, c, g, or t
  misc_feature (435)..(435): n is a, c, g, or t
  misc_feature (440)..(440): n is a, c, g, or t
  misc_feature (460)..(460): n is a, c, g, or t
  misc_feature (498)..(498): n is a, c, g, or t
  misc_feature (512)..(512): n is a, c, g, or t
  misc_feature (529)..(529): n is a, c, g, or t
gcgatnnggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggttgacgtggagaatcccgacctggaaaagttccccaagtttgccaaggccccattcctgtcctgcatcctgtctcctggagagatcctgttcatcccggtgaaatactggcattacgtgcgggctctggatttgagcttctcggtcaagcttctggtggtcgtagccaggataggagctgaaaggggctgacattgcagacagnatttcatctgttcactaattttcctggggtcctggnaatcnatagagacaagcaggactgnaactgtgttcctgaaaaagccttcaattgccaattggnaagcccttgggggnttaaagcttccagaaantgga

SEQ ID NO: 606655 - DNA, 100 bp, Homo sapiens
cccttgcgaggttcatattcaggatcctgggcaggaaacccatgcacgtcgttgctccaacttacaagattatggcatttagatccagataccgtattat

SEQ ID NO: 606656 - DNA, 291 bp, Homo sapiens
  misc_feature (6)..(7): n is a, c, g, or t
gcgatnnggaggaggaggaaatcaccatcaatgcctggtttggtccccagggaaccatctccccactacatcaggatccccagcaaaacttcctagtgcaggtgatggggaggaagtacatccggctgtattccccgcaggagtcaggggctctgtaccctcatgacacgcaccttctccataacacgagccaggtgggcactgggggtctggggtgacgttgcaggttctccccactgccctggagatgatgacgtcctttgctttcttcaggttacgtggagaatcccg

SEQ ID NO: 606657 - DNA, 859 bp, Homo sapiens
aagcagagggtgatactaaataacgtaaagggggatcaggccacgccggatgtgctccgataaccgggatatgtggcacaagaatggttgtaatctagataggtactagtgtttggaaagccgagtagtcagtcctcaaggggaagattatctttgagtatacatgatgtattcatggggaatagctgagtttgaggtaattgtttagcaaaattctgtttcagagtgatgtgaaaacaagaagaagttatggaaattcatctgatgccagatatgtatgatggatagagggacaccaggaaaacattcaccgaagaaatgggtacgaatgcaatccatactgcgttggcgcatatgtcctcactcacaatgtgcgtggtggattgactgccaggtgacaatgtcttgctcttaccgcactgcagtacattcggacaatgtgctattcatagtagaagggtaaaccatcaaagacggtggtaggctgaaccatgattgaagcaagtgagatgaaatgtgttttgtctacacccacaggaactggtctggatgtgccttcaaccagatgaactgaggtcatggctgggacatatacctcttgactgggaaatgtggccctgaattgacatggagttccattaaattgcagatgttgtctccattacctttaggtatagtcaattcaaacgtattgaggataggttcaataacgtaaactattctctaggggtgcagaatgccctcgttcatctttgatatttcacaagcggagggagatcaccaacaaaaacaccttggcgggggccgggctttggaaaaattcaaagacatttgggggggggggcacaaagaagagaca

SEQ ID NO: 606658 - DNA, 314 bp, Homo sapiens
agctgcaagtctagaaccgagacacatataaaagatgattttacatggaaccagccaccttgaaaaatattctgaaaaacatgatttaactttagaaaataaaacttttcatacttaagagataacatgatgcaaacgttgcttgttggcctgactttccaggactaagaccctctgggaatcaatggggctcggtgacatggcgtaacctgctactggggtgtggtctcagacacaaagatcacactggatgttggcctacagaggcaggattctctcattgctggatgactctagaaattaagcctttgcaa

SEQ ID NO: 606659 - DNA, 562 bp, Homo sapiens
  misc_feature (530)..(530): n is a, c, g, or t
actttcaccctgccatcaaaggatgtgtttcagccatgtcacaaaatcatataggtgattgccatctccttctccgatattaccccctgcccaccctgccgcttttaccgtatgggttcctttgggtgggtgatggagggtgatgtgatcagccatgacatcagcatgctggctgtgaccccggaaagatcgggccgccattgtaaatctcagccagcgctcgcaggtgtccggggcttctctggcagaagccatgtctctcacatcatgtgccagcctccaccctcacgccatttccagggaacagactgcgggtatgtagcagtgtagtctttaacctgctctgatacatattcagagtatggattgttgtttagaaagagttgcatgtttaaagagtttggtactagcttttcattacttggtatctagattatcataatggggctaccactttccttggttttatatccatttcctcttggaagtccttgttgcttatgtgacctgttggttgttccccggactgngcacctgcaggagtcagggcagacggcagatg

SEQ ID NO: 606660 - DNA, 595 bp, Homo sapiens
cactcggggctccctctcgtggtcgacaggcgctctctgcacacgcctgcagtgctccaccgcgagcacgagagtggagcccccgcctgctgccctgtttgcactcgtgcctgttgtgcctgcttagtggccctgcgagccccgtcgtcgacaatagttcggtggacggcagtgcggggaggcgcatggcaaccgaaggctggacgtgtcccaatgctgcaaagtcgaaacatatgcttttcgtaccgaaagaatgactcgctggacgaattattatcaatggcttgtgaatagcttgcggcaagacacatgatgtgtgctaaacgaacgtccctcaagcatgcggaaccagtggcgtgtcaactaactgttaaagagaatacattgagcacgccaggagcaccaagcttacgtgatgtggagatagcatcggaaaaccctcgtacaggtaaatacccctgtttacgaagggagcaccaagcattgaagcaacgctatcaaccaaatggaaccagtagatagtgctgctcataactcgtccccgtgccgaaatacatcggcgatgtaaaacgtacctgactattgacaagtacag

SEQ ID NO: 606661 - DNA, 510 bp, Homo sapiens
tgatcaggagataggacacagccaccttaataaaaggaagaagatactaaaaatctgtcaaacccagcagtactcaaggcctagagctccatttgttttttatctgcctacttcacacacctgacgatatgttgtcggatcttattattggaatattgttgtgtctgcctaagaatgaaactttcactgccatttttatttcaatatttgtggctgagaacagaaaggaggacttatttgggattacaggaagcaaaggtagaatttctggccaataacaattgtacgtttagaagaatttggggcaacacttgctttcattgtaacacgccacctggtcacaagattatggggaaataaatatatcgtcttcactttattttttttgttgctggagattattggtatttactaaaagactggacatttactgagaggtcacattggctcaggtttctaatttctaatttctaacccattttccaaataaaagagaagtgcaaaaaaaaa

SEQ ID NO: 606662 - DNA, 1149 bp, Homo sapiens
  misc_feature (918)..(918): n is a, c, g, or t
cgtgtgtgtgctggccatagtggacctctacaatcaaccccgtcccccgtagtgtctggctggccttctacccgttggtgtgcttgggtggttcctgtgtcattggctccatcctatgtgggctttctacactcgcggactatgccgatactgagccctgcctcggtgccctttgtgaccgctcggctcgttcttacagcgcacttgtcgggcgtgggtgctcttgcgagtcgttcatcgaacccgggtcgagtcgattatgcgatgagattggtgtgtcacaccatctgttgtcctcactatcatctctgggggtcttccaattgcaggagttgttcttctgtgttaccagacatgtatgcatctgagctgtcctacctgggtatggcagtgcgcctcgatgctcttcccaaacagtatgggcaaatgcatgacattggttggagacgcttgggccccaatagtcgaaatgcatcaatggcatgcgcgatccttgatgtcgcggccacagtgggcgcaatgctccgcactagcgtctcggcgttgctccttgtggctcgttgtatcattgctcgcttgacatgttccgaaggtgccgcaatttcaccaaatgagaagccgcaccgtgtcaaccagagttccgatctcgttgtgcaagagtcgtaaagggaagctacacctaatttgtaactcgctacatctccaacggagatcagtcgcctctttcagtggatttaccatctggtgaccccttggtcctaagataagacacctctgtgagtggccaactgagccccttaaggactggggcgtgggaaaccctggcacagtcttgggctcgaatttatcattcctttttgtacaccccaagggcaaagagaagtgggcgcaaggcacgggtactgttcgttggtcggncgtggccatagttggtgttcgccattgtcgttgtgccttcgttgttgttgcccagtggtggtggttgtagctgttaggtcgggcggggggttttaccccagagtgttctcggggggctagggcgcccccgttcggcacggggattcggggcctttggggggcacccccaaaccggcggcagactggccccgcgccactggtgttaagggggcgcacaggtccagggggggg

SEQ ID NO: 606663 - DNA, 601 bp, Homo sapiens
  misc_feature (30)..(30): n is a, c, g, or t
  misc_feature (44)..(44): n is a, c, g, or t
  misc_feature (56)..(56): n is a, c, g, or t
  misc_feature (68)..(68): n is a, c, g, or t
  misc_feature (80)..(80): n is a, c, g, or t
  misc_feature (184)..(184): n is a, c, g, or t
  misc_feature (233)..(233): n is a, c, g, or t
  misc_feature (235)..(236): n is a, c, g, or t
  misc_feature (356)..(356): n is a, c, g, or t
  misc_feature (358)..(358): n is a, c, g, or t
  misc_feature (371)..(371): n is a, c, g, or t
  misc_feature (447)..(447): n is a, c, g, or t
  misc_feature (452)..(452): n is a, c, g, or t
  misc_feature (465)..(465): n is a, c, g, or t
  misc_feature (468)..(468): n is a, c, g, or t
  misc_feature (476)..(476): n is a, c, g, or t
  misc_feature (485)..(485): n is a, c, g, or t
  misc_feature (505)..(505): n is a, c, g, or t
tcacgccgtacccgagcgcgtgggtgcgangctcaggacatgtnccggcccctcangtcggaggtatnggtcgtcgtgtnggccgaggaagacgcccgccgggagggtcagtccagctttgcggatgtcgacggcatcggcccagcgtgccgaaccataagtcgtaaccagccgcgactgccgngaacgccataccgacatggcgatggcgacgagtaaagcgaacaaaccgntnncacccgcaatcgcaccgcctgtgtcgaagacgtgcggcgcgtaggcatcaaagaagaaccaccattcgaacaagcgccacgggtgataaaccggtacacctagaagatcgaaccagggcnanccgaggcgtactngatagccaagggtcgctgctgtccattgtgtggcgccccagacgccggcgatcacgatgccgattaccacagcganctggncgaacagaacgtncgncccttgcntgacctgtnctccgatttctcctgcgctngtgtctcattgaaaagcgtgcacacggggtgtcgcaggcgtaaggaatcggtctgggctagtgccggtcagagaaccgtcgcaggacaatgatcga

SEQ ID NO: 606664 - DNA, 316 bp, Homo sapiens
agcagccagatggggttttaggcaaataccccccaaactgcccagccaggtccccatttcaaagggctttccccggagcaaaagcagtttcgtttgtattgtcatcccccccatcaactttttttttcccctcccatgatgtatgccaatatcattattttcgttatttggaaacccgtcatcatcatcaatgtttcgtgaatttttgggggttatttttaacatagcatgtaaacagcccccccccccaaaaaaaactagctcaggataaacatttttaagagtttttcataggggcttatagtttgccccccca

SEQ ID NO: 606665 - DNA, 510 bp, Homo sapiens
  misc_feature (210)..(210): n is a, c, g, or t
  misc_feature (237)..(237): n is a, c, g, or t
atgtagctatctagtgtgttgtttagggagacagggtttctctctgtggcccaggctgaaacagagtggtgtgaacatagctcatgtatccttgaaaaaccaggctcaaagatcctcccacctcagcctctcaagtagctaggactacaaggcacatttttaatttctggtagagacagagtctcactatgctgcccaggtttgaactgnaacttctggcctcaaggggtcctcggnccttggcctcccatagtgctggtataacaagtatgagccatcacacccagcccattgccggttgtagttgtactatgggactaccgtgaggatggttgtgaccccatatatgattttcttaaaggatggttcagaactggaaaattgtaacaaatgtggcacttattgtggatctatcaccggtcatcataacgggcttcggcttgtaatccacaccacaccaggacttaagacactggggactgatgtcatctagagctcttcatttatttg

SEQ ID NO: 606666 - DNA, 155 bp, Homo sapiens
aggtgatgaagcccagagcaggaggcatctgacccttgaagtatcccatcgagcatggtattatcaccaactgggacgacatgggagaagatctggcaccacaccttctgacaatgagctccgtggtggcttcccgaggagcaccccaccctggt

SEQ ID NO: 606667 - DNA, 292 bp, Homo sapiens
  misc_feature (2)..(2): n is a, c, g, or t
  misc_feature (281)..(281): n is a, c, g, or t
gnttttggaatactcagtgtatttgcatcatagaaaatgtctgactgtttgcaaaataatattctgttttaagaatccatcttacctctctttaagtttccatacacttgagagccaacacaacatatttattactaaaaagatgctttgctagaaactcaaaaaccagcacttccttttggcacttcctgcccagttttctcttttgctttaaatgaacatcatcatatggaattggaataggagagtatgagtacgggcagagaagtggatcagaaaanctagaatgagg

SEQ ID NO: 606668 - DNA, 307 bp, Homo sapiens
  misc_feature (178)..(178): n is a, c, g, or t
acaatgtttccctttcagctcaactgcagaatagtttagaacagactttttgatttcacaatactgtttccacacttacttatatctgtaactttctaactttaagggaattccgcttatttgacatttaactacctcagatatgccaccaaacctgttttcatcattagttattttnaccttgtctactttaaaacagtgaaattattaggttaaattatgtttttatccagttactctaagataccttagtgtttgtctacttattacaactcaccaaattactgggttttatatggcctttggg

SEQ ID NO: 606669 - DNA, 416 bp, Homo sapiens
tagagcagaaccacttcccaatcacaccccatgaccattttctggacactcaccagcggggagcccagcacacacaccacgcagtcagccttgactgggtctctgacactaacatgaaattaggttaatccaggtgtttccttcccgaggcaggaaacaccatgaggagcagcacaaaggcactgtgatccagggctggagcacggacagaggcaccttggagaagcctgtgacaaacccaaagcttctgcctcaaacaggccccaggagtggggacagcgaggtaccctagtgtggccaggggcaccccaatacagacaccctcaccctctcctccaaaactcaccagctcctacgtggccagcccgaggctcactgcagggcttcccactcataacgcaacttcaaaaaaaaaa

SEQ ID NO: 606670 - DNA, 355 bp, Homo sapiens
agtttgatgtagcgattagcgatcaaatgcatccggctcgtaagtagttcagcatgcaagcgtctcactataggcatatcaaatcgttgctctggagcgtcatgggtccacggtgagagaactatgtgattagtcacaagtctcaatagagtctccggctatacgtgacatagcctattcagggacatcattcatagttcatccataatagcagtacggactcttctgccgatactatgcaatggctatgatcagtcaggccataatatgctcagccctgtatctatttactcgtggaacaaccgcactacagagtgattcgcaactacacacatgcatggaaccacaagcgtgt

SEQ ID NO: 606671 - DNA, 141 bp, Homo sapiens
ggcgtgaaccactgcacttggcctgttttatttttaaagaccctgtttttctccaaattattgatcacatgaactgcttattgttaccaataacgtatgtgtgcacctgtcatttcctttacaaactcaggatgggctcct

SEQ ID NO: 606672 - DNA, 374 bp, Homo sapiens
gctatgaatttttctcagtttgctgcctagtataaaaatttagtggataaagattcttggccgggcgtggtggctcacactggtaatcccagcactttgggaggccgaggcgggcagatccgaggtcaggagatcaagaccatcctggctaacacggtgaaaccccgtctctactaaaaaatacaaaaaaaattagccgggcacggtggcgggtgcctatagtcccagctacttggaaggctgaggcaggagaatggcaggagcccggaaggcggaggttgcagtgagctgagatcgcaccactgcactcgaacctgggagacagagcgtgactccatctcaaaaaataaaaataaaaaaatattctttactgt

SEQ ID NO: 606673 - DNA, 104 bp, Homo sapiens
gatgcatgcatgcagtgcttgcatacgtgcttatctatcttcacaaccacgggcctgaggagctggtgcggtctgaaggagctcaagcacgctatgcaggcgtt

SEQ ID NO: 606674 - DNA, 210 bp, Homo sapiens
aatcaccatatataggtaaatcaggtagcttctctcacatttgtctctaaatgcatatcttacgttcacaatcccccaaagatggggaaactctactgataaaattcaacactatttctccaaaatccatggttcaggtaaataaggaatagaaaatttaaatgttatggtgcttagtagggtagtttaaaataatagtggaagtttacc

SEQ ID NO: 606675 - DNA, 907 bp, Homo sapiens
gggtcaggagaagtggacacagggacgcggggctgtgtggagttgctgtccgaaggatgggcggggaggtaacaagaaataccgtgcctgaggttggatgtggggaatccatcccgtggggctcagagtgttgtactcgttaaaaaaatggatcattcgatgtggtcttacaagtgcactctaataacggaagcttgttgcggtgccatagaccctggttgaagaaatggccatcgtgcttcaattcgactgcacaccggtaccgacaggtggtacagagtcccatatatgcgcgtgcccctgtggggactgaacgaagggatgccaaagttgagttccctgtaggaagatcagcattttcatagacaaaaagcggatcttgacataaatttcagatagaaatatgagtgaccacggaatatacgaattgcaaaaaatgagcagtctttctgggggagcaggttccagaatgggcaagttcttgaggtgattcgcttcaaaggccagggacagttgtggccgagaaagaatggctatgtgcatagagtggaaagagttggagttattatctgaggaaaataatggaccgaaagggaattttaatttcctggtttgggcttcggacccatggtaataaacgcgtgtaatcgttgtcccggcaaacatatagaccactagaaaaataacactgtttggcgcccgccctccaaaagtttaagcacatcttgttggggcgcgccaggacgcctgctagccatggccacaccggtccaacaaacacgggctgagaagtgcggggtctcacaacaaacccccgggccagggttagcaaccaggagggtcggcgtaggacccagggcaacagcaaccgccccgtgtacacccacaccctgcgccgagcacccac

SEQ ID NO: 606676 - DNA, 133 bp, Homo sapiens
catggcgaaatcggaacatcactcgcccatcaagctcttgggcagcagtgctgtaatcagtgcaacacatttatctagtataaatgctcccatccccaggcagcaatgtgctatcgaaacttctaaaactagg

SEQ ID NO: 606677 - DNA, 184 bp, Homo sapiens
ggagaacttaaaatgtggtaaagtaagaaatgttaaaaagtccctgtttttgtcctgcaaattttagttctatttctgggttaaataagggattttctggacacagattatgagaagttgtagctctgatgtctagctgtagtctcctccgatctgctgattgcattattttaatttgctcttt

SEQ ID NO: 606678 - DNA, 152 bp, Homo sapiens
gcgcgcgttcgatagcctgggagcacaagaatgggtacaatgtagttcatgatatcctgcagcaattcaagccgggaaggggccaagatttgagtgcttcagttccaggagcagactatccagcttgagctctccaacaagccggtcggact

SEQ ID NO: 606679 - DNA, 459 bp, Homo sapiens
aattcggccattatggccgggaagtcttctgcttgttggtgctggttactggaagatgcagccggggagacacagggtagaaggggcaaagtcttaacttaggaccttgaggaagtaaaggggtaatattctaggatataagttggaccacaagttgaaaccttgagcacaggcttccagaagccgttggaagttgccgccagaagctgtaaccatgacgggggaacttgaggttaagaccatggccatgaagccggggtaaaccttgaggatcacaggcagaatcgccgatggaactgatggtttggaaattaatctgggccagggaacagacaagctgaacctgcatttaaaccttggtttaagcgaatccaccattgccgtgaactaattgaacggaagcaactgggggcaggaccaccggaaggatcacttgtgcttaagccaagggtaagaggt

SEQ ID NO: 606680 - DNA, 348 bp, Homo sapiens
  misc_feature (38)..(38): n is a, c, g, or t
agtccccctcctagacattccagataattgtccaaagnaaggaaaggctttagtggtccctgagtggattaaggtagatatgggggtgatgtggtatgtgtgtagtgtggaggctgagagggaggaaggtgatgaaacgagcaatacaaaaaataatttgagagcttgggcaagataagtgagcccgtctctataaaaagttaaagaaaattagccagctgaggagacttgggagggaggattgcttgaacccaggagttcgaggctgcaatgagctatgatctgccatagcactccagcctagactctgggtgacagtgggtaacagagcaagaccctgtcaaaaaa

SEQ ID NO: 606681 - DNA, 199 bp, Homo sapiens
atgacagatacgaatcgagctctttacccgatgatgtaatcttggcccgatgagttaaatctggcgagtgagtaaatctatgggcgatgagtaaatgttggcctggtgagtaaatgtcggtctctggcggcgggatccgtcatcggccaagatttactcatcgtcaatatttactcatcgggccaagatttactcatcg

SEQ ID NO: 606682 - DNA, 108 bp, Homo sapiens
  misc_feature (4)..(4): n is a, c, g, or t
cggnatggctgtaatgtctcttccatcatatgtaatatcagtggaacaggcagcgctactcaagtcctaaggatcctcagtgatcagtgatcacatggccactcaata

SEQ ID NO: 606683 - DNA, 332 bp, Homo sapiens
tactctggctcagggctataccggcgcctcctccatctaatacactgatcagctatatactgctgcctcctcctctgaatacactgatcagctactatactgctgccccctcctcctctaatacactgatcagctctataccgctgcctcctcctcctctaatacactgatcagctcatatactgtctgcctcctcctcctctaatacactgatcagaacatatactgctgcctcctcctcctctaagagaatgatcagtgtcgtcattctgctgcctcctcctcctccattatactgatcagaactatactgctgcctcctcctccaccaa

SEQ ID NO: 606684 - DNA, 151 bp, Homo sapiens
  misc_feature (81)..(81): n is a, c, g, or t
acacatgagggactggtactgaagggccaggcgctcccattgacgttggtgcatccctggctacccaagaaaaatggccgntcaatcaacctgcgaggtgcactcacactcgatggtcacctgagaccgcatggcgatgcctgggaaggca

SEQ ID NO: 606685 - DNA, 145 bp, Homo sapiens
acctagaggatccctattctaatcgtggtgtgtctatttgtaggatacactcgactctgtttattgaatttaatggtccctttctttgatggtgcttgcacggttttctaggtagaaattatttcacttattatacatgggtacc

SEQ ID NO: 606686 - DNA, 111 bp, Homo sapiens
agctgtcggtatccctgtgctggtgccacactgcctcatgcactgactgtttttaagtaagccgtgcaccattagtatgtcaattcttcctgctcttcttatccatcaaaa

SEQ ID NO: 606687 - DNA, 1159 bp, Homo sapiens
  misc_feature (154)..(154): n is a, c, g, or t
tgtatgtatgcatatatgatgtgctcgtgctctatagtgatgtgtactggtgtgtatatcgtctcttgctatgatgtctcattatgaatcatgtcgtgtgtagatgtatatgtcatgtgctttatcctatggtcgtgtgtgtaatgtatcctanatacttgtgttctctgtgtctcaggtctatgattgtgtttctgtgatatctgtgtgtgtcagtgtggtagtgttatcatgtgtgctcactatcatgtatgtttggtatagcatgttactgctgttatcgttgtcattatctatcgtgcctacttatttcagctgttctctgatgctactggccatatttgtgtttaagatgtatcttatgtctgtgatctggtgctattagtgaatctcaactgtgttgttcaatctctagagtgtactgtatgttgtagaataagtctgttgtgaaggttgtcattatctatttgtatagtgttactagcggatcgatatgtgtagtatctgcactgtcgtctaatcatcatcctggataaccggttgtcttaaggacagtggacgttctcgaccttccctcattccatgtccgaggttccggcatccaacgtcttgcctttctgcgtttcaagcaggactagcgtattgacttctatgaggacgcacgtccctcactctgctatcatttggcccagcggaccttcctcactttgtatttctacaagaaataccaagaaaccatgactccatccgttgttccttcttccagtgcgtctgggatactccgtcacctacatcttccaccagcttctggacatgcgggagcctgtgattgattttcggcggccgcccccttaccaccccaagcagaagcgcttcccccaccggcagcccctgcgctacctggaccggtacagggacagtcatgagcccacctatggcatctactaaggagccagagtgtgcgcatttcagagcatgggatttatcggcagcaagagtaaagacacagctccagagtgccacactttggggttctggtccctccttaagcagccccccttttttgccccctcccgttagagcccaggggttggagtgaaagttactttcaggtggtggggtggggaatgtgaataaacatgaattctttcccggaaaa

SEQ ID NO: 606688 - DNA, 414 bp, Homo sapiens
tgtacgaaggttacaaggattaagtaacactgttccaagtgtcgctaaaaaatgtttttaatgaattatgtggcaattccggggaatgttctcaaaatgaaatattcatactttattaaaagtaaattagtatgttggataagttgcgttgtttgctgtatatcttctgacgtggaaggctcacagtttaaaacacaattagtggtaaaatcgacacaggaaatgtccagtacagaaagtaccagccacagtaccctcataactccatctccttccccaggcatcactctttccagccacttcaatcctaaagcagtgagaccctcattttaacacacagagcctccctgcctaccctccttccctgtaacgtgagctactgtagtccatttattagttcttcggttatgcttc

SEQ ID NO: 606689 - DNA, 80 bp, Homo sapiens
ggagagaactagtctcagttttttttttttggtcccaagtgtctttttgtaagaggagaataaacaataaggaattactg

SEQ ID NO: 606690 - DNA, 139 bp, Homo sapiens
gtagcgtaggagacgcgtcacctacgcgtcgagaacgaacgtgtcttcacatgtttacaagatgaaataatagataaaagctatactccatctaaagatagagacatgcctcgaaattgggcacgcaaggggcaacccc

SEQ ID NO: 606691 - DNA, 354 bp, Homo sapiens
gagatagagtctagaggaaccatggctctaactgggtcaagtcctcctagctctgaatctaaggctgcagagctgtcctttggactgtagtctcttcatgctttccagagttagagccttgatcacggaacattattgtgtgcagaagaatactgtacctagtactaaagtctgttcatcttggatttttctttagctccatcagtccttccttgctaatctctaatcccctgaagcctaacacagttactaatgtgttatgccttaacctcttttatctttccacattggtgcttctggatggggctctctttacttactgcttaggcacatagtcaccttctgtggactacc

SEQ ID NO: 606692 - DNA, 656 bp, Homo sapiens
  misc_feature (33)..(33): n is a, c, g, or t
  misc_feature (51)..(51): n is a, c, g, or t
  misc_feature (97)..(97): n is a, c, g, or t
  misc_feature (131)..(131): n is a, c, g, or t
  misc_feature (185)..(185): n is a, c, g, or t
  misc_feature (207)..(207): n is a, c, g, or t
  misc_feature (223)..(223): n is a, c, g, or t
  misc_feature (232)..(232): n is a, c, g, or t
  misc_feature (238)..(238): n is a, c, g, or t
  misc_feature (247)..(247): n is a, c, g, or t
  misc_feature (268)..(268): n is a, c, g, or t
  misc_feature (302)..(302): n is a, c, g, or t
  misc_feature (321)..(321): n is a, c, g, or t
  misc_feature (324)..(324): n is a, c, g, or t
  misc_feature (591)..(592): n is a, c, g, or t
tgaggagctgctgcgacaggccactaccttgtncgagatgtgactcccgtntgtcccaaggcttcccagagcgaatcctgtgcggctgcaggctgcngtggcgttcgagtttccggcgtccggaaggaccngagctcttctcgcggatccagtgttccgtttccatgcccccaatcatcagagcnggagccgacagatatgcagggnaaccggcatggccaanagccgcggngactcnggcatcganctggggcacgcacctactccntgcgtgggggtgttccaacacggcaagggtggangatcatcgccaacgaccanggngaaccgtcaccacccccagctacgtggccttcacggacaccgagcggctcatcggggatgcggccaagaaccaggtggcgctgaacccgcagaacaccgtgtgtgacgcgaagcggctgatcggccgcaagttcggcgacccggtggtgcagtcggacatgaagcactggcctttccaggtgatcaacgacggagacaagcccaaggtgcaggtgagctacaagggggagaccaaggcattctaccccgaggagatctcgtccatgnngctgaccaaatgaaggaggtcggatagctgtaccaggctacccgggctcgcctatacgatcctc

SEQ ID NO: 606693 - DNA, 635 bp, Homo sapiens
  misc_feature (6)..(6): n is a, c, g, or t
  misc_feature (99)..(99): n is a, c, g, or t
  misc_feature (101)..(101): n is a, c, g, or t
  misc_feature (106)..(107): n is a, c, g, or t
  misc_feature (179)..(179): n is a, c, g, or t
  misc_feature (188)..(188): n is a, c, g, or t
  misc_feature (196)..(196): n is a, c, g, or t
  misc_feature (210)..(210): n is a, c, g, or t
  misc_feature (223)..(223): n is a, c, g, or t
  misc_feature (226)..(226): n is a, c, g, or t
  misc_feature (228)..(228): n is a, c, g, or t
  misc_feature (406)..(406): n is a, c, g, or t
  misc_feature (425)..(426): n is a, c, g, or t
  misc_feature (441)..(441): n is a, c, g, or t
  misc_feature (456)..(456): n is a, c, g, or t
  misc_feature (464)..(464): n is a, c, g, or t
  misc_feature (468)..(468): n is a, c, g, or t
  misc_feature (484)..(484): n is a, c, g, or t
  misc_feature (494)..(494): n is a, c, g, or t
  misc_feature (569)..(569): n is a, c, g, or t
  misc_feature (627)..(627): n is a, c, g, or t
tggtgnatgggataaaaaggggttctaaaacactattactagatcatccaaaccctacaaaagacacttatgcatcaaaattcttgaaaaaggaccaantncctannccctccaccctcccctcaaaatacccatgttcataaagaacaaaaccttatcagcttaatccaataaaaaangtgtcatanaataattntaaggcaatggttntatgaagacaggngangnagcaggctgaaccgcattcactgaccctatctctcagctgctcctcctcactagtcaggtttttcctgtgtaccccacttcattatttccatcatgcttacctctctgtttactggacattccccttgatctaataccaaacttagccagtctaactgtaactcagatgttaatctgnccacttcctggttagaacnnatggttgttgttgtnacagtgattatttantactattntganttattttaacaatganttactttttntcccatccaggcatgaagaagttaaaacctggaactcactgaccctgtgttataatttagtgctaaatgtaagcnacaacactggagcattgttattttatcaagacacctgaacatagcaaaattaattttnttcatttt

SEQ ID NO: 606694 - DNA, 501 bp, Homo sapiens
  misc_feature (110)..(110): n is a, c, g, or t
  misc_feature (221)..(221): n is a, c, g, or t
  misc_feature (224)..(224): n is a, c, g, or t
  misc_feature (233)..(233): n is a, c, g, or t
  misc_feature (285)..(285): n is a, c, g, or t
  misc_feature (361)..(362): n is a, c, g, or t
  misc_feature (378)..(378): n is a, c, g, or t
  misc_feature (382)..(382): n is a, c, g, or t
  misc_feature (384)..(384): n is a, c, g, or t
  misc_feature (409)..(409): n is a, c, g, or t
  misc_feature (436)..(437): n is a, c, g, or t
  misc_feature (451)..(451): n is a, c, g, or t
  misc_feature (484)..(484): n is a, c, g, or t
tacccctgtaccccagtaacttatggaaaaaaatgaatgacagcagagtcctcatcagaaccaatattcctcctgaacatagatagaactaaacaagattttgacaaatnaactctaacaacaaattacatagataatatgttatgactaaatgggttatcccaggtgtggagggttgatttaatgtttgaaaatcaatgaactaaaatagaccacctcantanacagaaaanttatttggcaaaatccaacacccatttctgataaaaactctcagcaaactgngaatagaaggaaacttcttaccctgataagggcatatatgaaaaaacctcagctaacatcatattgactgaatggnntgctcttaagaatagngacnangacaaaggtggctgctctctttacnacacctgggccggattttttttaactnntttaatttcagtanggctaagttggtcatctactgggatttcttaancctaattttgcctcttg

SEQ ID NO: 606695 - DNA, 318 bp, Homo sapiens
acatatctctccgacacattctcactttccattaatcatctctaaagggggtaaacaaggaaacctgctgggtgaaaacaggctgttggcaattcctgagatcatgtgacccattctctaaagactagactatttaacttaaatcagtgagaaactctgtgcagtagtgtccttgtatataccaaaacttcatgtgccttctcctgaacctgcaagctgtgggcaggtctgggggcagaggccgcatacaccgaccttacgtccaacctcagtgactgcctggagcaagagacctgaggtatggggacaaaaaggagg

SEQ ID NO: 606696 - DNA, 453 bp, Homo sapiens
gcagtggctcacacctgtaatcccagcactttggggaggcccgaggcaggaggattgcttgagcccaggagtttgacaccagccatagtgagaccctgtctctacaaaaaaatttaaaagttagccaggcatggtggtgcacacttgtaatcccagctgctcaggaggctgagataggaggattgcttgaacctgggaggtcaaggctgcagtgagccatgatcacaccactgcactccagcctgggcgacagagcatgaccctctctcaaaaaaattttaaaagttagaaaatatatttctatagtgcaataacaaagtgatttgtgcagggaaaactaaaaattctggagacattttttaagctcagcagtatttgcataaagaaatatttataatgtgaaaacaaagtacttcatttaattttgaaagatgtattaagcaaaaaaaaaaa

SEQ ID NO: 606697 - DNA, 1255 bp, Homo sapiens
  misc_feature (356)..(356): n is a, c, g, or t
  misc_feature (428)..(428): n is a, c, g, or t
  misc_feature (500)..(500): n is a, c, g, or t
gggcagcggaggcagcgcgctcgtcttctgcgggctctcgtggtggccctctccttttcgtttgccggaaacagtggcctccagtgtgtggtgtgtctctgagtggtgtcatctacaggtgttcaagccgacgatgaagaggtggcagtaacgtctgcaagcgccaagaaggaggtcgaagaaagcgcagacgaagggcgggcgctctttcgtgccatgagtgacggacctaagaagaacagtctattctcgctggacggatgggcagagggacgatccttggggtgggggcgagtgctgggctcgagatcgtgctcgacggaatctcgcgtcacgccgacgcgttctgtgcgagngattggcttgctcagtactagacggtactagccgcgtagtgacctcttctactgatgtgcaatccctagtgnagtatccagacggaaggagccataggacacgcgacggactcgtggggtggatccgatccttttcgttggggntcgccccgtagggtctgggcgaacccctcttctaagggaaggcaagacactagtattgtgagtgccagccctcgccaaggaagcgccactcgaatgacacgaagcatgaccagggtgctcgacatgcactgaagtttgctagacgctagagacgttgcttacgaggggagggtccagacggtaactcgcctagcgaaccgcttgggcgagacgagaggcatggggcggggtcagatggccgatcagtctgcccctgggaaggggcaaatgccttttggtgaagcccccctgtcttgggggccccctgaccctgggaggccatctggggaagacccctagacctgccgcttggggggttgcaaggcctggacccactgtcctggccaggaccgggagggggctggggggggatccccagcagggtggtgaggggccaattccccttcatccccgagattggccaaactgaaccactcgaaaccccctggattttgctttcttccgttccattcccttggcacgttctgggcctttcgcaaagctggggtttggatcttttggattccctcttgtgggcttgaagctgaccaaggtttccccccagggcacccccaggtgtggggggagggcctgccattcttgtagacagagattccccattttctcaagtggtcttccccttccagtgtggagacttctatacggcaaatagacttctggcgtgctcgatatgcctgggtaatgacaggtggttc

SEQ ID NO: 606698 - DNA, 328 bp, Homo sapiens
cgtcgattgatggtacacagtcttactgcggctctacaccctcagtctgtggagaccgacgcctcaccatagttcaggctcaatggaaacacaggtttccccggagtaccacaaaaccaggcctcagtgagaaatctaccactttctacagtagccccagatcaccagacacaacacacttacctgcccgcatgacaagctcaggcgtcagtgaagaatccaccacctcccacagccgaccaggctcaacacacacaacagcattccctggcagtaccaccatgccaggcctcagtcaggaatctacagcttcccacagcagcccagg

SEQ ID NO: 606699 - DNA, 411 bp, Homo sapiens
  misc_feature (30)..(30): n is a, c, g, or t
  misc_feature (57)..(57): n is a, c, g, or t
  misc_feature (86)..(86): n is a, c, g, or t
  misc_feature (399)..(399): n is a, c, g, or t
  misc_feature (402)..(402): n is a, c, g, or t
  misc_feature (405)..(405): n is a, c, g, or t
ctgaagattaacaggtgtgcaaccaaccangccccaagttaaatttttgcccttttnaagtgaaagacagggtctcgctatattgncccaggctgatcaactcccagcctcaattgatccacctgcctcagcctccccaaagtgcctaggattacaggcatgagccacccacgccctggcctcttttttcaatttctttttttgagacggggttggggggggtctcactctgtcacccatgctggagtacagtggcacgatctcagttcactgcaacctccgcctcctgggaccaagcaatcctcccacctacaggcacaccacacccggctaatttttgtattttttgtagagacacgagggttttaccacattgcccaggctggctgcaatccaatnttnatnagcacg

SEQ ID NO: 606700 - DNA, 407 bp, Homo sapiens
tatactgccccttctttccatctctgccccctgcatctgtagacaaatgcttaagtcagcaccgactcagccaggatggcagttacccaaggccacgccgcgccactgcttctctccctctcgtctgctgtgtctccctccctcccgtgcatctgtgagttcttcccagttctgcccacattcagtctccctgtttgcacttgtctgtggccagtctcctggaagagctacagggaactcatcctgcccccgctctttcccctcatcctgtcttcatccttcccatgccacgaaccccttgctctgtgggaacgccggcggctcacccgcgcaccccacctccttcccctcatcctgtcttcatccttcccacgccacaaaccccttgctctgtgggaatgcggccg

SEQ ID NO: 606701 - DNA, 756 bp, Homo sapiens
  misc_feature (697)..(697): n is a, c, g, or t
tgaagatctacacgttcaacaaagaccacgaccgggtgaagctgggtgtggacacctatttggcaagtacctggacaacatccacctgcaccccgaggagtgagcaagtaccggaagcatcaagctgcataacaaggtgtttcatgagcgcattaactgcctggaagggacccacgagttttttgaggccattgggttccttaaggtgttgcttcccggccagtgatcaggatggatccccgtacgtgagttctatgttgcttgagcagaagaccacctttggcccagtccccagtagtcctggagaggcacaaggaacagtctgctggcttgcgtgagtcccgtgcgcgccaagctggactaggcagtcgcctgctgtcttccagccctcgcccctggcctcgcatgttcgaactgccttggggttacttcgttcaagcctctacagtcgagagagagatcagagcgggcagcacgacggcgtcatggtccagaggctggtgcgaggcgcgctgacggtcgtgcttgcggagccaaggtcccgattgcgcggcagagaggcacggagctcagcgggggccatgtcgccagagtaccgacttacaacgcattgcttcgcgcggttgctgccatcccgccgtactggacttgcgcgtccgtgccagcggccatctcattcttagccggctactggcgnagccggggccttggtggggcggagtgttaccgcgtgttccgttcccgtgcgagggcccc

SEQ ID NO: 606702 - DNA, 540 bp, Homo sapiens
acacctcctctcttaaactctagttactgaatcgcactttgtcttttccaaaacataatattctgagctcagcagacacttccttatgcgctgttacgcatggtagcgttgctggaattacagtaagaattatcatctgccaggagccagttcaacccatttctgatataaaaagccattttagtactttgggaggcagaggtgagtggattacctgaggtcaggagttcgagaccagcctggaccaacagggtgaaaccttgtctctactaaacatataaaaattaggcttggtggcgcacacctgtattctcagctactcattaggctgaggcacaaggatcacttgaatctgggaggcggaggttgcagtgacccaagatcaccctagcctgggtgacagtgtgagactcaaaaaaaaaagaaaaaaatgaacttttacctcgagagctccaggaagccttgaaagagttttaaggagattgaactgatggggatcattacttggtagttgagcgtaaagtgctcaggggaaggtgg

SEQ ID NO: 606703 - DNA, 418 bp, Homo sapiens
gagacagcctgggcatcagcacgatcccgtctctacagaaaatacaaaagttagctgggcatggatggtgcatgcctgcaggcggagctgcttgggaggctgaggtgggagggtcgaaggaagggcggaagggaagacgggaaagaaaagaaagaaagagagagagagggaggaaggaaggaaggccacgggaaagacggcaggaagggcggaaggaaggaagaaagcaaagaaagaacgggaaagagagacagcagaaagaaaaggaaagaaaaaaaagcaacgaaaggaagcgagcagcggttcttaaagtgtggctcagggcccccaagagaccctttccaggagcatctcgtgatttcacatggctttttcactctccataagtgtacaatggggcacacattatggcaggggg

SEQ ID NO: 606704 - DNA, 805 bp, Homo sapiens
aactcattatgaactacataggtgtggctctgagctatgatatcaattggcttcctacgagttgtcagcgtgtgagcacaccatgatatttggcagataaggcaattggagatgtacgaccacatgagcatatttcgagctccgctagccgatgatatctaatacggcatatcccccaccggcgtcaagagtgatctaaagaccttgacatcgtatacactcgcacgtgcacagacacgatgaccgatgatctagttgccagtgcctgctggatgccctaggattcatctttcttttcaccgtagggtggcctgactggcatggtattagcaaactcatcactagacatcgtactacacgacacgtacctacgtggtagctcacttcccactaatgtcctatcaataggagctgtattgccatcataggaggcttcattcactgatttcccctattctcaggctacacctagaccaaacctagccaaaatccatttcactatcatattcatcgggttaaatctaactttcttcccacaacattctcggcctatccggaatgcccgagtactcggactaccccgatgcatacacacatgaaacatcctatcatctgtaggctcattcattttctctaaacagcagtaatataatactttcatgattgagaagcttcgttcgaagcgaaaagtctaatagtagaagaacctcaaaactggagtgctattgatgcccactacaatttgagaccgtaataattagaaaaggaggatggacccaagggtttaggacccgtggtcatgtag

SEQ ID NO: 606705 - DNA, 469 bp, Homo sapiens
tggctgctgtatagagttttgacagttataacactgtctaaaccacggcagtctgcgattctgtttctggttgtgcggaatatgcagccacagacacagatcgaatgtgtgatcttgtcctaatctactttatccacctgtaaaaggaagacgattggaattatccgaaggagactgactctgtcctcctccatctgtaaagatgcttaacaatcattttctccaaatcaaccacctaaacacattacaagacaatgtttagcttctggctttcagaaacccaatggtaagggtcagtttagttctggcacaaagactgctgtgtgccaccctaaacgtacctcatcttgcgaagtttcttgggtaagccggggttagcactgatttggcatatcgccattatagaaagtatccagggccagacattacacacctgggttctgactttggcacaggcctcagaaagcct

SEQ ID NO: 606706 - DNA, 415 bp, Homo sapiens
gtaccactacactccagcctggcaacagagctagactctgtctcaaaaaaaaaaaaaaaaaaaaaaaaaaaaatttttcgggcgcggccttgggccctcggaaaaacgtttttaaacccttccggtgggcgcgcgcgcgcgggcgcccaagtatggtgaacgtgtggacactggggccatataacgcgtgtgttcccttaagggggctacccggggccttggcattatggtgcgttggggtcttctctccccatattaaaacaacgcgcccgggggggaacccgagggcgtgctgtggaaaaactcccaagaatgggggggtccaggagggcgctcttaagggggcttcattctaacacgggaggtctccaagccggaggcccgagatttcaattttaccccccgtctggggggc

SEQ ID NO: 606707 - DNA, 138 bp, Homo sapiens
ttgcacgtcgggggggtgtgcccagctctgaaggtgtctggatcagtcggggaggggtgctcagctctgaccatgtctggatacagtcggtgggggggtgccctagctctaaccatgtctggatgcgtcaagggggtg

SEQ ID NO: 606708 - DNA, 107 bp, Homo sapiens
gactgacctgctccagtccagatctccatccgctccgtgcccatggagcgggaacatgccaatgtctgaatccagccagagggaaggtcgctggagagggtgagaat

SEQ ID NO: 606709 - DNA, 208 bp, Homo sapiens
tcacgcgatctcctgcctcagactcccgagtagctagggattacaggcacacacacaccacgccacggctacaatttatatatgtgtctttttagtagagaaggagttacgctatgttggccagactggtcttgaactgctgacctcgtgatccgcccgcctcggactctcaaagtgctgggattctgtgtgtaatgtgcacctccac

SEQ ID NO: 606710 - DNA, 913 bp, Homo sapiens
tccctccccccgaaaaaggggggtttggcccccgaaaaagggggtggccctttttcctttgtgggtttttttccccccttttggttcatctttattactttaatttcacacaatgttcaaaaaagggcctggggggaagcggacgagtgggggacgctcggacacccgcgtggagtgtgggggtgcgtctatgagggggaacccgcgctgtgtacaagcaagaacaaaaagatgacagggtgggccctccttccatgaaaagccagtgacgcgtgtttctcccgcggaatttccgcgccccagaaggaaaaaaaagcacgaaggcatcacatattatctagcgggcgacacggaggggcgtggaagtgagagtggtgcgcaccccaacattagaggggacaccgcttatcccccgggagaaaatatggggcgaacgtatggcgaggacccaaaaccacagaaggggcatggcgccccaccactacataaccccgccataaccctgtggagcgaacaccagggagtggtctacgcgtcctgtgggcatcaaaggggacaagcgctatgagcgcggaataacttcacaaacaaggtggtataatccccccagcgaccgaacagcccagcccgcggggttgattaccccacccccgcgggttatgtggagaaaaatatacacgaccatcgggattaagaaggacaaaccgctgcggaaccacaacacaagaacagaccaaacacaaccaacaagagatggggacgcgcggcacaaaacgagacacgatgaacaggcgacagacaagatgagcgccgacgacgacatagtatggaaaacgcggcccccaacagggaggagatatcaataaacgcaacaagtagacggcttaataacagtcggaggaaggaaaaagag

SEQ ID NO: 606711 - DNA, 110 bp, Homo sapiens
cctgtggtgcattggtgtgtgtgtgtgtgtgtgttggcaagggtattgtggcggtgcagtgggtcatgctgtctccgctcatggacgcgagcaggttgctcacgtgcatc

SEQ ID NO: 606712 - DNA, 102 bp, Homo sapiens
gtgtgctggacttacggccttcctaagtgagtctttggaagtcctttgactgaacgataaccacctcgcacacagtccctaccctcgcgtttgcctcactga

SEQ ID NO: 606713 - DNA, 407 bp, Homo sapiens
ccctatatcgggtgtcttactgtgccaaaacataaatcttagaagcaagtagacccttcataactatcattgaagctgctgaagtagtgtttaggatcctccatggcagttagtgaatgtagaagtacagtgttaaagtgttgtaaacagttactcagtgcaatgtatagcctgagtctatccataatggctatatccaatttgacatcacgttatggatcagtacacaatgaaaaaccaaagaaccacagtatatcttattcttaactttggtaaaccatgtataatgggtaactttttagttttcccaaaaggctgataaatttcaatattttgaatacttcattgttaattttgagtaggcagaggtaaactaaccaattaccataatgtttaagtactaagga

SEQ ID NO: 606714 - DNA, 154 bp, Homo sapiens
tatttatatctggaagtgatatcatattacaactgatagatgctcaaccacgtacaaatataactcaactgtgtgctgcttacagtcagtcctccaatctgactcacctggtggagacactttcgggctttgtcatattcgctcctcaggcagt

SEQ ID NO: 606715 - DNA, 843 bp, Homo sapiens
tttagtatgaaagttttcaagacgcctacaagtggaaaatgcactcctcccagccaaatcaagcttcgccagattccttacagctgtgtgcagtgaaatgactaatgaaagagccctctgctgctggtggaactttcacatatggcactgttatgccactcagcaggacccgaccctggtatttacatattggatgtcaccccaaaagcccctgaccagggggtttccgggatgtaataagaatgccactctgggctttggaaggtgcaccgtatgcacacccatactatagggcaggggttagcatttcagacccctgttcctcccttgacaagcaagtgcttttctccagggaagacgttcaggttcattcatagatccattggtgccgtgggcagctcagtaacaatagctctgctgcctaccagctgctggtggaggtgttgagaatacctaatgaggaagtcagggcccctgcgtgcttcagcagagctggatgcctggcatggcaatcaatggacacaaacctttggataatttccgtccttggcggtgtgttctatagcataggtatgaagtgggtgctctgggagctcagaagaggggcttttctcttaacttatgggtggccagggaaggcttcctggagctcaaatgactgagtggagtcttcaacattaaaaaaaaaaaaagaaaaaaaaagtgcttccctcccacccccagttaaaaaggtaatacacctcattgaaataatttaaactttacagaaatgtgttcctttaaagttcagagagtaaagaggaagtaataaagctgaaatagtagaatttctaaaaaaaaaaa

SEQ ID NO: 606716 - DNA, 606 bp, Homo sapiens
  misc_feature (1)..(1): n is a, c, g, or t
  misc_feature (236)..(236): n is a, c, g, or t
  misc_feature (244)..(244): n is a, c, g, or t
  misc_feature (332)..(332): n is a, c, g, or t
nagcttaatgtcagtgtcgagtaaaagcagtaatccatctcatatctgatctcatcagctatgctcactgatcactctcactctcatcagctctcgcctttccatgctgatactctgctcagtttgagagatgagactcatgactcataattctatttcccattgaatttatctgatcttctacctcctctattcacagaagatgtcccttagccttcaacttgtgccctacttanagtatttntagtgaagtgcaaagagcatttgctctatatagaatgcctctgtaacagtattgtacctggttgagcacacctgcaatatcatcatcnctgataattccttaccatatcttttctatgtttaggtttgttagatatacatatacttaccattgtgttacaactgcctatgtaacctaggagcaacagactataccaggggtccccaacccctgggccacagactggtacctttgtggcctgttagaaaccaggccagacagcaggaggtgagaagccagagagtgaagcttcatctgtatttacaaccacttcctatcacttgcattaccacctgagctcagcctcctgtcagatcagtggc

SEQ ID NO: 606717 - DNA, 175 bp, Homo sapiens
ggaaggctaaaacgcggtagctaaactgcagccaactttggttgtgtgtggaaaaggctttagccatggacaggagttgctttggagagatatcatcccctgttaatccgggaggcagaggttacaaggacttcacggaaacaagttcttaggaaaagagttttacttcaggcat

SEQ ID NO: 606718 - DNA, 800 bp, Homo sapiens
aactgaataccactctgtaattgcaaaaaaaaaaaaaaaaggttgccgctgtttggtggactttctgaatgcttctaagtaaatacaatttttttataagtatggtggcccttttcataggtctgaaattttctcttctggaggggaagctagctctttggctttggcccatttggaatccacttgatttatcacggtgtttatccttccatatagtagctaataaaaagctttggtctacacaccctgcatatcataaggggggtaacgtcagtggagatagtttcatccattaattggaacttccaaaattcttgatcaagttaagaaattttcacattagcccatttacttttaccaaccggaagagtaatcaatctactcaaagctgtgggattataagaaatcaaccttttggaaaggtctgtccttgagggactaattagaacaccgtttgttctacccttatacatgagggactctattcttaaactcccattaccattgtatgccagtaatatttggcagtcccacattaaagaagacctgagattgtattccccaaaagcgtgagcttaaaatacaagacttgccatattaaatttttggttcgacatagctctcagagacggctatgaaaatgcgtggctatagatgtctttccccattttatcctaaacttttggactggctccaggaaaccgagacttcgccattaacaggtattttcaattaaatgtgcgccagccttttacaaacacaaagatgcccattctcacaatagcggtaaatttcctata

SEQ ID NO: 606719 - DNA, 551 bp, Homo sapiens
gaatatagtcagccccaagactgccgggctgcgtgagccttcagggaaaggccgagctgcgccgcctgctgaccaaggtgctgcagtgagagtggatggcttgcggatgagtgcacaggccgagcagtcctgtgagaagactcgctcctagacctcacgcagccaggataaggaggacatatgccatgtgtggtcacaagagttagggcgatcgattgggctagatatgttagcgacacaccacacgtgagctcgccctagcgggtctccaggggtgccctagcgcgtctagaaacagtgagggctagagtgcgaagccccgtccgggatttatacaactcaaaccattcgggcagatgtatgcactcacccaaggccgagttcccataattggggttggtggtgtgagcagcgggcaggacgcgctggagaagatccgggcaggtgcctccctggtgcagctgtacacggacctcaccttctgggggccacccgttgtgggcccagtcaagcgggaactggaggcccttctgagcgagcagggctttggc

SEQ ID NO: 606720 - DNA, 150 bp, Homo sapiens
atacacctgcttacagtatcacgaagtgttctggaactgaaccagatgtgagccttcaaaagcagtgcaattggctcagtattcacagggaaagctgtgagggaagcgaaatgtggtgattttaaagctgttaatagtggtggtatcacg

SEQ ID NO: 606721 - DNA, 937 bp, Homo sapiens
  misc_feature (17)..(18): n is a, c, g, or t
aggtgacagaatctggnncacacacgctagtgcgcctcgatatgtccgttgaacgccgtttttacgatacggatatatcctcctgggtatacctatgtgggggccaccgcgggaatgtccacaatggcgcgaaactgttcaaggcgttgtgaaacttgacccgagggtttcacgtgctttcacataggaagttaagaaactcttgttggtggttttttttagcccctttcctgaatagcaggcgtgctctctaatctatggagatcggccccgcgccccagtgtttcgttcctccctcagtggtaggcctctgttttctacaggcttcccccacaatattagatcttctttggggagaataaatcgttttgaaggggttaaatcattcttaaactcacgggtttcggggacactttatcttgttaaagaccggggaagaatttcggtgttgaaccaaccaaacaagggttgaaaaaacgtaccttctgctggtatcaaggagtgctactgctgctctcaccagcccacggcttgccatggctaaaacaagtgcagggaccccgcgctggtttaagttaagtccccggagtggagccaaaatgactatagcggcgcccccatattcggtattcattctcctgggcgcggcgcatttacgtggccctcctccttatgtagttgttttagtcccaaacacatgttcctgccgcccctgggcctaaaatggctacaaatactgtctctgccccacgcaaccaaagtttgagcaatttcgccctgcagagtctggcgctgtggtgataacaaaagcctctgtgacgccgccgtggcattataaatgaaagaaagacggtcgggtgaagcacttcttggacgccaccgatttgccaggccatcccgcccggaccaccgggcaaccccttcttgggacaaaaca

SEQ ID NO: 606722 - DNA, 878 bp, Homo sapiens
  misc_feature (394)..(394): n is a, c, g, or t
ggatggaaactcagaactggcataccgtgtgagtcctactgaccccgtgactacacactgtggcagccgcgagggtgtccatggacacaatgcgaagctgcctggttgtgtgcctgccttgctttggactcctgtactcattctggacggctagtgatgggggtcgctcctgcctgaagtagatgctagaatggctaggaccccctgaaccgtgaagagtggcagcggatcacgtgcgcctgactatgacgtcagccacggaagggcgctactgtgcgaagtgagcgcatctgacttgatagggaatcccttgtatagcttgtgcggctggatacacgagagtctcctcaatagcctggactctagatgagcagacagtgacaccgttgtggtncgctccggtggctgtccaatggctgagcacgacagcaagctcaagcgggcggttggcgcagtagctggtaggagttagcccttgatatcgttggcaaggggcgcaaaccgactgacatctcaggcctggctcaaacgatcgagtaagaggaagaatacatgctccaatggggtctgttagagctctatggagaagatcggtggtgctccgatgaaatatcctggagggatcgcatcgtcatgatgctgtgctggcctagttgggacgtgcttggattgtactgtcgtagtgggggtaatcgacggtaggctccagccgtcaactccatcgagaagtacaacccgagggaccaacaagtgggtggcgcatctgcatgttcaccgggcagcagtgtggggtgtgggggtctggaagctgctcaaatttcccggcgcatcctccccgaagctggtcggtgtctccaacaggctttgaccactacaaa

SEQ ID NO: 606723 - DNA, 137 bp, Homo sapiens
ccctacaatcttccttacccccaggcatacctcctgtcaccccgaggtgttcctcagattgtagtcacttttgacattgatgccaatgagtatcctcagatgtctctgactgtgtgacaatgagtacgcggaaaaga

SEQ ID NO: 606724 - DNA, 132 bp, Homo sapiens
gtctcatcttctggaatcccacgtagttttactcactagtcttacactagattctcagacacaagtgattctcctgacctcagcgcgtcccgagtagctagggattacagggcgcctgccaccacgcctggc

SEQ ID NO: 606725 - DNA, 140 bp, Homo sapiens
cactccgaggatcccttagcgctcagtgtacctgtgtcgtaggcatccagacgtgacgggcaccggatgtcacctctgccatctgagcgtggtcccggctcagctcccacagagagctgtggcgggttttgtgcagcgga

SEQ ID NO: 606726 - DNA, 818 bp, Homo sapiens
ggacgttgtgcgatctccatcagctgtatagtaatactcgtgcgttggaataaggagtagtcgttccttgtggtgctgtgcttctctcctccagcgggcaagtattgggtggtgtcgtccatcgttcctctcccggcagccagtggaggccgcgcgtgcgatatatctcctccggcaatccagaagtaattcttttctttttcccttgaagcgaaccacgcatcttgtggtggcagaaggaggacaaaaattcttcctccttgtttgtgcataagataagaggaaaaaactagtacggcggtggtttcgagactacaaccactaccatgtgggggtgccactaaaagagacttttgttccacgctcatatttgttgcctggacactagtctattgcgtgtgtgacaccccagctgcccagaggacactgctctggggagccttcgtccccctcgttttcattgaatatgactcgagagcctagggtgagacttctattcccccgccaccgccttgtgtgtccagacaaatatatgtgtgtcgcccagctgcgcgtttctcttctgccacacggatattttcattcgtgcccacaaagccccgcgcttatgttgttttcatatacaagaggggactcaccccccactggtctcagtgcgtagtacatagaacatttcgttggagaacgggtcctgcgacaacgtgagaatatggagagacacgggcggtcgagaccactggaagtatcggggggaccacgacgaaacataacacaccgctggaaccggaatccccccatttaaaaaaacacacaaaaca

SEQ ID NO: 606727 - DNA, 334 bp, Homo sapiens
  misc_feature (51)..(51): n is a, c, g, or t
  misc_feature (91)..(91): n is a, c, g, or t
  misc_feature (116)..(117): n is a, c, g, or t
  misc_feature (142)..(142): n is a, c, g, or t
  misc_feature (144)..(144): n is a, c, g, or t
  misc_feature (153)..(153): n is a, c, g, or t
  misc_feature (166)..(166): n is a, c, g, or t
  misc_feature (191)..(191): n is a, c, g, or t
  misc_feature (193)..(194): n is a, c, g, or t
  misc_feature (226)..(226): n is a, c, g, or t
  misc_feature (243)..(243): n is a, c, g, or t
  misc_feature (272)..(272): n is a, c, g, or t
  misc_feature (306)..(306): n is a, c, g, or t
tcccctcctccgccccagcgcgcgcagcggcgcgcggaaacgcaggcaagnagtaataggcgggtggggcaggcggggcagggcaggcagnacagaaggtggaggcagccaccccnnggcggggatgaggaagcggcgccanangtggagggnaaagcaaggcggngcgccagcaagggcggaggaggccngnnggccaaacccgaccgggagcgcaagggaagangatgaacgatgtaaccnatgtgccacggccacggggaggagaaaancgaacagcaggggggcgcaaaggaaagagggaanaacaaaatagacctacaaacggggccgg

SEQ ID NO: 606728 - DNA, 360 bp, Homo sapiens
ggaacaagtccacggggtccctgcaggccaacgtgcagcggctgaaggggtaccgctccaaaatcatccttttccccaggaagccctcggcccccaagaagggagacagttttgttgaagaactgaaactggccccccagctggccggaccggttttgcccgtccggaacgtttttaagaaggggaaagctcgggtcatcactggggaagggaagaatttcaaagccttcgctagtttccgtttggcccgtgccaacgcccggcttttcggcatacgggcaaaaagggccaaggaacccgccgaaccgggttttgaaaagaaaaaataaagccctcctggggacttggaatccgtcggca

SEQ ID NO: 606729 - DNA, 917 bp, Homo sapiens
ttgacttgatagtgatgctggttagcttcggtcgtcttcatgtatgcctaaataggaacaggaggagaattatgagtgatagttccagtgtggcgaatctacggaggacacatgttgtcagagcccatgtttgatgacgcgataagcaagattcgtgtaagagaataactggaagatgtattccattgtcaagaagagtacgagtatcagctagccacgagatcaagctgagagggtgcaactctcatggaatgacacctcaggaaaaagaggaacagaagtaagtgttctcagagctcctgattctttctatgtaacattgcgatgaacagcttgaaaaacatgttctgtctgcataaaattatttgactgtaagttttccccaatggttctgtgcatcgttgtgcctttttaaattacatctccaaggtggctcaaaaggccttgacacagggacacctgcgacatatccaggatatgtgtaaccagcgatggtgacttgagcttgccaagacctgtgattccttgccaggatacaatcgagtgagaaataaagaacacatctggggaagtgggaatcctggagtttatgccattgcaatattgaaaacacatcgacagtgccagttattattgcaaataataaacttcctgtcgtcatcgtattctgtggaggtgataaagtgtcagatcaagtaacagattaattgttgttaacagctcttttgttgaatagtttgtggaaacaaagagtcttggtgcccaaaaggggtggcggggaacaattgttgcgcaagggaaattccgccccggggttagaggaattctcctggacaagctccggaatttttgtaaagcctataaaaggcttgggttgcaacattgtggaaagagcgttaaggaggagagaaggggga

SEQ ID NO: 606730 - DNA, 289 bp, Homo sapiens
taagacatgggcgggggatgttggccaggctgggctcaaactcctggcctcaagtgctcgtcctggcttggcctcccaaagtaatgggattataggcatgagccatgggcccatttaactcttgagtctttcttttgtcgtggatgccgatggcctgtggctgaacaagaatctggatttttaggaaccagtgacctttgaagatgtaacactgggttttaccccggaagagtggggactgctggacctcaaacagaagtccctgtgcaggggagtactgcaggaagag

SEQ ID NO: 606731 - DNA, 210 bp, Homo sapiens
  misc_feature (164)..(164): n is a, c, g, or t
  misc_feature (172)..(172): n is a, c, g, or t
ctataatgtgctagtgttagtagatattttctaagatatcactggaatttctgaaatgagaggccttgcagtgcctagtaaaatgacatgttggcattgcaagttgctttcacttcgtggctctacggtgatacggcattcatttggagtaaagacttatgctnttgctatntaaaggctttgtatactttttttggagagtctccgtcg

SEQ ID NO: 606732 - DNA, 100 bp, Homo sapiens
caatggactgacgtgactggtggctcacttgtgcccactgccggcaacaccagtgccaggaaaaggccaagggaatgtctgtttctaacaaatccacaaa

SEQ ID NO: 606733 - DNA, 189 bp, Homo sapiens
tggcaaattagcgacggacgggctgaagattttcttactattccctaagcaaaagtgtgccttacgttaggaatgtttatttatttgcgtatgcctttctatccactgtaagccctatgcatcttgcatctacggtggtcttatttaaatttaaagctgatgattgtgttgcttctatataatatagcg

SEQ ID NO: 606734 - DNA, 229 bp, Homo sapiens
  misc_feature (34)..(34): n is a, c, g, or t
  misc_feature (38)..(38): n is a, c, g, or t
  misc_feature (51)..(51): n is a, c, g, or t
  misc_feature (88)..(88): n is a, c, g, or t
  misc_feature (97)..(97): n is a, c, g, or t
  misc_feature (210)..(210): n is a, c, g, or t
gatcctgaagagcgctgagggacgggtgcttcgncgancagcaccagcganacgtcaaactcatgagacagatgctaatggatgccgncctccctanttgtccactgccccagccacatcatccctgtgcgggttgcagatgctgctaaaaacacagaagtctgtggatgagctaatgagcagccataacatctacgtgcaagcaatcanttaccctacggtgccccgg

SEQ ID NO: 606735 - DNA, 131 bp, Homo sapiens
gcggcatcctcttcaacagtgggagggggcagtgaccatggagtgttgggggcagcctgggaacacctccgcttaataggctgtggttagagacgaagagggactcgcatgtgcagacagccccagacctg

SEQ ID NO: 606736 - DNA, 678 bp, Homo sapiens
  misc_feature (394)..(394): n is a, c, g, or t
  misc_feature (485)..(485): n is a, c, g, or t
  misc_feature (556)..(556): n is a, c, g, or t
  misc_feature (559)..(559): n is a, c, g, or t
  misc_feature (574)..(575): n is a, c, g, or t
  misc_feature (589)..(589): n is a, c, g, or t
attaacatctgagatagtttcttatgcccctttctagtcattcccctttcacctgcctgcctccccgcgagaaaacactgttctgaagttccttaaaactgtaggtttagttttgctgattctagaatttcatataaatggaaacactcaatatgtataaaaggcttctttcattaagcatagtgtgtttggtatttatctatgttgttgcatgtagcagtcgttctttccttttcattgctacatacactgtatgaatataccatgtgaatatactatagtttattttaccattcactgtttgatggacacttgggctgtttttcgtttttggctattataaataaagctttcatagatatttttgtacaaatttcacgtagacatgtgctanttctttctcttgggtaaatacttaagagtggaattatatgtttagttttcaaagaaacttccataacttttttcaatgtggttgtaccatntttatattcctatcaacaatgtgtgagagttgcagttgggctacatccttgctaacattcaatggtgtatnttntcactttttgccatnngggatgagtgtgtngggtatctcatggtttttaatttggaattttttgatggtaattatttgactttttatgtgattatcgggctttatctgctttgtgagta

SEQ ID NO: 606737 - DNA, 895 bp, Homo sapiens
  misc_feature (34)..(34): n is a, c, g, or t
  misc_feature (90)..(90): n is a, c, g, or t
  misc_feature (97)..(97): n is a, c, g, or t
  misc_feature (113)..(113): n is a, c, g, or t
  misc_feature (117)..(117): n is a, c, g, or t
  misc_feature (119)..(119): n is a, c, g, or t
  misc_feature (142)..(142): n is a, c, g, or t
  misc_feature (216)..(216): n is a, c, g, or t
  misc_feature (228)..(228): n is a, c, g, or t
  misc_feature (230)..(231): n is a, c, g, or t
  misc_feature (234)..(235): n is a, c, g, or t
  misc_feature (240)..(240): n is a, c, g, or t
  misc_feature (314)..(314): n is a, c, g, or t
  misc_feature (316)..(316): n is a, c, g, or t
  misc_feature (380)..(380): n is a, c, g, or t
  misc_feature (431)..(431): n is a, c, g, or t
  misc_feature (443)..(443): n is a, c, g, or t
  misc_feature (457)..(457): n is a, c, g, or t
  misc_feature (464)..(464): n is a, c, g, or t
  misc_feature (481)..(481): n is a, c, g, or t
  misc_feature (495)..(495): n is a, c, g, or t
  misc_feature (509)..(509): n is a, c, g, or t
  misc_feature (533)..(533): n is a, c, g, or t
  misc_feature (544)..(544): n is a, c, g, or t
  misc_feature (581)..(581): n is a, c, g, or t
  misc_feature (619)..(619): n is a, c, g, or t
  misc_feature (668)..(668): n is a, c, g, or t
  misc_feature (704)..(704): n is a, c, g, or t
  misc_feature (796)..(796): n is a, c, g, or t
  misc_feature (851)..(851): n is a, c, g, or t
gggcttgggaggagggcgggagggggcagcttcnaggtggaggcatgagaaggccttggcctagccctccagggtcccatactgtggagnttggagnggcaggtctggccttncctngntcagcatagggcacccaggtggnggcacaggtggacacccagcacaggcacctaggcaggggcacaagctcactatccgttagccagcctaatgtgngtgtggagaganannccnngcggnaatccacgttgggcttaatcgtgttaatgccaggcttccagccagcgggacaaacttccccatgctcgtctgtntnctggaaggcctggaccagccgcagagcctcatccacggagcgtgccaggaggcaaatgattaanagtgatctggcgaaggacacccttgccatcgatgataaagaggcccctgtnggcaatgccctnatctgttttcagcncgctgtnatcctcagacaagcgtntggtcacgtcagcnagcagggggatgtncagggggcccaagcctccgctctngtccggggggngtggagccaagccaggggggtgagctgagagtgcacngagaggcccagcacttcacagcccagcttgcggaagtnctctgcacggttgctgaacgcgatgatctcggtggggcacacaaaagtnaagttcagagggtagaaaaagaggaccacgtacttncctttgtagtgcgacagcttcacctctttgaaggcgccatcaaccaccgctgtggccttgaagttaggggctggctttccgatgcgcgcgtnaccggagccatgactgaaagctgcgtgggcaaaggctagaagcacggacgatcanacgcgtggacccgcgttctcagcgccaagtgagcactgggccgc

SEQ ID NO: 606738 - DNA, 87 bp, Homo sapiens
agaacgtttcttttcttgtcttctttcttttgtctctgttttgatgtgctccttgaccttctacctcttttatactaataatcttat

SEQ ID NO: 606739 - DNA, 685 bp, Homo sapiens
  misc_feature (272)..(272): n is a, c, g, or t
  misc_feature (411)..(411): n is a, c, g, or t
gatgctttctatgtcattcggtttggcgcgcgatcccagttatgttacgtgaaacagtagtgtctatgagtcatgtattccctaggcatgtatcgcatgtgtcgattggaactacgttgcttgtgaatgtactctaacatatataggatctagcccgtgggagcaatgcgacgagtatctcgagataggaatcccagatgcgacgttcatggaaggtcgatgagcaggagttctcatgcaacatggtacgatcgcaaatgcggcatgcatcngagtgatgctaagatggtatgcgtcttgaactcttgtaggatgggttttcttttgaatttgtgtcgtactattgggattgagtcttgatccaatgacttggggatttgcgggtatataaagtttccactactatttacnttgtaattggcgagtcgtagtctgctcccgtttaagaatctatgtaactagcttagctttgttatagcttgtgggtgctcatggtgcttgaggtgcattcgactactttagtaataggtatatagtccggtttgctaaagatttgacatgctattatcagttagtatacatgagccttcgttttgtactctttgttaatagtcattgagctggatagacctagttttaatctgggatacaagtataagcgtactccgtggttcttgtaatggtg

SEQ ID NO: 606740 - DNA, 140 bp, Homo sapiens
caaggttctgaaatcagtattaactaattacgcttactaactcagtggctctcataacggcctactttaacgggatattttaaagaaagtctgtgattccaagctgttaaccctttagattatattttctactttatttt

SEQ ID NO: 606741 - DNA, 217 bp, Homo sapiens
ggtcgacgaactcttgacctcgtgatctgcccgcctcaggctcccaaagtgccgggattacagtcgtgagccaccgtgcccagccaaaatttatttttatgtatttatttttaatagagagagggtcttgttgtgttgcccaggctgttctcaaattccttgcctcaagggatcctcctaccttgccctcccaaagtgttagaatacaggcatgagc

SEQ ID NO: 606742 - DNA, 921 bp, Homo sapiens
  misc_feature (122)..(122): n is a, c, g, or t
  misc_feature (156)..(156): n is a, c, g, or t
  misc_feature (203)..(203): n is a, c, g, or t
  misc_feature (215)..(215): n is a, c, g, or t
  misc_feature (236)..(236): n is a, c, g, or t
  misc_feature (240)..(240): n is a, c, g, or t
  misc_feature (256)..(257): n is a, c, g, or t
  misc_feature (273)..(273): n is a, c, g, or t
  misc_feature (292)..(292): n is a, c, g, or t
  misc_feature (311)..(311): n is a, c, g, or t
  misc_feature (323)..(323): n is a, c, g, or t
  misc_feature (330)..(330): n is a, c, g, or t
  misc_feature (348)..(348): n is a, c, g, or t
  misc_feature (351)..(351): n is a, c, g, or t
  misc_feature (394)..(394): n is a, c, g, or t
  misc_feature (424)..(424): n is a, c, g, or t
  misc_feature (433)..(433): n is a, c, g, or t
  misc_feature (447)..(447): n is a, c, g, or t
  misc_feature (452)..(454): n is a, c, g, or t
  misc_feature (471)..(471): n is a, c, g, or t
  misc_feature (474)..(474): n is a, c, g, or t
  misc_feature (514)..(514): n is a, c, g, or t
  misc_feature (523)..(523): n is a, c, g, or t
  misc_feature (542)..(542): n is a, c, g, or t
  misc_feature (559)..(559): n is a, c, g, or t
  misc_feature (566)..(566): n is a, c, g, or t
  misc_feature (580)..(580): n is a, c, g, or t
  misc_feature (612)..(612): n is a, c, g, or t
  misc_feature (620)..(620): n is a, c, g, or t
  misc_feature (628)..(628): n is a, c, g, or t
gcgcctgcccgtcctctcgccgcgtcgccggtgcctgcgcctcccgctccacgctcgcttcttctctcccggtcgaggcccgggggaccagagcgagaagcggggaccatgtgccgacgcangttgacggctctcgactaccacaaccccgccgtnttcaactgcaagagtgaaacagaatttagaaacttcatcgttgggtngaagaccagaanatcaggcactacaagattgangacngagggaatttacaganncatccacagcagcgantggcccaagttctttgaanagtatctcagagatgttanctgtcctttcangattcangatcgacaagaagctatngantggcttcttggtttagctgttagattgaatatggagataatgntgaaaaatacaaggatttagtacctgatanttcaaaaantgtgacaatgcaantaaannntgcagaacattgatcanttntggatgtaaataatcctgattttaaggctggtgtgatggntttggtaanctgcttcagattcaggtcntgatgattacctggtantgcttanggcaattcggattntggttcaggagcgcctgacacaggatgcagtnggtaaggnaaatcaancaaaagagggttacctgtggctttagacagacatatgctaggttctgacacaggagatgcagttcttaatgaagctgctcaaattctgggattggtgcataagggagtccagagagctacggacaaaatcacgaagcctagtagctgttcggcattgggggtccaagaaaggccccgctgtgagtgggggtgaaccttgggggtcgcttcccacttgtacggggggcccccttgccgtggggacacagtgcctcggggggccccacaggtgtttctcacaccgctggttttag

SEQ ID NO: 606743 - DNA, 163 bp, Homo sapiens
cgtctccgactagcgacaggcatggggtagaagatggcagtacgaagagaaggtacccaagggaaaaagggaaaagctgatgctggcaaggaggggaataaccctgcagaaaatggagatgccaaaacagaccaggcacagaaagctgtcgggctagtcgggg

SEQ ID NO: 606744 - DNA, 174 bp, Homo sapiens
tcagcacgcgctaacaagggggcagtcatttaatgcagaaagtccagttagacataaagagacagaggttgtaacaacaggtcttcaagacatatacgtcgcattagtgtcacgagtttagctctctaagacacgctttgtatctgatttagtcttaatgattttcgtacttcc

SEQ ID NO: 606745 - DNA, 679 bp, Homo sapiens
  misc_feature (679)..(679): n is a, c, g, or t
gcggttcgggtgcccattttcgtggtggtgtcagttgtggggttgtgctcagtaacagccaagatgtgggaatctgtgctcttcgtcagatggggcagaggagataagcatgttcccgagcatttaaaaataaggttcgtggagaagcaaaaatgttccaggaggatgatgaaattccactgtatctaaggggtggggtagctgatgccctccgtgtatagagccaccatgattcttacagtgtggtgacaacatatgccatatatgagctgttgtggttcaatttcccaagaagcaggagtgattcagtcatcccagcaatcgctttgttcagtttcattcagtctctatggacccagtaatctgataaataccgagctcttctgggggatcaatatttatgtgatgtgtagtaactgccaccaataaagcagtctttacacaaaaaaaaaaaggggacccaacaacacactgtggggcggcttcggcccaagaacagtttcacaccccatcggtgtggccccccggccaggaggtacgttgaccctggccaacgctgggcccaagagaaccggccagcactgtcggggttcccaccataaaaagcgcgggaaccggctgcctaccaccagggggccgccaacggcctcccggcgcccgcgcaaatccgccgcggggn

SEQ ID NO: 606746 - DNA, 1190 bp, Homo sapiens
agcgggcgggcgctcccgcaggggttcctccaagatggcggcgcagaggaggagcttgctgcagcagtgagcagcagccaagcctggcacacgactgacctgcctctctgccaccctctctggcgcgcttggctcaccctgcaaccgcagctactctgctgactggcaacgggccctgagagccacccgcccagaggacagcctggctcaagttcacgagtgacgaaccaactgcttcctgctctgcggcgctcttcaacgcgctatgatggccaaccgacgtgcacaccttcgtgccccacgcggctgtccgcagagctccctgcctgggccagcctgactgccgagcacgccgacggcccgatgctgccggccgtgtgctgcctgcaggcccttccccatgtgcgcggacacggagctcatcctggcagctaccactcgaacgaaacgaccctagcgcccagacccaagcgccacagactctacccagccacgaccaactcgcccagcacgcgcgaagatcccctccagacacaccacgcctgcaccaccctcacgtaactccacgacagcactccccttgccacgacgcagctccacccaccgcttcacccgcagtggacaacttatcccggcgcaggggcccactgcgccgcttgtcggcccggctcctttctcaacgcaaacaatgcgttctaacgttcgccaaatgtctcggtaccaagatcccggtggcgacttcttatggccaaatcgacccagtgggaataggcgatcagccaaggggtggcaccacaaagcgctggaaaagcgagtggggaacgccacaaaccagacaaggatgcaaccagacgcaggaatgcacagccccccatccccaactgctattccgcccaagcctgggcgccctatcacgaatcggctaggcacaaaaggaatctatcgaaaagcctacgcggtggaggggcaatccacaatcccatgcacgcggcccacaagcaagcaacgctgaccccagggaggggctacccaggcgggagttcgcacagcgggtaaaccaccactcggccaccgccagcgaccacacagcaccccacacgcagtagcaccacgccccaccacgccgcacacccccagacaaacagtccggcggaagacgcgcacaaactccccatggcggccagcaacct

SEQ ID NO: 606747 - DNA, 209 bp, Homo sapiens
gggggggcaccggccacggacagggcggactggggtgaagagaccaggctccttaccacccgtcaacacggccccctttctacgggactccgcgcgcgcacgccccggttgagtttgcaaagccttgtgggtacggtcgctccccggtcacaaaacccagcctgtggagcaggctaggagcaccgctggcggagctcagctcgctgacg

SEQ ID NO: 606748 - DNA, 368 bp, Homo sapiens
tccgaagacagagtggttgtctctggactgcctccaattggaagtcgtgcacggattttacaaggatcatatgcgtgaagcaagtgatgtatgttatgctgatgttcaccgagacggcactggtctcctggactttgaacgccctgaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctcccc

SEQ ID NO: 606749 - DNA, 408 bp, Homo sapiens
  misc_feature (3)..(3): n is a, c, g, or t
  misc_feature (96)..(96): n is a, c, g, or t
  misc_feature (98)..(98): n is a, c, g, or t
  misc_feature (107)..(108): n is a, c, g, or t
  misc_feature (120)..(120): n is a, c, g, or t
  misc_feature (139)..(139): n is a, c, g, or t
  misc_feature (142)..(143): n is a, c, g, or t
  misc_feature (165)..(165): n is a, c, g, or t
  misc_feature (181)..(181): n is a, c, g, or t
  misc_feature (184)..(184): n is a, c, g, or t
  misc_feature (212)..(213): n is a, c, g, or t
  misc_feature (220)..(220): n is a, c, g, or t
  misc_feature (261)..(261): n is a, c, g, or t
  misc_feature (265)..(265): n is a, c, g, or t
  misc_feature (271)..(271): n is a, c, g, or t
  misc_feature (275)..(275): n is a, c, g, or t
  misc_feature (357)..(358): n is a, c, g, or t
tgnaagaccatgctgcagattggggtgatgcccatgctcaatgagcggacctagctgtggtgtgcatattcccactaccttagtgcatcaactttntncatgaggtnntgacgaaccatnctgggattcctcaccatcngtnntgatctccactttgccaaaggnctggagaggtgatganaanaaccggcctgtgatgtcagggcgtccanngcccccncaccgtcccagcagtgtctgagccctcaatccccaagctgncagntgtcantcangaccccaacaccttcagcccctcttttcccacattcatagcctgtagtgccccctctaacccccagtgccacagagaagacnngatttgaagctgtacccaatttaattccataatcaatctatcaattacag

SEQ ID NO: 606750 - DNA, 110 bp, Homo sapiens
atcgttgggcatatgcaagaacactaaatgtctatcctaattacagacccactcctcacaaactcactcatgggagctctgtgatggattctgggccccattatcttcat

SEQ ID NO: 606751 - DNA, 426 bp, Homo sapiens
actctctggacaagtacacgaggtaatgagtttgataaaactcctcagtgtacaagtcatacatcaccttaggaccatcaaataaatgagcgcatcaaactgacagcgtgagcctcataattttatttctttttctttttctttttttttttggcatcccaaatcccctatcattatcccacccaggagagctgaaatccccgggctggaagcggggcaaatttatttagcagctccggatagtcacttttattttatgggtggccaggaaaatttctctcaccgactctcctggccaaaatgctcagacatgataccgggcagcgggtcagcttatagatgcacttagggatgaaacacaagagggccagaagtcttcaggcaaagacaccaggagacaacagaccttgggataggggtaccccg

SEQ ID NO: 606752 - DNA, 471 bp, Homo sapiens
  misc_feature (185)..(186): n is a, c, g, or t
  misc_feature (262)..(262): n is a, c, g, or t
  misc_feature (280)..(281): n is a, c, g, or t
aattttttttaagagattgagtctggttctgtcatccaggctcgagtgcaacagcacaattatagcttactgcagcctcaaactcctggcctcaagcaatcctcctgcctcagacccccaagtagctgggaccacagccatgtggcactacacctggctaatttttaaaacgtttttgtagagannggatttcgccatgttggcaggctggtctcgaactcctgacctcaggtgatccgcccacttcagcctcccaaagtgntagaattacaggcgtganntaccgtgctggccggacttcttgctttttagcagaataaaatgtttgaggcttatgttacacagtacctatcctgacttggaatcatttttttttcctccaagaagtcctggttccttttaatgggaaatgatatttagagaccacagtctagactaacgggcactccgtatcctctagaacagctatcg

SEQ ID NO: 606753 - DNA, 141 bp, Homo sapiens
cgagcactgaggcatcaggcgcaataccactgcgtatatcactttgtcagcgctcctaaagcaaacgccaccatttaagtgaaagcctgtcctgacatcactggccataaacgcgagtgagcaccacgaatgcagggcagg

SEQ ID NO: 606754 - DNA, 423 bp, Homo sapiens
  misc_feature (137)..(138): n is a, c, g, or t
  misc_feature (214)..(214): n is a, c, g, or t
  misc_feature (232)..(233): n is a, c, g, or t
gagacagggtcttgctctgtcacccaggctggagtgcagtggccaatctcagctcactgcaacctccgcctcctgagtagctgggattacaggcgcccacaaccacacccagctaatttttgtatttttgtagagannggatttcgccatgttggcaggctggtctcgaactcctgacctcaggtgatccgcccacttcagcctcccaaagtgntagaattacaggcgtganntaccgtgctggccggacttcttgctttttagcagaataaaatgtttgaggcttatgttacacagtacctatcctgacttggaatcatttttttttcctccaagaagtcctggttccttttaatgggaaatgatatttagagaccacagtctagactaacgggcactccgtatcctctagaacagctatcg

SEQ ID NO: 606755 - DNA, 1218 bp, Homo sapiens
  misc_feature (1218)..(1218): n is a, c, g, or t
gatatctgtcgacccacgctgtcgcgtgaggagggagaggcgttgctgggtggtgggaaggcgaagggccggctgtgtttgcgtatccgacgacccgaggtacggcgttcggccagagcgggtgtgcggggacctctcgaggacagtgtcagagccgccgctcgaggatgtggtcttcacagcggcgttacgcatacgtagactcgtctccgctcaccgtgcgtcgcgaccagcgctttgccctccaggctcccacctgggaacgccccgtcccttggtccttcctctcctagccatggtgtcagctctggccaggcccaggtgctctgattcccctgttcaggtcccctgccccttcggctgggagacttgcatatcggcctgaagacctccctgcggtttatcccagctcctgcaagggcccagactgcagcggctgtgaggcgaagggacggcagggcgcgtggcgtggttagtgtgctggctccgatccagcgggaacgcactgcgcaccgtccgccctgcacaccgactcggcgggacgcgctcgcagcacaacggaccgcacagcaggtcagacagggtgttctccagcgatggaggccaacacagccgcgggaggccgggacggggcaggtgtacaaagtgacagactgggcataggtaacgataccggcgactctgcaccgaggggaaaaccggagcacgggaaggatccaggcacagccacgacggaacgacggggaccggaatactctagggatggagactggagacagtaagtgaaacccaacgaattgaaggcagaacacggagggactacaggaccaacccgcataccacgagaacaccgaagaagaagacagaaaatcacagaggaaccacaaggacaacaggaaaaagacagaacccgagcaggagaaaaacaagagatagacagagaagagcaacagacaaaagcgagaacacgagcagcaggagaacaacaaaacaacaaaacacgaacaaggggcgacagagaagaaccacgagagcgcagaaagagaagagagaaaaagaagagaaaaagacaagacaataaacagacaaaacagaaggaaaagcaacgaacaaaaatgagcaacagaacgagagacaaaagatcgacgaatcgaacatacacgaagggacgacaaaacggacgcacacaagcgacacgacacaagagatcaactgaan

SEQ ID NO: 606756 - DNA, 236 bp, Homo sapiens
ttcatgtcggatcagtagacactgtggtaagcacggggacggtatcacacaggatgatctcaccggcttggtggcacactcggcatagtcctggtggtctggcttaaaaacattcaaaagaattaacttcttcttggctttctttttctttttaagtggttcggaatttcttggcggctgccgctactacggcgtggtggaacccatcagaaaccgaataagtattggatactggg

SEQ ID NO: 606757 - DNA, 257 bp, Homo sapiens
ctctcagttggtgcgatgttatacactctcaactggagggacagtgagctgtgactccatcatggtggaccagagctgcactgatgagacgatgtagccatctccaatagaactacagaaaagcaaccaaacggatccatatcaggaagacactctgaagagcagagatctccaaaaactacgcatttcaagtgcatactatgcagcatgcatacctgggaactgaagagggggtaccgagctacgaatatacgtaa

SEQ ID NO: 606758 - DNA, 879 bp, Homo sapiens
  misc_feature (516)..(516): n is a, c, g, or t
cgtacaagagaaactcctaagatctcattggcttaacatcaataaaacgttgatttactcatataaagtgcaaggtaggtgtcgggtgacggagaggtcagtcattctgcctctgaacgtcttcacactcaagatgcgctctctcaaaaatccttcctggcgtcattcgcagactctatctaaacagctttcgcatagacgaaggaaagggcaggggagggtgaatgggattcctatgtagaggttctgttatgcggccgaagccgtggcgaatggcgatgctatctaccttgcagatccgatattctagatgtatacctcagctcttgtggtctacaatctcaagtcgttcaaaagaattggtagctggggaacagactcattttgtcctccagctttgtcttggacgccagcgatgatcgagggggacacacataggttgtaggtgatagcaaaccacgcaatgggatatcttgactagtggctggtcatatgcctttgggggatgactcggtntttggaagtggagcaccacatgcgtctccctgtgcagaccttgggtacccactcagtgaccttctggcatacaggcaggttttctaggcagggagtcctccaatctatggagatgccagtggctaaccagaaactccaaggagcccaaaatcttttagcgcaagcaacagggcttttcctagcacagatggaattaggtgggaacaagtccctggggtctactgggtgagcactaaggaaagctgattacatcgtgactcgtgttgttatatcaagaagacggggtgggccaaacaagaagggttttcgaataggcccggatatgtcctggtaattcctggtggcgggagaaggcgtaagaag

SEQ ID NO: 606759 - DNA, 165 bp, Homo sapiens
ccgtcaccaggaacaccaccgcgagcatcgcggacggcccgaggtcgccaagtgtctgcaccagatggttggcgatgagcgtcgtcgtcccggtcttggccaacgcggtggccagcggcaacatgcccgcgatcaaaaccagggtgttccagctgatcaaccggt

SEQ ID NO: 606760 - DNA, 336 bp, Homo sapiens
  misc_feature (41)..(41): n is a, c, g, or t
  misc_feature (69)..(69): n is a, c, g, or t
  misc_feature (79)..(79): n is a, c, g, or t
  misc_feature (83)..(83): n is a, c, g, or t
  misc_feature (87)..(87): n is a, c, g, or t
  misc_feature (89)..(89): n is a, c, g, or t
  misc_feature (97)..(97): n is a, c, g, or t
  misc_feature (102)..(102): n is a, c, g, or t
  misc_feature (109)..(109): n is a, c, g, or t
  misc_feature (114)..(114): n is a, c, g, or t
  misc_feature (119)..(119): n is a, c, g, or t
  misc_feature (127)..(129): n is a, c, g, or t
  misc_feature (141)..(142): n is a, c, g, or t
  misc_feature (148)..(150): n is a, c, g, or t
  misc_feature (152)..(152): n is a, c, g, or t
  misc_feature (270)..(270): n is a, c, g, or t
  misc_feature (275)..(275): n is a, c, g, or t
  misc_feature (326)..(326): n is a, c, g, or t
gcccctcttcttccgtatcagaatccctggtttaaggcaangattacacaagaacacgacgacgcaatnaaccaaattnaagntgangntgtgtggnatggnagaaggnttaantattnttgttttnnnctaggtatattnnaagatnnntntagtcttctcttatgcaattatatttaagggtcagctgttatccttgccctttaacggaaaccagccgtggccaaatctgtcctcacagatccatttctccctggggcagttgcagancagangatagttccttattactctttgctcaaagggagatttctcctgtccttgcntgcatttcgt

SEQ ID NO: 606761 - DNA, 668 bp, Homo sapiens
  misc_feature (21)..(21): n is a, c, g, or t
gctcggtgagtcggggggacncgaggttctcaggggtccacaggtgccagtgtggctcgagcacctggaatgccagaaggggtgtgacacagcaaagtgtctgcacttcttaagatacgtgtacacagcgcatatatacactctaggccagagttcaaataatattattctccatagtagttctcgttctctctagcaagcactcaaggtcaaggatatgataaatatttaggtccacccctccctctcaacatattggagggtgaacaggtgggcacgcatctgacatttcttcctctattcctatagctataaaagatagcatatatatgcttcaatgagtatccaagtcacatacactccaaattaagccatgcacacgtgtttctgggaagggatatggccagcccaggatatttgggccacatgatgggggacattcactgtgccacttgcagcacccctgatctgggaaggggtggccagtgccacagtggactctgagatgaaagggtgtttcttccagtggcctttggcctgtcatcagcatcttccgcggtggcagacagtacaagagttatgacaatgtgactggcacatatatagtttcttccaggcacacgagagctcgtgtgagccccgtagttccatcgtgcaaagggcctcag

SEQ ID NO: 606762 - DNA, 1005 bp, Homo sapiens
gcctctgcacatatcgtcctattggcgtcgcagtgatcgctgacatcgttgagctcggatgcatgttcacgatgaatggtcccggtctgatacggtttcgacgctatcgaagcgagcgcccctctactgggatagaggatgtgcatactctggagctcacagtggagatgtaggcaggagtctatacaaggcatgctcacagtaacgggggctatgacctccattcttgatactcggtgctcaatctcttaccatgatattacggtggggtagctccaagtatcggtactggtgccccagggagagaaataccttccagagaattctatcctctaaggggatgtgctcctgactctatctgaatcgatatctgccattatcttgaagaagcgcagtcgcatggacgatatgtgtgttgagaggcagcggacctgcattgggcactgctcagatatctcaggctgtattcgtgatactagtaggagctcggatatcatctgggtcgcctttcgataggcatactgacgccttgactagatccctaactgtagcaaataggtagctcttgaatcatctacgggctctggcctggtctgccataaatttgctcgtgttggtcctctgggtcacggcaaatgactcgtaggtctggttcaagaaagcgcattacccttttagatggttgcaggggaattaccattgctaatgagtttttggaaagtaacttacggggaggacgtggctcgaagatttagggaagtagaggaatcggtggccatcagaatttgtggcggcatggtggttgatggaccagaaacctgctcagtggggcggaaggtgtgaacagattcccgcggggggagggatttcaggtcggcgtattttaacgcggggggtttttgtttcactgaaggaaaagggtgggattataaatggtggggggagagaccaaatgagattgagatcaagtctctcgggaatggagatagttaaaagacagaggtg

SEQ ID NO: 606763 - DNA, 152 bp, Homo sapiens
ttactgactgcatctgtgcctcccaggttcatgcgattctctgctcagcctcacatcaccacaccgggctaattttgcatcccgagtagagatgggatttctccatgttggtcaggctggtctcaaactcccaaccgtaggtgatctgcccc

SEQ ID NO: 606764 - DNA, 162 bp, Homo sapiens
  misc_feature (5)..(5): n is a, c, g, or t
agtanggaatgatggatacaaagatggttcacattcttacacactatgctgacaatgattgaatctgttcatttttcagaccagttctctggtccgaaaattatgcaagaggaaggtcagcctttaaagctacctgacactaagaggacactgacaacgtgt

SEQ ID NO: 606765 - DNA, 113 bp, Homo sapiens
acatatctagaggatcccagcgctgcgcaatactcaggaacccacccaaactggtcacccctcatgacaggatggctggctttgatggctcagcatgggatgaggaggaggaa

SEQ ID NO: 606766 - DNA, 501 bp, Homo sapiens
  misc_feature (239)..(239): n is a, c, g, or t
  misc_feature (303)..(303): n is a, c, g, or t
  misc_feature (307)..(307): n is a, c, g, or t
  misc_feature (316)..(316): n is a, c, g, or t
  misc_feature (323)..(323): n is a, c, g, or t
  misc_feature (326)..(326): n is a, c, g, or t
  misc_feature (330)..(331): n is a, c, g, or t
  misc_feature (336)..(336): n is a, c, g, or t
  misc_feature (339)..(339): n is a, c, g, or t
  misc_feature (344)..(345): n is a, c, g, or t
  misc_feature (348)..(349): n is a, c, g, or t
  misc_feature (351)..(351): n is a, c, g, or t
  misc_feature (354)..(354): n is a, c, g, or t
  misc_feature (356)..(358): n is a, c, g, or t
  misc_feature (365)..(365): n is a, c, g, or t
  misc_feature (368)..(368): n is a, c, g, or t
gagaggtgggacacggggtcaggagatcgagacatcccggcaacacggtgaaaccggagtctccaccaaaaatacaaaaaatgagccgggtatggtggcgggcacctgcagtcccagccactcgggaggccgaggcgggagaatgccgcgaacccgggaggtggaggttacagtgagccaagatcgtgccactacactccagcctgggtgacagagtgagactccgtctcaaaaaaccnaaagactttatcttatttcctatatgtttgtggtttcagtcctgatgtataatttgaccctagntagnatggttatntgaggangtngccnntacgnttnctgcnnttnnanatntnnngctcccnttngtccttgacgaacttatgacaattccacgaatgcgactacgcagtgtcaagggattctctgtcacacgccacatatagatctcttcctcctcattttattgctcaaaatcgatctcccatatactgtgtcatg

SEQ ID NO: 606767 - DNA, 133 bp, Homo sapiens
actgtctcttggtcagtgacttgtatctttgcaggaaagcttcgtatatgcggcgatatgcaaagccgggtcatgcgcacgcgcaggttttcaacatgcccagtgtacttcatctggtggcggatcaacacct

SEQ ID NO: 606768 - DNA, 143 bp, Homo sapiens
cttaacgactggattactctggtctgaactcaaatacgtatgactttactcgttgaacaaacgatcctttaatagcggctgcaccatctggatgtcctgccacaagcgggttaccgagactcgcaattgcgtattcatggatc

SEQ ID NO: 606769 - DNA, 166 bp, Homo sapiens
caagtgcagtagtcgctcatgacatccaggacgtggtctacctcacgctggccactgactggtccgatagtgagaggggtgttccggtcatgaggaagtggagccgtggggtggagaatgagcgaggagataaggccaatgaggtcattgtccatgtaccctgggt

SEQ ID NO: 606770 - DNA, 206 bp, Homo sapiens
  misc_feature (3)..(3): n is a, c, g, or t
ccntgcagccactgatcttttattctttctatagcctcgccctttttagaatgttacatattgggaattatacagggtatattattttcagatttgcttcctccgcttagcaatatacgtcccagcttcctccatgtcttgtcatggcttcataaagcattgctttttagcactaaataatatttcattgttcagaatgtatctgt

SEQ ID NO: 606771 - DNA, 174 bp, Homo sapiens
  misc_feature (174)..(174): n is a, c, g, or t
ccgcgatccactccacgccgttgatgccagccacgcccagctcaccgatgcgggtcagcatgctggtgcaggccgtggcccatctcatggaacaggtggtcatcgttgtgatgaaggtggccgggcttgccgttggcaccgcggccgagagtttgcacacacaaggtagaacgn

SEQ ID NO: 606772 - DNA, 118 bp, Homo sapiens
catagctgccacaggtctgcctggctgctcttgtgctgactcttgtggcattcaggtattcttgtgatcactttctggaactgtttctccttgcgcacctccaccatgaccagccctt

SEQ ID NO: 606773 - DNA, 135 bp, Homo sapiens
cggcccgcattcactctatgcattgatcttattttatcttcatcctttgtttacaagtgtgtctccccatgctagactgtgaaacggaaaggacaaggcaccatgtcaaatgtatctttcattcatccactttat

SEQ ID NO: 606774 - DNA, 125 bp, Homo sapiens
ccggccgctttttttttaaagaagaagtaagcctttatttccttgttttgcaaataaaactggctaagtaggtagcttttaggtgatagtacaagagcaattcactatcggatgtgctggtacac

SEQ ID NO: 606775 - DNA, 1450 bp, Homo sapiens
  misc_feature (200)..(200): n is a, c, g, or t
  misc_feature (904)..(904): n is a, c, g, or t
gagtttctgacggttgatgcgaaagtaactgccggggtgttgtacctatggctgtccgatggaggacctctcgtgctatcgtatgaatatgtggcgcgccttttcctctactgatacacatggtatcaagggactcgcaagatccactggtctcatagaggaatcattgaagtgccactgcaaacgatcttactatattnaactggcaagacaagggatcgctgttaataccaatatctgaaagtagtagaccaattggacatatgggtaactctaggaatgagtggctatggactaacacgaagttgaatggggtagagtattaaagggaatagagtgggaatgggttgatctttgttgacatcttgacaatgggaatggagggaggcacacgcaatcatttcacaagcaattgcatttgcgtattggattggaatgctacttctatgattttgtcgaaaagacatggaattgtgattggaaacttcgatactcgaaaagtgtatctactaggggaatttgacttggatagattgtggggaagcgactatgtgaaaactctacctaagagtaggccgaggatttggttcccttgtgagccttagagttggacaccttttagattgtgacgtaaaagtataagcttgcgaaagacgacgattattgtcttaatataaaccaggattagtccaatgtgcaagccccaaaattaccacgttaaagttaaggacagccgaagttgggggtaattagcaagccaaggggtgtttgcgttcgagtcagttctgaccatcatttggcatttcattacctagcgaaactatatggatgacgggacagaatcaggtccgctccctctttgggttggtaacacttaattaaaggcggaggcaaaccggtatantggcgcttgtgggagtatttcaacggcacccctgcattagagaccttttcacaccggctttgcgtggatttccacgaagaatggaggcgtctcaaagtagggtataggatctaaccgggagcggggacattggggcctttgggacaaatttgtggtggttgtagagttagacctggatactcattgcaggttggtgaagagcatgaatgttttgagattgggttgacaaagcaccagggttgctaacttttggggaacgtggtagttctaaatgggtgcgtattgggagagataacagggggaggtatggcacattgtacgtgtgtaattgaacaaggttacataactggtatttagaccgggtcggtagtagtttgtgtgtggaacacaaaatgggcctttttcttggtatacaccacattggaggaattgttcggcaaaaaacacaaagttgggggaagaaatagtacctgtgcgagaaatgtcgacgaagtttattctagaagatgtggtgcttctcatgtttatagaaagacacagagaaga

SEQ ID NO: 606776 - DNA, 1744 bp, Homo sapiens
  misc_feature (166)..(166): n is a, c, g, or t
  misc_feature (597)..(597): n is a, c, g, or t
  misc_feature (1501)..(1501): n is a, c, g, or t
  misc_feature (1743)..(1743): n is a, c, g, or t
aggaggccatagggtgcgaacttacctttggtcgtccacgagatggggggttcatcacgtagcaccagacgcctccacctatgctcgccgaaggttcggaacgccgaatcgaggatcaatagatcgtataccgtgagtgctgcatcgcgagaggtgaatgatcagntgtccacttatcatgacctgtggagcctcccaatgatcgaggctcctcatgggctctgatcgtcacaaaagaagagttgcgtgagtgacgatagcgctagagggcgaatcgggtgtgacgtggcgaaagggctcgtggacggacttacgaggtggacaacttgacgcgattcgacgaacatgactaggggccctaggagtatgcaggctggtgcacttcctgtccatctgccactgtagtctaatctagagcagccgcgtcgaatggtagacacacgccaaaaggagaacgatggagatcgaataaacgatggagaagatagaaatttagcaccacgagtagcgcgaaagtcatcgaccctcttggggcagtcgacgaagttcggtccaaacagtttgcggtcgaacgacggatgcggcgtagcccagacncacgtgtcacgcgccagtgaaggacactacgtgcgtgggcaagcgcagtttagaatgagggatccctagggggcgagctatgccccgaaagtccaggttcgcggctaggtagatgtgttgcgtatggggggcagggcaattcacttccattgaacacatccgatacgggatgaaggattcaaaggatggtggggtgggccttgggctaggggagattggggcccccaaggggccccaggggttgtaaacggtccggccatacactgggggagaaccaccatccaaagtttctcccagagttacaacgaagggcaagttccaaccttcttttggaaccaaaaaccgtggggtttggaaacaggcacatcagacggtttcacacttgagagcgcataatacaatcgagttaccgcctaaggaaattcccacagcgaaccctaacattagggcacacaactgagagcgcagagaaagatctacaccggtgagcgcccaaaagcgaaaaacccaggaaccaggcaccaaagaccgttgtggaacaacctgtgccgaaacgacaacgtctggtcacaaccatcggccaaccatacccaccacaagccaaatcggaaccacgactggaacgaacaccccgagacataaacgaaacccgtgggcgagacaacgacccacatctgggcaagcaccacgatgcgacgcataccgagccaacaagcgcgacgcgccatctacgactaggagacgaaccccgcacacgcagaagcgcgacaagcctgcacaagcatcgcgagccgtgccaccccgcagcgcggcgcggggaccaacccgcgagaccacctgccacgtgagcctgccgacgaagcgacagcacaccggcagccagaacaagggagagcccctgaanacacacaggccgcggcgggtgccaccccacactgacgtgcggacgaacacagccgcagcataaaaacagagcagaccgagaacagaacgcgggagaggacgaccagagacgacagacaggacaagacagaccgaagcacgagcccgagaagctgtccaagacagcaaccagcgcaacgaaccccgacaagcacgaccagacggagcaaagcgaacacgcaccgacagaccccaccacgaccnc

SEQ ID NO: 606777 - DNA, 419 bp, Homo sapiens
  misc_feature (57)..(57): n is a, c, g, or t
  misc_feature (125)..(125): n is a, c, g, or t
  misc_feature (131)..(131): n is a, c, g, or t
  misc_feature (138)..(138): n is a, c, g, or t
  misc_feature (164)..(164): n is a, c, g, or t
  misc_feature (262)..(262): n is a, c, g, or t
  misc_feature (265)..(265): n is a, c, g, or t
  misc_feature (270)..(270): n is a, c, g, or t
  misc_feature (312)..(312): n is a, c, g, or t
ggttatggagaagggttaatagaagtaggtatttggtttagatctttagggagtttntttggtggatagtggatacttgaggtaggaggtggtaggggttaagtctaggtaggtagtagtagggntgtaantgagagntgaggctggagaggtagtggttgttntaacttgatcttgtaggttttaggctttggggttatatacttgccctatgaagacagggaacttgtgctgctggtcttagggcatgaagaggaagggntgntgtantttaaagaccagcagggtgtgggccacagagatggtggaggntgcagccgcctccaccccagtctctgtcagttccagcactgtctggtgctgcatcgcagaaacctgaagatctgggtcctctgtcagcccacacaggttgtcgacgc

SEQ ID NO: 606778 - DNA, 131 bp, Homo sapiens
ttagccgacggagtcacagtagcttgtatggtagatactttcttaaacccagatcttatgagctaaatctacagggccatctgaccggcttccttattgggacataagccttataggggagcccactatgg

SEQ ID NO: 606779 - DNA, 250 bp, Homo sapiens
tgtgttatgtaaatttcacatcaacaattacttgtttgaaaaagagaaaacaaggctctgagaaacaactgcaacccatacatttttactatcctcctcctctgtttgataaatatttgtgtgtagcgagcctgccatggcaattcctgcccttcccctggcccagcttagctcttacgtctccccaccgagctgctgtacttcagagatttacacacctgcccccctgcctgcccccatgggtcgacgc

SEQ ID NO: 606780 - DNA, 320 bp, Homo sapiens
accggcacgctatccggttcaatacactgctgttggccaacaagagcaaattttgatctcccccccaaaaaaaaaaaaaggagggaaggttttggaggaaaaaaaaaggacctgggataaagcggccactgggggggtagaaaaaaatttgggatggtggaaaaatatggggcctggggtgggttgggggggcttgagggggtgggggaaatttaaaggcagtggtgggggggaaaagggaggggaggctcagggggcccatggtttgccctaggtttgttttccggggccacattgcctcccaaaggaaaaccaccctc

SEQ ID NO: 606781 - DNA, 803 bp, Homo sapiens
gcgagctcacccggtgaagcgtcagaggatggagtgcgcgctggaccagctcaagacaggttcaccaccgtggtgggcgcgacacggtgcgacttccagcgtccatcgacgagtacaaggcccagtgatgctacctagccaagccccgtccgctgagttccctgggccgcagtgcacacgcatgcccgcttaccaggagcgtgggtggcaggaggcttgatttgccatatggccggaagcgtgggcgggtcacaattgaggaccatgagttacaaatctgcgtatgtgactcaatactttgttgttggttgtctatggagtcagaaagtactgtacatgaagaattccgggccgagtctatccacagtaagttagacagcaagggcgtctcctttgataacagatgcggatggtggctcatgagccagtgcgcgttcatcagagcctctcacgaatgggataccgtctaggtgatcatgaacggatcctgaattcttcatgaagcttgtcattcaacctgggaaggaattcaggctgggataggagctcgaggtgcaggcatgggattcactgcatatgatgatcgttactcttgctccttcggccaggctgtgggctgtgccgaggcgcggtgtgaccctcatctccccatttgttgcggcgcatgcttgattggcatgtggcaaacaccgagaagaaattctatgatggccctggaagaacctggtggtaaagagtgtcggtaaaatctactactactacagaaggtctaggtacgaaaccagtgtcatgggcgctcttcg

SEQ ID NO: 606782 - DNA, 140 bp, Homo sapiens
gagcacatacttagcaatactatggactactatgttggactatgacatggtgcactttctctctaaattgcagcaggagcttttgctagcactgaaattctggatatgtgaatgtcacactctcacatacttcatatact

SEQ ID NO: 606783 - DNA, 763 bp, Homo sapiens
  misc_feature (24)..(24): n is a, c, g, or t
  misc_feature (33)..(34): n is a, c, g, or t
  misc_feature (37)..(37): n is a, c, g, or t
atcgacccccatgtattgatcctnatcgcagcnntcntgcgacattgcgctaattctcctatgggagcacatatggccggcttacccacttttacccgcccttttcaaatcgaaactaatgtgggcaattttgagggcacttttcctaataaccgggacaacgatcaaacaaagaatcccattatcacattaaaagatcattggaacgcaaattttttcgcaataaacttgcccaccacagtatccaacactatcatgaagaaaccccctactacgtctcactgcatcaacgaatttaagaccactctactgcatttaacggactccacacattctaactctgcaatcacgcacccacctcatggtcccaatttttgtctccgtcatttcaaccgttctcaacattacctaaagttcgtcccacctctctccgtctatctacttggatcagacaatctcctagacacgcatccctactcctatcctgacgcggtttactcgtcctattccctatcgagcttatcctttagccctctattagggcagattcttcaattcggatatccctaaactgacacctccgatctgcggttatctcttactaacctccccttcatatccatcattctagcttgataccactcccgtattctcccatttgtcacgccacccaagctattcactctccttacatccaatacctcccggtcaacgcttcgtttatcagctcctagatgcattctaaggcgcctatctctcttct

SEQ ID NO: 606784 - DNA, 170 bp, Homo sapiens
tcgcagcataacattagataaaaatctttggcttttgtttcttgtttttttttttaacaaaaaaaacccggctgggggaaccagcatttaaatgaattaaggggttttatcccccttttaaaccttatcccaaaaaaagttctagctgatttcattgaagggaaaattct

SEQ ID NO: 606785 - DNA, 304 bp, Homo sapiens
ccctgcccttttcaacttcccccctcaagaactgtcaagtaatccccctctgggtaccatccttattcctcctcatggtcggattcaagcaggtgcttcaacccccccaaatgccccagcagggtcagatgctaatactggaggccgtgggcagaccaataatgctgcttttgcatcagcttcccactccccctgaacagtcccgagcagccagctgcccaggaaaaaccccccgtttcttgagtgtccctcagccaccctggtcccgtttggaaaaaatatttaaaaaagaaaaaaatcctta

SEQ ID NO: 606786 - DNA, 101 bp, Homo sapiens
  misc_feature (89)..(89): n is a, c, g, or t
cgagtcctttaaacttagccgggcgtggtggtgggcgctgtagtcccagctactcgggatgctgagtgaatcaggagaatggtgtgacnccgggagtcaga

SEQ ID NO: 606787 - DNA, 279 bp, Homo sapiens
ctaatagtagtgtaaagtggtggactgctctacagagcagcacagtggttcctcaaaaagttgaacatagaattactatatgacccagtaattccactttgaggtatatagccccaataattaaatgcagggacccaaaaagatatttgcatagcaatgtttacagcagcagtactcacagtagccagaaggtggaagcaacatcatgcccactggtggatgaatggataaacaaatgtgatatttgcacgcaatggattattattggaatattattcc

SEQ ID NO: 606788 - DNA, 226 bp, Homo sapiens
cctagtttttgaagtttcaatcagcaaagaaatgaagggctggtaaaatgaatttcgtaatatcctcaggatacttttatcttaaaagtatgttgttaaagatttgggtaaattggtatttcaacatattttaaatggtgttagagcacagtggcacgccgtagttttagacagtttcaagtagcaccgtagtctagaacaccccgcagggcagcgaaggggggta

SEQ ID NO: 606789 - DNA, 81 bp, Homo sapiens
ccccctctgagacctccttgtttaaaagataaacacaaattgtgctctcaaattatggcagataaagcttgatactctgta

SEQ ID NO: 606790 - DNA, 142 bp, Homo sapiens
tacacagagcgcctggaggagccgctgtccctgggggagctggacacctagccgcggtgtccgtgctgcccttctttgaccctgacccccacatcgtctacctctgtagcatgggtgacagctcaatccggtccttagagat

SEQ ID NO: 606791 - DNA, 415 bp, Homo sapiens
  misc_feature (217)..(217): n is a, c, g, or t
  misc_feature (219)..(219): n is a, c, g, or t
  misc_feature (275)..(275): n is a, c, g, or t
  misc_feature (278)..(278): n is a, c, g, or t
  misc_feature (405)..(405): n is a, c, g, or t
tcaagtgcggtatcgacatgtttgactgcgtgtcacccaccagactagccaggcatggagctgctttcactcatgcaggccgtatctccatcaaaaactcgccgcatcaaagggattttagtcctctagatcctctatgtacctgttatgtttgcaagagctataccagagcgtatctgagccatttagtaagacaaagcgaaatggcgggacatcntntgctctcgatacacaatgtgcattttttgatcaatcaagcccaggaatgccgtcangantaccttggcaaggccgaagtttaaaagaagtactttaagtccgttgggtcttcaagttcacgcactttcctgcgcatctatagagacatcctgattgtcggcttcgaagtaggacagggctcttttncggcttgagt

SEQ ID NO: 606792 - DNA, 709 bp, Homo sapiens
gttacgtactacgatttgtgatagtgagcctgtatcctgtgcgatgtgtgtgacaagtgtgcaggacctggtcttgcagagatgtccgacaggggtctcatgcgctaatggcgtgtgagctgtatctgactgaccatgacaaaaaaccagccatgatttctcgtgctgtgcctatgtcaagtgtctggaggtagcgtagtggacgcgtagggaacgcctcggtctgtaccagtagggacatgcagagtctgagtcgtgtctttctggatgcaaggtcgcacacgtcgcgccatgtgagtgggataataagtatgtcgcaggtagtgaatcagtgtgtctgtgggacatctgtgtctcactccggagatcagtgacgcgcgcatgtggctgaggtctcacttctggaggtgtcgcgagtgtttggcgaaatctgcttttagcgctccaaaaagaaccgggccaattaccgttgaagttgttgcaaaccgatattatcatcgtcacttcatgttggaaggataggattaataaccattttaaggttttaggattaatatttcaccaaatcgtttttaagtaaggcaagcattaattattatattgcggagacttaaccggaggccggtttttagggattttgtttggcaggaaccagtatataataaagatcagtggaaagacgtttccaagtggtaaacttcgtaagttt

SEQ ID NO: 606793 - DNA, 202 bp, Homo sapiens
tgccattgtctcctatctagccaaccatcagaggcagggccaccttctctttctgacccacactcctacacttactatttctatgtgaacgcaaccgcaaaaaaacaaaacacaacaaaaaattctatttgccatctatggcccaatactgatgagtatgcacgggctctgacgtgcctacaactcgcctgtgcgtggcacc

SEQ ID NO: 606794 - DNA, 300 bp, Homo sapiens
aacaatgctaaacaaatatcctatagttggcatcaaggcattgatcactattaggaggcttttaagacaattcatttacacgatgcacatgcctctgagtgaacgtgtactatcccatcatctgaagcccacaggaacaagtcctacaataataaaaaggctcgatggaaaaatttctcaatcctgaaatcccctagggcaggcgtcaggagaaagtgccatttttgctatttaagaacaccacagctcttaaaactaagcacttatccctaacatgcaacactgcagatgcaagtaaca

SEQ ID NO: 606795 - DNA, 356 bp, Homo sapiens
ccaaaataatctatcaaaggtgttttacccagggttttaatttttaaaaaattttatcggcaaattggccccaaaaatttatgggtaaaatgtatgttttccccccttaaaaaccctaaaagttagttaaaagttactttggtttaccccaaccccaatgattaagggcctttaattttggtaatttaatgaaacccctcccctgccccagggaggtataaatttttgaaagaataacccgaattatataatatgaaatgctatgtaaagttttttatgtaaaaaaattatgtataaaactattaaaaaatcccccgctttgatcaggggggcccccaataaaattttaaaaagta

SEQ ID NO: 606796 - DNA, 510 bp, Homo sapiens
ttactaggtgaggatgtggagaaactggaaccctcctatactggtaacagaaatggaaaatggtacaaccactttggaaaacagtctgatagttcctcaaaaagttaaagatacaatgactgtatgactcagcaatttcattgctaagtatatatgcaagggaaatgaaaatgtatgtccatgcaaaaacctgtacatggttcacagaggcgttatttgtaatagtcacaaaaagtagaaaggacccaaatgtctacttactgatgaatggaaaaataaaatgtggtatatctatacaatgaaatatcatttggtaataaaaatgaagtactgatacatgttgcaatatgtatgaaccttgacattatgctaagtgacagaagccagtcacaaaagaccacgttatcatttcctttatatgaaatatccaaataggtaaactgtatgaaacagaaagtagattagtagttacttaggactagggtagttggaggggtgctagctaaaagg

SEQ ID NO: 606797 - DNA, 802 bp, Homo sapiens
tgacaaaaactaggccccatctcaatcatataccaaatctctgccctcactaatacgtatagccttctcctgccactctctcgaatcttatccatcatagcaaggcgagttgaggtggattaaacctaaacgcagctacgcaagaatcttagcatactcctcaattacccacagtaggatgaaataatagcacgtatctagcgcggtacaaagcctaacataaccagttcttaattgaactatttatattatcctaactactaccgcatgcctaagctaactcaacttaaactccagcgccacggactcctactactatctcgcacctgaaacaagctaacatgatctaacgacccttaattccatccacccctcctctccctaggaggctcgtgccgcccgttaaccggcttttgcgcaaatgggccagttatcggaagaattcacagaaagacaatagcctcagtcatccccaccatcatagccaccatcaaccctccttaactctacttgtacctacgcctaatctactccagctcaatcacactagctccccatatctgagcaagtgcaatgaagagaaaacaaaacaaataaacaatacggttggggcgtgtggggcccaaaggaagttagcatgactcacggggggggcgggcccacaagccagaagacggggccagatctggtcccgggaaaaccggggcacagggaagggggggttccgcccaaaaaaaaccggggggcccggccgttgagaaacccggggggtcgggtccggctagacaggccagactgtaca

SEQ ID NO: 606798 - DNA, 312 bp, Homo sapiens
tcggcgagcagataccctgtatgtcgactacagacacatgggattttaggaactcttagacgaagagcagtatggcggcagcgaatacttaaagacacccggaggggcctacaacgttgatgcctacgcgtagagcgtatatagtctagaattttccgctcggtaagcattacgattgccattgcgattaaatgtgtacaatgaggagtagcaggttcgccatgtgtatgttgctaagaagaggaattgaacctctgactgtaaagttataagttatatgcgattaccgggctctgccatcttaacaaaccc

SEQ ID NO: 606799 - DNA, 401 bp, Homo sapiens
  misc_feature (328)..(328): n is a, c, g, or t
gagaagacgacagaagggatcccttgaggccaggagttcaagaccagcctgggaaacacagcaaatccctgtctctacaaaacaacaacaaattgtttttttcaaagaatgagtagggatgctgggggcagtggctcatgcctgtaatcccagcactttgggaggccaaggtaggtggatcacctgaggtgaggagttccacaccagcctgactaacatggtgaaaccccgtttctactaaaaatacaaaaaaattagctgggcgtggtagcaggcacctgtaatcccagctacttgagagactgaggcaggagaatcgcttgaatcntggaggtagaggctgcagtgaacccagatcgcaccactgcattccagcctgggcaacagagcaagactgtctc

SEQ ID NO: 606800 - DNA, 596 bp, Homo sapiens
  misc_feature (33)..(33): n is a, c, g, or t
  misc_feature (120)..(120): n is a, c, g, or t
  misc_feature (129)..(132): n is a, c, g, or t
  misc_feature (160)..(161): n is a, c, g, or t
  misc_feature (164)..(164): n is a, c, g, or t
  misc_feature (170)..(170): n is a, c, g, or t
  misc_feature (172)..(172): n is a, c, g, or t
  misc_feature (176)..(176): n is a, c, g, or t
  misc_feature (188)..(188): n is a, c, g, or t
  misc_feature (200)..(200): n is a, c, g, or t
  misc_feature (213)..(213): n is a, c, g, or t
  misc_feature (256)..(256): n is a, c, g, or t
  misc_feature (261)..(261): n is a, c, g, or t
  misc_feature (277)..(277): n is a, c, g, or t
  misc_feature (441)..(441): n is a, c, g, or t
  misc_feature (591)..(591): n is a, c, g, or t
actctgacctggtttgtgctgttaagttttgantttgggtcaaaaggctagggaaagatgtgccaaatctactctctaatccagtaaccatcccgtcaggtgtgagtgtgacagacattnggggggggnnnnggggaggggggggggtgtctgggaatgnngcnacgggngngcgngtggtaaccgantatctgtacctncttgttagagggnaaatgttaaccaccctttcccatgtgcatgatgtgggacgggnctggngcatcctttcactaanatgaatatcaaaatgggattggggcatcttttggttcgagtgttgctttgcaaagaaacattgtcctgctgtctgctttcttccttctgatatgacatttctgcctggcctctacagtaccatgaaacctatattacttacttctctccagcttaatcctaggnggaggaattctagctgtggtttgtgaatgtacacaggtcagagaggtttagcaccttttgggaggaggaggtcagaatgcggtggtgaaacctctcccactgtgaccaacaaaccctcatacttaaaaagaagcatgcacctctggcttnaggtt

SEQ ID NO: 606801 - DNA, 433 bp, Homo sapiens
cagttaactcgcgcactgagaggataccggaggtgggaacatctcagatcatatgggtgccatacaccgggatagagtgccacagtccacgctactttagaaaaacactgggatgggtttggtcctgcacttaatgaatctgagatgcctgaaagacagctatgagctgaggtgtctataaggggactgaatgtaagggtctgagctcatgagagagggctaggaatgggtggagagctaatgataaaatatattacacaccagctccaagagctttggaaagacagaagtggaaccattaactctctggaagcctgggaaggattctcaaagaagatgacatcggattggagtctggcaggagaaaggagggacctccagggaacaggtgagatgggatgaggagggagagaggagcattcctagcacaggt

SEQ ID NO: 606802 - DNA, 767 bp, Homo sapiens
tccagcgggctgcaggaattcggtacgaggctaaaagaagatattctgactgactaattcactattatcatgttacatttctgaaataattgaactttaggggcaagatactacttactgaagcacaggttattactgagaacccacagcccagctaattataagagacaggcatttcctcaggccctcccagaccaaatttatcgacccaaacaatgaaatgaaaactgattgctttgatcctgaccctgttttctagagcacaaacaaatggttacaaacaattgaaagaaagtgcttgatcgtaggacagagattggaattgcttatagcgactgagtgcttaaattgctttaaatttagtattgccactttgatgagagatgggccttttagaaaggaagacatatttaaacgattgatcctttttcccacagtgctttattgtgaaatatgagacaggtctgaatacacttagaggtttattgtgccaaggtatagagcccatgatggtgccttaagagagttttagaacatgtgcacacaagtagaccggttacagctgtatacatttgagggagacagaaggtccaagcatagccgtgagctattacatgtaacgtgtacacctggtatggcctggaacagctggacattcttgaagatgggggtttacaggcccgaggtagaccaaatagtactgaattgcaattgtgtgagagagtaaacctttcctggaaagatgaactcggctaagtcaatatagg

SEQ ID NO: 606803 - DNA, 404 bp, Homo sapiens
  misc_feature (228)..(228): n is a, c, g, or t
  misc_feature (301)..(301): n is a, c, g, or t
  misc_feature (347)..(347): n is a, c, g, or t
caatggtgtgatctcagctcattgcaacctccacctcccgggttcaagcgattctcttgcctcagcttcccgagtagcttggattacaggcgcccgcaccacagccggctaattttttttggtatttttagtagagacgggggtttcaccatgttgcccaggctggtcttgaactcctgactgcaggtgatccaccctcctaaagtactaggattacaggcgtgacanccgcgcttagcctgtttttagttttctaaagcaaggtacctatttgaaaggcaggccattaaacagtgatgantaaggaaaaatcctgggaagagcctgaggaagggaaaaaggtgganttttaattgccaggaggattgaagtttagttcaaagggaacagtgttggaaaacatt

SEQ ID NO: 606804 - DNA, 810 bp, Homo sapiens
  misc_feature (13)..(13): n is a, c, g, or t
  misc_feature (94)..(94): n is a, c, g, or t
  misc_feature (101)..(101): n is a, c, g, or t
  misc_feature (106)..(106): n is a, c, g, or t
  misc_feature (109)..(109): n is a, c, g, or t
  misc_feature (111)..(111): n is a, c, g, or t
  misc_feature (113)..(114): n is a, c, g, or t
  misc_feature (116)..(118): n is a, c, g, or t
  misc_feature (125)..(125): n is a, c, g, or t
  misc_feature (127)..(127): n is a, c, g, or t
  misc_feature (137)..(137): n is a, c, g, or t
  misc_feature (140)..(142): n is a, c, g, or t
  misc_feature (147)..(147): n is a, c, g, or t
  misc_feature (149)..(149): n is a, c, g, or t
  misc_feature (151)..(152): n is a, c, g, or t
  misc_feature (157)..(158): n is a, c, g, or t
  misc_feature (162)..(162): n is a, c, g, or t
  misc_feature (167)..(169): n is a, c, g, or t
  misc_feature (171)..(171): n is a, c, g, or t
  misc_feature (176)..(176): n is a, c, g, or t
  misc_feature (183)..(183): n is a, c, g, or t
  misc_feature (189)..(189): n is a, c, g, or t
  misc_feature (198)..(199): n is a, c, g, or t
  misc_feature (202)..(202): n is a, c, g, or t
  misc_feature (205)..(205): n is a, c, g, or t
  misc_feature (250)..(250): n is a, c, g, or t
  misc_feature (277)..(277): n is a, c, g, or t
  misc_feature (280)..(280): n is a, c, g, or t
  misc_feature (289)..(289): n is a, c, g, or t
  misc_feature (293)..(293): n is a, c, g, or t
  misc_feature (301)..(301): n is a, c, g, or t
  misc_feature (789)..(789): n is a, c, g, or t
ttctaagtgagtncgggtgggggagcttcacgaggggaggctgctctgtgaaggaaccgcctttctctccgcgtgtctcacccttttctccccntaatctntttgnacntnanntnnngggaggntnggggggggtnagnnntgttngnannatacnnggangaggnnngngattnttccttnttgccnctccgcttnnttnccncgtccattccgcgcggtgtcccgattttaggggtagggagaagtntcagcttcaggcatcgcgaggcgtggnggncccatggcnccgntgggaggngccccgcggctggtactgctgttcagcggcaagaggaaatccgggaaggacttcgtgaccgaggcgctgcagagcaggtgtccgtgaggcgggaaaggtggaagggggagctctccgcatcacgtgacacgaggagtgcttttgggtgtcacggagtgagctttggagtacgggtcgtccgtttgcaaggcaggaggagcactgggctggggaaggtggaatgccaccattacataaaacagtagtctacacaggcgagcctcaaagaagcaggtgaccacctctccaaagaccttcagctgcaggtctctctgagaagcattaataatggttcctacgaaggcactttctatataccaggcgttggataccagcctgggcaacatggcgagaccccgcctctacgaaaaatccaaaaagtagctgggcgtggtgacgcgtgcctgtggtcccagctattcaggagcctgagacttggagctgatgtntgttctgtcctccggctctct

SEQ ID NO: 606805 - DNA, 170 bp, Homo sapiens
gaagcgagatgtaccacccctgtcaaactgcaacctctgatcttctgctcttaatgcttgtgcttcttcctttccagcatcccctacccccgacaatgtaattttacatccatgttttatgttttttgcgtttagcagtgttgtacttttatttattgggttttatggtt

SEQ ID NO: 606806 - DNA, 470 bp, Homo sapiens
ctgtagatcgtcgtgtgctacgccatcatcatgattagaagatcacagcagaatacccttggattagagagaagttcgtaccttgcatatctctgaattctagtctctcataagcactgtatgctgggatgattttcactgctttgtgttaatgactttgagcgatctctcacatgatggggttctttagtacatggtcaacagccatgtcatcttaccacacctagccattgtgaatgctgtagtgacatcctttataggcaccttacagctcaaacactttggtttcatttcatgccttacttatcacaaaggcaggaaagtagggatgatctctaaagtcacacaaaaaaacaaaaactttttatcgaaggctcataaataatcatgtcatttggcaatttggttcccacattttcccccaagagttttcaactataagttctgccaggtggctatacaatatgcac

SEQ ID NO: 606807 - DNA, 321 bp, Homo sapiens
agtttttgccagttggttttatttggaggtttgtggggtttttttaaaaaaaaaaagtctttaaattaggaagaaacattaaagattatgtcttagtggagggagtaatcctaacacccagggtggccgccaggtggcacctgcctttatcccagaatgcccttgtcccagctttttgtccaactgttgattatgtgatttttttgaaaggtccattttcaaaagccagggggtttacatttttgttttggccagcccattttgtatttaaaggttttgaggcccaataaaataggacgtggtgtttgcagcccttattga

SEQ ID NO: 606808 - DNA, 1240 bp, Homo sapiens
  misc_feature (967)..(967): n is a, c, g, or t
  misc_feature (975)..(975): n is a, c, g, or t
tgaacatccagtccatgccatggtaactagttgaaaatgttatactggagtggcatttccaagttcagtgcttctataaagacctgctagctcacagaatgcttttttaatgttctgcattgttgtgtgtcccccattgaacaaccttttgagcggacctcgtttttactaatgtaaacattctgactagtatccaaagaaatgacctttgagtgaacctctaaccttccccgtaagtatttgtttgaagacagtgtggagttctcctgctgagaactaagaaccatgatgccttgcagctctgtgagtaagggagtgtttgggggaactggagagaaagacataaataagggaacaacctccagatgtaaagaataaaagagtgaaattaaaaagggaaaaaatagcaattcgttttacctgaagagttagcctataccgaaaaaaaaataaaaataaaaaacgcaaaacacaaaaaccaggattagtagcacataaaagggggtaaaacccctgccgagtgttgtcctctattagaaacttcaaggagaagagccttctctgaccctcctgagcatctctgctggtttcaaggtgagctgataaaaacggttcctggggtggaaatataggtagtcctccttggttgctgtaaaagtggtggggaaagagtagataattaagttctttttctgattggaggagggatgcttctggaagtctttgtgatctagtcagatattcattcctcagcaacatttcaggtgacaggtgggaagaaagatgcagtttcaactctccttttgttttcacctctacatagctgatcactttcttttttgacaactgagctacactttcttaagtaataaagaagtccattgttttgcaaacaaacaccatatgcaaaagactcctttggttttctcccagctattattcctcagcttaattgtattcccaccanagtgctcncaggaggcccgaccgagtggggcctgactgtcctcctccaaagggacttcagcttcctcggaacacagagctgccagcacacactgaatttttctggctaatttcaaagagtgagttttcagttcctgcctgtggccccaggtggactcattaatcatgaagtccccctgtgcttaagatctgaaactggaaatattgacagatgttatcaatgggtatatttttagggagaagctagctggatgctccctgctcctccgaaatg

SEQ ID NO: 606809 - DNA, 632 bp, Homo sapiens
ctaatttttttttttacttttaatagagatagggtttcgccatgggtctctaactcctgagctcaagtaatccacctgcctccacctcccaaagtgctgggattacaagcatgagccactttgcccagcccatatgtatgttcttttggttttaaagacagaatctcgctctgtcatccaggctggagtgcagtggggtgatcttggctcactgcaacctcagcctcccaaattcaagcgatcctcctgggaggcggaggttgctgtgagctgagatcgtgccattgcactccagcctgggcaacaagagtgaaactccatctcaaaaaaaaaaaatggtacagtcggcctaaaggaatggaaaaattatgctatgtagttaaaccaggcctgggacaacggaaaggaagaaaattcaaagcggctaaattggctctgcatgtgcccaaatatttcccagtgctatatcctaaggttccactaagtggtggttacagggtcggagatacgtgaattatcattaagaaacactaaacccggaaggaaattaattaacctgaccctgacaataggacccccgacaacgtggcttctcccagcagacatgaggaagatacctctcccattacctg

SEQ ID NO: 606810 - DNA, 299 bp, Homo sapiens
tgaaaatgaggataagcatggagagccaatgattacatttcacaatgtccttcatgggtatgtgaatatgatagtaggaatcttagctcttcacttaaagaaagaagcattaaaatttggaattttagagagtgagatgataaaaagatacgtggtatggtattaccaccttcttggaatttctgaaaaaccatgttcaggacccagacatagataactgactccttcatttgaattttaggtaggtactacctgtgttattgtgtttagtttctgagataaattgataagcattcaaa

SEQ ID NO: 606811 - DNA, 433 bp, Homo sapiens
  misc_feature (17)..(17): n is a, c, g, or t
atgaacgaacatctcanaaaaaaaaaaaaagaaaacgaaaaactagcaacaaaaaaactctcaggatttggtataataggacccggtgtataaggtagaatattccttccctattgctgtaagcttcaccttcagaacaagacttctctcttttctatctacagtatgaaagtttcattctatttaccagccttaaaagatagaaatttttaagtgtgtagcttcatctgtgttttgacccagttagaaaactgaggagaaattacccctctcattttttctccccctgagttttcaggacagtttgtcgtgctttgccttggggactttctttcttggctcaccttttatttctttccaaattgacgagacgttgtctactagttccagtgttggttccggtcccatttccggggttcccggagcctcgaat

SEQ ID NO: 606812 - DNA, 156 bp, Homo sapiens
cccccagctgggttcgagttcgagaccagcctgatcaacaacatgtttgtaccccatctccactaaaaaacaaaggagccttttatggtggtgcatgcctcccatcccagctactggggaggctgaggtaggagaatcacttgaacccgggaggcg

SEQ ID NO: 606813 - DNA, 170 bp, Homo sapiens
acatgagaacacgtagacatcctcaacctgtcggacaatcaacctatcgagaaataccatgttgtctttttcccagcctgcatcctagctgtatgataggcctggggaatggtctatgaaaatgtgggcgcatatgttacccaaaccatctggcagctgattcctgtgtc

SEQ ID NO: 606814 - DNA, 134 bp, Homo sapiens
cccggagtatgtgatcacccagatcgtctgagagcgggaattttcccggagcggggtggacggagtgtcacgatgactagtagagatgacagacacgtcagggagccccacaagaggaccccccaagacaccct

SEQ ID NO: 606815 - DNA, 964 bp, Homo sapiens
ggagcagctagcgcaggaagcgctcagacacttggttaggaccaaaactcgactcagagccatttgcccccttctcggccaggcgccgaccatggaaaactgactaccatagagtattggtccgggaatgtgctttgaggctccttggtatcccctgtgtcctttcccgtggaacataggcctgattctgtaccggtcctgatgaataggccgagagctgagtccgtcaaggaggaagctcaggtgatattacacccacggaagacccgtatcgcagagtaccgtaccgaacgatgcatgagcatgatccacaatggatgtaatgtgggctgatggacgggttgatgatgaactaggtggacggcgaagagaattaattgggactccgagagagaattctgattgagtcgcacggactgagaactcgtataggttctcattcagaatcttgtgtcgccgttctgaaccattctagaatgacctcttggtgaacttgatcagttgattccccccaacaggaacttgctactttagccgaccctatgtgacagcctcccttgtgtccgcagaagtaagacaatctaatgactcgatcagtaggtggctagtagtggatgcatcgacattgaggatcgagatctaggaagatagcgcagtagcctaaaatcatagttaacctgtatgacctagagatggcatgacatccacttgaacatgttatgcgccgaatagaagagtgcgtgcagggtcagtcccgtggaccagttcccgcacggctcagtctgcgtggattgacgcgggagggagaattaaagcagtattggatacagagtggtgtatcacagcaagaaacagtttgtagggcaaccagaatgaaaagacacgcgggggcacaggactacaaggagggtccaccgtaatacggtatctgtaacccggaacaaaccaatttgcatcgtcggca

SEQ ID NO: 606816 - DNA, 359 bp, Homo sapiens
acaattcagcctcccactgttatgtcttaactaaacagaagagaacagaccgaaaatctatacgtaacacaggagactggaagacaatgtatcaatctgaacatctctgccaattttagctcccacgccatctatagatagacagttaacgtttctatttgacccctggcaatgaggcctagaagaggtcaaggttagaaaggttaagcatttgatcactacaggtacttgtagtacctacagaaggaacccatcctggggttggtggagtctggtattgctactcgttttgatagttctcatttacagagaaagaaacataagccaaagccagacagacatccaagcctcacagttat

SEQ ID NO: 606817 - DNA, 244 bp, Homo sapiens
cctttccactccattccattgcatcccactccattccattccgctccaatccacgccattccactcgactccactagactctattccatgtcattccaccccaccccatttcactccattccattccattccactccactccactccaatccactccacttcattccactccactccactccactccattacattccattctaaatccattccatatccattccattcccttcgtttcttttga

SEQ ID NO: 606818 - DNA, 413 bp, Homo sapiens
gagaactcttgctggacatactagctgacgccactctgtaccagcatacgtgagctatcactgattatcgacttaaggtaactacgcctgcactctcacatgtttctgagttcactaccagggagaccatgggccaatctgcggaccggctgaccggtcacagtgcagcttctctattggaacacgatgaatatgcactgtgcacagacagtgtaaccttgaaggcccaggatgaaggacttcttactgatgtgatacccattactgagcccagactagagacagctactagagctcatgggaatcgaccgtcattactggagctgatgtacttactaatgcctgcattcatgatggcttacagcgcagagacagatgcacagtattcgctctttgactgatgcgcatggcgg

SEQ ID NO: 606819 - DNA, 108 bp, Homo sapiens
ccctagtgacatcttattaaaaatagtcacacaaaaaatacttgtaaattataataccctgtgccggcaaaggtgcaatgaaatgtgcattgttctttttatcttttt

SEQ ID NO: 606820 - DNA, 385 bp, Homo sapiens
  misc_feature (19)..(19): n is a, c, g, or t
tttccataaacacacacanttctaatcacctttagacaagatcgttttggcctttgtttggctttatgcatagtaaagtgcatcagctatttatattcctgccagtaggaaatgatgggccacgtttgtggggctttttatttttaacaaaaatgttaaagtctatttatctcacactgatcctgctgtcaaaaagctataactactggaaagacagagtgtctgaggagacaactgccttagattgtcagtgagccaatgactgtgctgcctaaaaatatttaaaagtattttaattcctttattaaaagcatttataaaaaaacataattttcaaggaagtgtgggtggaataatacagaatataaaatgtgctgactttcca

SEQ ID NO: 606821 - DNA, 294 bp, Homo sapiens
ttttttttttaaggtacccgggccaggcatagtggttcatgcttgtaatcccaacaagacaggcagatcacttgaggccaggagtttaagaccagcctggccaacatggcaaaactccatctctactaaaaatacaaaaagactagccaggtgtggtggcaggcacctgtaatcccagctacttgggaggctgagtcacgagaatcatttgaatccaggaggtggaggttgcagtgagccgagatcaccccactctactccagcctgggtgacaaaggaaaattccatctcaaa

SEQ ID NO: 606822 - DNA, 911 bp, Homo sapiens
  misc_feature (165)..(165): n is a, c, g, or t
  misc_feature (393)..(393): n is a, c, g, or t
  misc_feature (395)..(395): n is a, c, g, or t
  misc_feature (571)..(571): n is a, c, g, or t
  misc_feature (575)..(575): n is a, c, g, or t
gtccgggtcttgtgtgcttcttgtacgttcgaatgtctcacggctgagtacagtttagtggcatccttcctaatgacaggaaggcactgttttcctcaacactgagatctgacctgtgataagtcatgtgactatactcactatgtaatatggctcacaagttcnaattgctccctaaacctgacatggtaccaaagtcctctcagtgcgtgcgtgcgtgaacactcgtcttccagatagttagtacatcatggacttatagaaaacgttctggtcttaagaacatttgccaatcgcgagtccatcgtggtcaagtctatgacatgtgcacacggaatgagaactacatagagtgcaaatgtgttggagagtatctcaaatggcctgtttagngntggtagcgtatgccgttgttgtaggaattgtctcagctcgtatcctggcgttacttatttacccgatatacctcagtgtctcgttgtgtaatactcttgatagtgcagttttgaaagctctgtaccgtaagcaacagactacaccatatccgctatatgcgtggcgaaacttgganacantgaacatgagtgtggcacgctgagtactcacgaaccaagaacaccattctaacaacaacaaaggcaccccgaaatagagaaacaagaggatagcagacaattgccccagaatgaagggatacaaccacatttcctgaagaggaacaaatgatcgtagggtgagcgtgcagagaactacccattgtgcacagcgtggtagttcacgtgaaccagacgacgcaggtggctttcccatggatgtttccatcactgcacgccttgttgcatgagggaaggtaaggaagtgtccaacgtcacaaaggccccgttgggcgctacaaaactatatactccgtg

SEQ ID NO: 606823 - DNA, 304 bp, Homo sapiens
cgttagatcatggacaacacatcactaccagactcacaagctcagtccattctttcgtctattcataaactctaccatgtaagataacaagccaatagcccgactcttagaacctctcatttcctataagacataagccctgcatatcactccatcctatagctacctatcccccctagaaaacttcctatacttgcatatacccagccccatgaatagcagtgaacggttactacgtaagacacttagtacttactacatacaccataaaaatcaaaactccccttctacccagtagctccat

SEQ ID NO: 606824 - DNA, 424 bp, Homo sapiens
  misc_feature (335)..(335): n is a, c, g, or t
  misc_feature (364)..(364): n is a, c, g, or t
gctgtagctcagtggtctgctttccctggacagcgcggcccatgctagcctgtgacctgaggcactttgaccgggattggtggacagtgcttaagcacagtagacactgggactcctggcgcccgctgctggtgttcatctgaggcggctcgcaggcggtctttgcaggctgagtttcctaacggaatccctggaatgcattacccctctgcttttgctcagaaccccacgtgttacccatcccaaagcccaatgaaagaccacaagaagaacttaaggacaggaaaattgttctttcaagtttgacatcaatccatgacaaccaaaggcaaagnaaagcgtccggtgggtggttgtgcaaaanttgccttcccagaacacacaccatattggagaatgccggcttgctttcctgcagattcag

SEQ ID NO: 606825 - DNA, 93 bp, Homo sapiens
ccccccctcccccctgtgggggggggtttccccccccttcctttttaaaggttttttctttggaaaaaaaaaaaaaagggggggggggtttta

SEQ ID NO: 606826 - DNA, 785 bp, Homo sapiens
ggggccgccgccgtgtgcccccgcgcggccatttggccgccggggggtttgtgggcagcgaattcttgtgggtgagcccccttttcgtaggggttcaccccctcccgtgcttggtgggcaatcccccgtgtggggttttttggtccccgcaggccgcactggttggcacccccacgcgtccttggtggccgcgcgctaccgtgtgccctcgagtcctgttggccacacacggttgcacatggtggccgccccgaggttgcactctttggtgtcgccctcggcgagatggctgctccgtccttggggctggagtcccgcagtgcctaatacggtcgtgtgaacccgtctctcatgtctctccctgtgggagagttaggttctcacgccacgcgcacggcacgattctttcgtggtgggtgagcgacctccctcctgtcgagggggaggcccaagaggggttctgttatttcttccggggagggtctcttctgtgggaggggcccccacggtggtctttctctcccatgggcccaccgctctccccgaggacggtttttctctctccggggggacagagtcggccgttcccgcagggaccaacacctgcgggggtgttaccccgcacgggtgatgccggtagtcgtgtggcagtcggattgtagacgcccccgtcgtggtgtgctccacctagcgtaatccccccccgcatgtatctctccgctggtccctgacacccccatgaagcggcgcccccgttgttccgcgcacaacgatgtcgagcacaa

SEQ ID NO: 606827 - DNA, 556 bp, Homo sapiens
tctgcctaaactacactgcccccatctctcccagcccctggctctgcctttgctgcctcaccccagccagtcctggccttggccctgactgcctgatccaccaagatgggcttcatcctacccatgggtctccaagagctcctcactctgaacagcaaaaggtaatgtttctactctaaaatcatgatgtgtgcatggtcacatacagcccaccatgtccgtaggtgcagcccttccaatctagaaaaagctcagggggagccagagtgcaagtacacggaaagaaccagaacccatgcagagatctctctcaaaaataataacgtgtcttcaactagtgttgttagaagctgaaggctgttagtacaaggacagatgtcagtcagaatcctgtttcaggccaggcatggtggctcacacctgtaatcccagaattttggacggccaaggcgggaggattgtttgagtccaagagctcgagaccagcctgtagaacacagtgagacctcatctctataaaaaaaaacaaaaattagctggatgttataatgcacac

SEQ ID NO: 606828 - DNA, 153 bp, Homo sapiens
gtagaatggggttctcatgtcgtgcaggctgtctcaactcctgactcagtgtgatcatctgcctttgctcccaaagtgatgagattacatggcatgagccactgcatccggcctaattcccttttttttttttttttttttttttttggggaa

SEQ ID NO: 606829 - DNA, 178 bp, Homo sapiens
  misc_feature (132)..(132): n is a, c, g, or t
ctgcatcatcttcgtggtgcagcagcagctatcacatggtcatcggacggcacagacaacgctgcaggaggctctgaagctcttcaagagctctgtacaacagatggtgcgcaccatctctgtgatcctgtncctacaccaagcaagatctgctcgctgagaaagtccttgctgggga

SEQ ID NO: 606830 - DNA, 89 bp, Homo sapiens
  misc_feature (27)..(27): n is a, c, g, or t
ccccaacgtgagatgtatgaaggcttntggtctccctggctgcctccacccactcccagggagaccagttgaataaaagtgcacacctt

SEQ ID NO: 606831 - DNA, 117 bp, Homo sapiens
tggagaggtgctggaaccacagtgcagggcaaacattagaccatgagagaaagtagaaagtcctgtcatgtcacaccttccaacactatagtcttttttctcttttgcaaagtttag

SEQ ID NO: 606832 - DNA, 978 bp, Homo sapiens
gtaggtagcataggctcagtggttcaaagttgagcacctgcatcagtgtactactggctcctgagaagcatgcaaatctgaacaccagttgatgagagttacactctttgaaacccgctggccaggacggagttgctaatttggaagaggcagtggtgacatggtagcatgcggggaataggtaggaacgaagttggggtggacgataagccttttttaagaaaggatcctcttattaatcaggccaacgtgtcaattttgtgcgatgatcctgacagactcatctacttaccgcaatgcctctattgttgcatgatccatggataccagttaggttaacgtggtgacttggttggtatccaaatgtggcacttgttggtaagccgtgtaatgtgccttcttgcccacatatgcctgtatccagctcctgtagcctatatctcccgtaggtgggtcgcactcttctgttggtgcattgcatcctgccatctatcttctcggctgatgtgggatgagcgtggcgtatttgtcccatctgtttctggctgtgcataactaacggatctcttggaggtgtggtgccactgactctcttcatctatgttgctggggatcccctttgccatgtcgctgtgtcggccagacggcgtgttggtggtttggcctttatcatacttggctcactgtgtccatcctatcgtctacgtgatgtgcagtctgcctgtgtccagttgctggtggcccttatgggccagggctgtccgggtggctggggggaagggcctagcaactgcgaagaaatgccaccggacgtgctgggggagtcccgggccaccggcaaggcttgggttgtccccacagggggcacgtgtgtcggccaccagggtgtcccgcggggttaccaaggggggggcgcctccacagtgctctccccgtgcaagaccgggcgtctcgccgagcagctctcttgcccgttcc

SEQ ID NO: 606833 - DNA, 233 bp, Homo sapiens
cagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctggacaggagatgaagtaaagaagatttgcatgcagcggttcattaaaatcgatggcaaggt

SEQ ID NO: 606834 - DNA, 430 bp, Homo sapiens
attctgattgggattgtgttgaatctattgagcagtctggggagaactgacatcttacaatattaagtcttccaacgcataaacatagcacatttctccattaatttacgcctttttttaagttcttttttttcagacagagtctcgctctagcacccaagctggagtgcagtggcacgatcttggctcactgcaacctctgcctcccatgttcaagtgattctcatgccttagctgggactacaggtgcgcaccaccacgcccaggcaatttttgtatttttagtagagatggagttttgccatgttgggtaggctggtctcaaattcctgaccttgtgatccgcccaccatggcctcccaaaatgttggaattacaagtgtgagccactgtgcccggccagagataaatttattatgctggattcttt

SEQ ID NO: 606835 - DNA, 580 bp, Homo sapiens
tacccattttaaagtcagttgattaacaaactgcatttcgtctgcaaccttaattcccctttgcatgtgaaacatgtctccgcttccattcattaagacttggaccttgttgggagtctatttttctacttagcacactcaccttcaattatttccctgcagtcatctgacttgtactaagtaataaaaattaacatatgctcggcgttgaatatatttttccttatggtcactggtagctttcctttctaacaaagtgcagataaggaagttaaaacaaatgagtgatgggagtggcagaggaaatacgttcacctgtgtagtaaaaggtttgggtgccaaagtcaggtttcagttcagcttaataatttaatgcttaactaacacttcagaaactgactctatttgtctgtcttgattcctgtgagacattttaattcatcttgaccaggaaaaggtatttaaggacacaaaccttcattccacagaatatgaaaacccaaggattttaaatgtatgtagtttcctaaacagatttcaccaggtgcagtttatgtgaaatgtctaagatagaaaaaga

SEQ ID NO: 606836 - DNA, 252 bp, Homo sapiens
cgagtatcttgcatcttgcgtccatcagcttaacatcctttctacaggctgaactcactcaggctgatagaatcaaaattcttacaaccaaatcagacaaattcaaaatcgtaaacccgtaagaaaacacattaaaaacggtgctgatgggagaagatgcgcgcatcttcgtcccatcaggtatttctatacattgacctcgttgttggttatcaaaaaaagcagtcaacgagtctgatgggagcaagatgg

SEQ ID NO: 606837 - DNA, 279 bp, Homo sapiens
cggctggtggcacgattttaccaaccctgcgatagatagcttgagttaataccttcgctatactagcgcgagtgttaactctctgctgtttctccgtgagaggtgtatcttcgctagtcgatctgcgcggctttgttcctgtgctctatgctccgtccctatcaagatcgtcgttactgagaccctgctgtcgctggaacggggatgcttgcatgtgtaatcttactaagagctaatagaaaggctaggaccaaacctatagtagaggaaccggcagta

SEQ ID NO: 606838 - DNA, 189 bp, Homo sapiens
ccgctttggccaggggagaaggagcttccgtgggttttccctgggccccgtttcccgggttgggtctcccctcccttcccgggccgggtgccatggccaggaggtaagggcctttttgggggcccccccttaccctttttttgaaaaacctggtttcgggaagggtttgataaactcatttactctcca

SEQ ID NO: 606839 - DNA, 182 bp, Homo sapiens
cagtgcagcttgaatgcctgttggtctgaattctagagttatccccgggatcgatgagaagggggcttgacacccttagtttactgcctttcaacacaaggacaggagagggaaaaaatatcactagacaccagcagggtgagccattgttggacagtggtgcactcgatggctgcatgtgt

SEQ ID NO: 606840 - DNA, 663 bp, Homo sapiens
  misc_feature (642)..(642): n is a, c, g, or t
ggagacgggggtctcaacagtactactacccattaagtagtggcaacaaatatttatccttattgggcagagggggaaactggggccaagggggtaaggtgactgggccatatcacatatttatcaatagaccatataagaataacgcactggatatcaatttccggaatccaagtgctctttgcagggggcagggggggggatgaggggtacggaatgggagaaaaattatatacataatagagggacaaggaggaaaagcagcaacagagacaggtaaagtcctcaaagggaaaagtaattccatgaagaaacagggtaaatccagccacatgggatggtatcacttttatacatatagaatcatagatgggggccttagatagcataaagtccaaccacatctaatagatgaggggtagctggtaatttgtaagggtctggagcttaaatggcggtctatttaaagatggttccctggaccacattctcaaagggaaatctctggttacaatattcatatacggtgctcagcaaacatattgggaatggttgactgggaagacattaacctggatgacaggaaaaattgaatcttatgcagagaacctaggatttacctaaaatagttttcaggggaanttattcacctaattagatgca

SEQ ID NO: 606841 - DNA, 221 bp, Homo sapiens
cattctgcactaagaacgtttgtatttccttttatttttattttttattttttactgagacagagtcccactctgttgcccaggctggagtgcagtggcacgatctcggctcattgcaacctctaactcctgggttcaaaccattctcccacctcagcctcaagcttaggaaaggaaccagcttcccattacaatcaagattcttattttcactttgggct

SEQ ID NO: 606842 - DNA, 1380 bp, Homo sapiens
gtttcattagtaacgggattcttctgctacttcggccggagatattttatacaggtcttgttgatgaccactgttgcacactaagaacatgtgttagaaaaagcggttgtcccagatatttcccggtcgcgtggaataatataatatgcggtggggggaatcttcttgttgacaatagggatcgtttctccacataggggggttcggcgcgacatttcaagtgaacgccctttcggtgaacaatggtaggcgggggacttcggttgggttccgtgttccccggtctatattggcgcgtttcacgccggcctcctgtttgtaaatgggggtgttggcctgtttcctcttgggctgcgacagggggtgtccctcatggtctcctgtcatacacctccttctccgctggcgacatggttgtttcagaagaagaggaaggcgggtggcttaacattttttctaaagacggggtgttgattcacccacatattgttccgccagaatagcacacaggagaaagagagttttgttgtcgggggttttcttcaccaggacgtttcttggatcacagctctaacgctcccacgctagtgatcaccattataagggagttctgcacaacacacacaacaccatgcgggggggttttttttggaaaacaaaccactaggtttgttttctctcggaggggtagaaaagccccccatcttatactgattaagaggtgggtaaaggaaagagggggtttatgaattgtggcgagaaaatgtattattacccgcccacacacggggggggccccgcgtgaatataaataaggggctcccacacacaaatatatcacggcggggcgtttttttcccaaagagcaagagcatttttctcgccaaaaaatttcgtatgtctcctcacaaactttcatatagaggaggggaggggtttgggggtgtttccaaaaaatgttatatgggagtgttataagttcaccaggggggggtccaccatcacgcggatcacagagccgtgtggataaaacaaaagtggcaagagtgtttactacaatgccatgacgaacatattcctctgggccggtgtttaacatggggcgccgacaatgcttcttgttcaacagagaaaagcgataaaaatggttgtccccacagtggatctttgtacttgttcaaccgtgggacattaggagagtgatggcgtcgtcaaaaaaaaaccaattattgtggccgccggtagtaaccagaagaatgttcgaggaaaataacccctggggaatcaaaaaaaagggaatttttttttgtaaaaaaaaccacccccgcgtgtaggggggtgggaaaaacccccaataaaacccctggtgtgtgtgatata

SEQ ID NO: 606843 - DNA, 1097 bp, Homo sapiens
ctccagcctgggctcaaaaaagaaaaaaaaaaaaaaaaaaaggcccgttcattctcaaattgctttgggcgtctccagggttgcctcaggaaaacttgaagtgtgggcatttgttaaaacttgtggggctacgtggtgttaactttgtggaagaaaaaagtttaagggttactttttaagttggattacgtgtttgtgatgaaatttgccaactttcagggagccccagcttgtggaaaaggagggacgttgagttattctcctttacaagggctctccgaaaacaattctctttctctttcacttatagttttctctttctcttggtgcctcgtgcattcttatattattctccagcaggggtctctttccaatgtgccattgggtttaattaacttaccagaaacctgtggcccaggtgtgcaggtggccttcacgcccgtgttaattcccagaaactttgtgggaaggcttaagaaccaggcagaattcaccttttgagggccagggaggtttcagagagaccaggcctgtggaacaaccattggtgtgattaccccagtttctcttacttaacaaatttcaaaacatttaggctcggggcatgtgggtgatgttgccacctgtgttatctccccagctgtgcctccgggaagcgcttgaggccaggaagaaaatccgcttgtgaaacccccgcggaagacacagagcgtttgccaacggaacgccaagaacttggaagcccacgtgggcctccggcctgtggggtgtgaccggcgaagacctcccatcttcaaaaaaatttaaacttttaccaaaaaaaaacttacttacaactaaacttttatttcacccctttgggaccctgggttttacaacaacacacatattataaaaaaaaaaaaaaaaaaaccaaacacaacaaaacaaaataaaatcatccacaaaaacacaatcaaatacaaaaaccaaaagcaaacagaatacaaactccacaaaacatcactacaatcaatataaatttttccttctaaacaaaaacaaatactcaaacaataacataataaagcacaaacacataatgtaatcatcgcact

SEQ ID NO: 606844 - DNA, 429 bp, Homo sapiens
ggcaaccacgcatggctggcgcagaagaggttgatatagtcctggtttctgttggagtggtccctgtgtgtcatcccctcattctggcccagcaggaagaagagcagttggtgggacaggcagtagcctgaccaggcgggcttggtcatgaggctcctgcagagcgtctgagaggccgcagggctcgctgttgtccgtcccggttcccagtcagctgcaccaggcacacgtcactttctctcctctcacaatgtagtcctggggcccgcaacgtgtgggtacacctatgcgaggcatcagtgtgtgttcccggcatgctcggaacttccggaacccgtgcgtgcattgtcagctggcaatccacgtcatgccactgtcctcctggccttactggtttgcttcctgttttacgaatcattggatcatcca

SEQ ID NO: 606845 - DNA, 303 bp, Homo sapiens
  misc_feature (8)..(8): n is a, c, g, or t
  misc_feature (26)..(26): n is a, c, g, or t
  misc_feature (95)..(95): n is a, c, g, or t
  misc_feature (228)..(228): n is a, c, g, or t
  misc_feature (278)..(278): n is a, c, g, or t
aatgaggngcctgtcccccgggttcnccctgggctccaagcctgctttgccttctgcctccttttgcacacgtgatcacttcagaacccagcagntcttcctttgtcctcttctctgtttctgcttttccatccgtgctgcactcaaccaatttcacatgtgttgtctttgcctgaatcatagcagtagcagtgaaatccctgcttatctttctccccaatcccagtntgtgctgaataccatggccatattcatctcctgaaatattattttcactntgatctcttctcaccctactactat

SEQ ID NO: 606846 - DNA, 1620 bp, Homo sapiens
  misc_feature (82)..(82): n is a, c, g, or t
  misc_feature (162)..(162): n is a, c, g, or t
  misc_feature (239)..(239): n is a, c, g, or t
  misc_feature (276)..(276): n is a, c, g, or t
  misc_feature (325)..(325): n is a, c, g, or t
  misc_feature (559)..(559): n is a, c, g, or t
  misc_feature (617)..(617): n is a, c, g, or t
  misc_feature (658)..(658): n is a, c, g, or t
  misc_feature (899)..(899): n is a, c, g, or t
  misc_feature (1041)..(1041): n is a, c, g, or t
  misc_feature (1066)..(1066): n is a, c, g, or t
  misc_feature (1126)..(1126): n is a, c, g, or t
  misc_feature (1140)..(1140): n is a, c, g, or t
  misc_feature (1166)..(1166): n is a, c, g, or t
  misc_feature (1201)..(1201): n is a, c, g, or t
  misc_feature (1231)..(1231): n is a, c, g, or t
  misc_feature (1257)..(1257): n is a, c, g, or t
  misc_feature (1306)..(1306): n is a, c, g, or t
  misc_feature (1324)..(1324): n is a, c, g, or t
  misc_feature (1333)..(1333): n is a, c, g, or t
  misc_feature (1370)..(1370): n is a, c, g, or t
  misc_feature (1393)..(1393): n is a, c, g, or t
  misc_feature (1401)..(1402): n is a, c, g, or t
  misc_feature (1410)..(1410): n is a, c, g, or t
  misc_feature (1426)..(1426): n is a, c, g, or t
  misc_feature (1428)..(1428): n is a, c, g, or t
  misc_feature (1452)..(1452): n is a, c, g, or t
  misc_feature (1474)..(1474): n is a, c, g, or t
  misc_feature (1508)..(1508): n is a, c, g, or t
  misc_feature (1520)..(1520): n is a, c, g, or t
  misc_feature (1551)..(1551): n is a, c, g, or t
  misc_feature (1553)..(1553): n is a, c, g, or t
  misc_feature (1618)..(1618): n is a, c, g, or t
aaatcaatatatattcacatcactctaattaagacgcaacacacaccctaagatgctctctaccgtaacttcgtaatatacntaccacgtcctctatgtggcgatgcagacagctcatggttataacatctgatgttatccttctacacaatcctccacacngcaatgcagtaacacgacatacacagatgataataacactatactacataatggtacgacatttaccacagtctaanatccctctcaacaagtcatacatcacgaggagtaacntgctcccacgctttatctttatttgtctctgtcacctcacacacacaanccacacatcctattctaatcaatgcgtaaagcaggtattattgattattatttctattgtctctatacatacataaaatatatcggccagccgtatcataattatctttactcgttgaccttcgatctcacccgaccgctccgacaacaccagatgacaatcaatatatacatttataacaattaacaccctatgacacagaatatattttccacaatactctcgactattttnacccacttgattataaccccaatctctacgacacacgtcacgccattctcacctgatntacgccagtagacgctgtatcataccacatatatcaaaccnatatcataatgaggtactatctattattatatctagtattagtctctcgatacggtaatggtacacccgcctctcacctacacaatatacagtatccacatataatcattataatttatactcttactacatatccccaccattatttatatagtcccctcgcccatcctatacattcactggtctgtatctgatagtacttcgcagtactccatcatcacttcataccatgctctcatanattaagcattcgaacatgaaaatatatactaccgccacctcacgctctactagacccaccacgagtctatttattgcttagacacatccagcattatctacatacatattccatctatgattagatacaaacgatacgctantatgtataatgaagatactattcanctttaatctgcatactatcataagttcagttcgatccgaacgcacgcaacttactattancttgtatacactanagcgtctactatagtatgacatacanacactccatctatctacgtgtaccactatagcatntatagatacagatcatagactgacaccttncagtcacatgtaactacgcttcgtgncaccataactattgtataaattactattctaatcgaagagatatctgtnatatataccacatgtgantcacactantgtacataactaaaattaaatatataagacaccacgntctcacgtagacgagatcactcngcagtagnncacacgtnatgtttttaatatatntnaatatctatatatatcattgacanatactcacatattagtccatcnatcaatacccgttgcgaaaatctaagatatattnactcaacatacntacatactctcttctatacagcttaccagtnanatatagatactacaacgacacaactacattacacctaacatcgactatacgatatcgcatagacnag

SEQ ID NO: 606847 - DNA, 256 bp, Homo sapiens
  misc_feature (24)..(24): n is a, c, g, or t
  misc_feature (102)..(102): n is a, c, g, or t
ggggggggccccgggccccccttnggaatgttaaggcaaaaatccaaaataagggggggcccccccctgttcaacaagggttgttttttttggggaaacagngggaaaaggggggcccccggtttgtttccaacatccaaaaaagggcccctttgccttgggtccggggcttaggggggggggtttaagtttccccttttaggggttccacaaattttctgggcctttcctttcaaaaagggggggggtttcccca

SEQ ID NO: 606848 - DNA, 376 bp, Homo sapiens
agattacataaggtgaaccccttagactgaaataggggatcaataaatgcagatttccctcctcaccacccactccaacttaatatgaaattaatgctggccgggcacaatggcttacacctgtaatcccagcactttgggaggccaaggtgggtggatcacttgaggtcaggaatttaagaccagcctggccaacataatgaaaccccatccctactactaaaaatacagaaaattagctgagcatggtggcgcatgcctgtaatcccagctactcaggaggccggggcaggagaattgtttgaacccaggaggcagtggttgcagtgggctgagatcatgccactgtacttcagcctgcaagactccatctcaa

SEQ ID NO: 606849 - DNA, 191 bp, Homo sapiens
gtatttgtctgaagaacagttaaagcttctttgctttggatggtggtagctgactgtttcttaatcttcctactggtgtcattaaaaaaaaaacaacagatgttatactgggttatactgggcagagtgggggatctggatctgggcctcgtgccggatctgggcctcgtgccggatcttggcctcgtgcc

SEQ ID NO: 606850 - DNA, 711 bp, Homo sapiens
  misc_feature (236)..(236): n is a, c, g, or t
gactgaccgaagaatcctttcaagctcttcctgactttcccagtcctttggttggtgggtatctgcccaagtagcgttgggatcagtctcctgtcttatgtgggcagcgttccaaagttgtaaatggagtgtgttttgactctggcgaccaaaatttaggaagatagcatgtgaaatatcatgttcgtaacttgtggtcacaactacatgcaacagaggagaacaagaccttttgntccttggaactctcgttgcgcttcggtgcagagcctgtgtccgaaggcgaacacgtacatcagaacgtggttacctgtgttaactgacgaggtcagcttcgagtggccagtgtcgaagctggttctcgacgggcatacgctccagtgtccttcctagacattgcctaggtgtcccagaaggaatagcagacaaagccagtttcgaactattcatggtaagcttgatctcttgttctaaattgtcggaccaagggggaccttgaagaatcactaagttgattcaaaaattgtggatgttgcgtacgaacttggggtagtcgtgccaaggaacgattggcgagggagagctcacgtaatatggaatccgcattggaggtcttcgcaatgtgttggtgcttctaaccgaaacggtaattgccaagaaagcttgacatgaaatttttgtgaaccatcgttaattttgcttatcgagggg

SEQ ID NO: 606851 - DNA, 214 bp, Homo sapiens
ctgaaatcgcatcactgcactccaggctgggtgacagagtgagagtctgtctcaaaaaacaaacaaacaaaaaaaaagtgtcagtttcccttgtggtccctctctcctggcatcttgtgaagaaagggtgcttgctttccctttgccatccaccatgactgtaagtatcctgagggctcccaggcattggactccggagacattgcactccggg

SEQ ID NO: 606852 - DNA, 421 bp, Homo sapiens
  misc_feature (13)..(13): n is a, c, g, or t
  misc_feature (387)..(387): n is a, c, g, or t
  misc_feature (397)..(397): n is a, c, g, or t
  misc_feature (419)..(419): n is a, c, g, or t
ataaatgtctganaaatggtaaactcgctatgaatcaaatattattaatcaaacatttccagtacagtaatggtatagaaagtgcattccaggaacaaagtgaaggttctcttaatctctcacccagaaacagtgaactaaactcttgatcagcatggttttaaatgtgggaaggaaattaaacacatgtcccaatgtgtgtatcttgtgattctgcctccagccaaataatgcaaaaatgtggcacctgtttttattgtgttactttctttgttgacagtttttattttctaaaaattaccaatatttggagaaagaaagtgaacacaaaaaaaaaagcaaatcagtattctgaatgtagcacagttaccaacagcagcattttantctctgaaanacgttgtgccccatgctgctgnga

SEQ ID NO: 606853 - DNA, 117 bp, Homo sapiens
accctggggtggggcggggggggcaacattataaaaaaaactggaagggaaaaaaaagggaggggggggggggtcttttctttctgttgctgtaaaaaaagttttttgtccctctca

SEQ ID NO: 606854 - DNA, 713 bp, Homo sapiens
  misc_feature (17)..(17): n is a, c, g, or t
  misc_feature (188)..(188): n is a, c, g, or t
  misc_feature (225)..(225): n is a, c, g, or t
  misc_feature (235)..(235): n is a, c, g, or t
  misc_feature (249)..(249): n is a, c, g, or t
  misc_feature (254)..(254): n is a, c, g, or t
  misc_feature (320)..(320): n is a, c, g, or t
  misc_feature (367)..(367): n is a, c, g, or t
  misc_feature (414)..(414): n is a, c, g, or t
  misc_feature (431)..(431): n is a, c, g, or t
  misc_feature (435)..(435): n is a, c, g, or t
  misc_feature (567)..(567): n is a, c, g, or t
  misc_feature (605)..(605): n is a, c, g, or t
  misc_feature (630)..(630): n is a, c, g, or t
  misc_feature (660)..(660): n is a, c, g, or t
  misc_feature (684)..(684): n is a, c, g, or t
ggaaggggaagcatganagggaggtccacttttgtggactcaaaccttgatggggatgttgagcagtgacaacgcttctgagagaaggcacaagcgccccagagattcaggcccggagaacaggctggctcagcaggtcttcacgatcgggtgtttcgagcccttcttcgggaacgagggccacagcnggagcggggcatgggacccaggccagggggtgctccngggggtgggnaaccacactcgatnggggnccagggggtcccggctgagcggcacccacactgcagggacgatggcggcgcactgtgagggggtgnagccgctgtgtcaggggaggctgggacccagcggtgctcagtgtgangggaacgtagctgggtgagcgggtgcgggcctgggacccgcgcgctngagaatgtgagcgcgangagnagcctttgctgcggcgctgccagagcctgagagcactacatgccgagcactgccgcgctccaaccgacccagagccaacgccagcgggtggcgaatgtggctgcgatctcggacccgcatcttaagggtatnaggaggtagctggggcattggggaaggcgctgggagcnctacagaaccagctttccggtagtnctccatcctgcttgctgttttgtttgttanttttgctgcccacgaagccgcctnaagcacgaaccggagccaagagggcgcgc

SEQ ID NO: 606855 - DNA, 132 bp, Homo sapiens
tacaggactggtggtgtaaaccggactgtagtgtgttaatggatttaatgggcctgagatgggggtgaaagaaacatagcagtgattagtagagctgccaaggagaccaggtatatcatcaactagccgtgt

SEQ ID NO: 606856 - DNA, 106 bp, Homo sapiens
actctagaggaccccgtcaatttctacacttaaatataaaaattaaaagttaaactctagcccttcagtgaaggagacgtaaaatggcgtgggtacaacaactacc

SEQ ID NO: 606857 - DNA, 881 bp, Homo sapiens
aatactacttggaggaattcttctactaattgtatttaatgtggaaatgtatagtttcattgatttaatcataaataatggaaatggtctccaagaagttttatttttcattttttgcttatacactctgattcctataatacagtgctataagctatgcacagaaaataaaatgtttgaaatccaagaataatggttcttactgctaagagggagtaatagttattactaatgattttgatgggttgcattttgttgcaatgtttattccacttgcagttagaatatgaatatgttttatcactagtgtggctaaataaccaaacattgtgtaaaaaaaaaaaaaagccaagatttcatggttggtggaatatttcttaagcatcgggcccctaaagagaccgtttcttaccaagccggtaaactatggctggagggaaatcctggtatttaattaggaatggtgttggtttactcaccacatctgtggaatcatggtataaatgtgtggttacaaactctggtgacttgtaatttaacttaatctcatctaatgtaaatatcagattctgatgtcagtaacatcttccataggtataactggtgtcattatagtttcagagtactctgagtaatcaaatgggtaaagcggttgagtacatagtagattatacttatggatacgaattacacacggttgcgggtggggtcaggttcgagaagcagcttcggatgcgggttagataaagttgttgggggaaggatcaccagcgaggggttatacctggccagattgcgtgtttggtccaaccctttttgttttccaaatagtaatgtatcagcgggtagtaccccgaggggatggccgcttttatatcttt

SEQ ID NO: 606858 - DNA, 818 bp, Homo sapiens
  misc_feature (45)..(45): n is a, c, g, or t
  misc_feature (47)..(49): n is a, c, g, or t
  misc_feature (51)..(52): n is a, c, g, or t
  misc_feature (67)..(67): n is a, c, g, or t
  misc_feature (71)..(71): n is a, c, g, or t
  misc_feature (73)..(73): n is a, c, g, or t
  misc_feature (81)..(81): n is a, c, g, or t
  misc_feature (115)..(115): n is a, c, g, or t
  misc_feature (128)..(128): n is a, c, g, or t
  misc_feature (131)..(131): n is a, c, g, or t
  misc_feature (140)..(140): n is a, c, g, or t
  misc_feature (149)..(149): n is a, c, g, or t
  misc_feature (155)..(156): n is a, c, g, or t
  misc_feature (161)..(162): n is a, c, g, or t
  misc_feature (172)..(173): n is a, c, g, or t
  misc_feature (196)..(196): n is a, c, g, or t
  misc_feature (198)..(198): n is a, c, g, or t
  misc_feature (240)..(240): n is a, c, g, or t
  misc_feature (249)..(249): n is a, c, g, or t
  misc_feature (326)..(326): n is a, c, g, or t
  misc_feature (342)..(342): n is a, c, g, or t
  misc_feature (350)..(350): n is a, c, g, or t
  misc_feature (356)..(356): n is a, c, g, or t
  misc_feature (618)..(618): n is a, c, g, or t
  misc_feature (639)..(639): n is a, c, g, or t
cgtttgggccagagaagtggatcgccgcttgcgccgcatggagtncnnntnngaaagcggggtgtgntgananccccccantggagaccctaagcttcctggtgatgaagagatnatcgaggtggtanaanttgatcccnggtcctgcnggaccnngatgnnctggcccagnnagatggaagatgtggactttgangnaagaagaggaggaagagggcaacgaagagggctgggttctangaacccagngaaggggtggtcggcagcatggatgggccccgacgatagctgaggtcacctttgcattgcactcagcatctgtgttnttgtgtgagcctggancccaagancaatancttgtgcatgttgaccgggggtgaagatgacaaagccttcgtatggcggctcagcgatggggagctgctctttgagtgtgcaggccataaagactctgtgacttgtgctggtttcagccatgactccactctagtggccacaggggacatgagtggcctcttgaaagtgtggcaggtggacactaaggaggaggtctggtcctttgaagcgggagacctggagtggatggagtggcatcctcgggcacctgtcctgttggcngggcacagctgacggcaacanctggatgtggaaagtcccgaatggtgactgcaagaacttacagggtcccaactgcccagacacttgtggccgagtcctccctgatgggaaagagagctgtggtaggctatgacagatgggaccatcaggatttgggaacctgtatgcagggaaggcctagtcagtgtactgacacggga

SEQ ID NO: 606859 - DNA, 466 bp, Homo sapiens
  misc_feature (4)..(4): n is a, c, g, or t
ttanaattacggttccagctaagccacagtaaaataagacaaacgggagattcctaaagtccctgatgccaggcctttgctactggaaggactttctagacctgccggaagccataagggaacacgctgccgcaggccttgggtgaaacacaatattgtgctggcttcaggtgtgacccagcacagtcccagaggtggtggccataggagagcttgtgtcacccctaccccaactccaggcatcacagcacagagggagagactccatttgttgagggcgggaggttggggggataagggaagaaaacaagagattcttcctggtaatctggggtgttcacctgtatcttaaccaaaaataccaaagaagtacttctagaactccaaaaaagttacagcattactgggcttgggatgccctctaatgcatatgccccttaatgctgcagtgaccaaagacttagat

SEQ ID NO: 606860 - DNA, 1035 bp, Homo sapiens
ggtgctatgggggcttctagactcccctgtgcgctcttctggtatcgctcgggctgaggtcgagtgaagaaggccctgctgagaagctcgagaactacctgcattctgagacgctgcaggtgcgcgaggacgctactcagtgctcagcagagcctggggttccaccattgacatagaggtctaccgggatccgtgtatatggcttggcgtcccgactcaaggatgcccggggttgtctccttccttgtgagctacatagaccaggaagaagatccacaatgagtttgccagataaaccgctgaccttgagtatgtgcggagtgaccccttggacaccatcgagcactgatggagtatcgacgcgggaagtgtggtggccgtgagtgtgtcattgtgaccccgaaataggctggattgacgggaggctgtggaaggcgtgctattaagcagggcaccggggaccaggtcctggcggaggcgtatgagtgtccatgcattgggggttgctgactagggatggaggcgtctgagcatgctgcctagacatatgcggccaggacttggctggaaatgaatccgcgaggtagattttggggtccttggctgagtgccctctggacctaagctagggacacctccacagttggaagggatgcactcgtggaacaacaagctcgaacgggtgtgcatggatgtgccggcttgagtgatctcagaccggatggacggcggacaggtgatgtagggtcgatagaagtcggggagactcgctggtcacgatctctggtgacgcagataggggcagtatcagaggtgggagaggctctataaaggtaccacaccgccttggtgagaactacaaagaaaccccagggtatgttgtcagtgcgacacccatgaatttcataaaggtgactggcacttcttggtgggaacgcacgatcccggtaccggcggaatccccgggatctccttttgagttgccagctcaacaacttgggttacaggcacagggcctgcacggtcggtcacatg

SEQ ID NO: 606861 - DNA, 1395 bp, Homo sapiens
cttctaaaacaccgcagagatgctcccctagcaagctcaccgatgcacttgactttccctgaaaatgagtggaagggtcttggtgacagagatgacacctaacatacgcgtgcggttacatgtcgccgctgaatgctaggtcgacgtagtaggccgaaaatgactcgtgtgaggtagactgaccacgcgtcatgaccaaagcatagttccaaaagagcttgagtgtcatacttatcgaactcgggagtcgtcccccaaactagacatcttgcacgaacacattcagtcgtcccgttcagtcgaaaagctctagctcaccgtcgccacgacaaagtcatccctggacaacaacaacccaattattgaggaccgcggtaaatcggtgagatcgcaccacgcgagagagactcgaggcaagacattaacgcattaatgtacatctatgccaggcatttcaccattagtctactaagacagccctgagtacgctatgggaaccacacgcgatctccgtgctaggtcgacaccctaacacagcggcacattaccaaacagaagccgcggaaaggtttgacagaggttaccacagcgcaacgcccgttgaacagaattgcccaaggagcgaaatgaggtattaccttagtcgcccaagagggctctatcgaccacgagttcgcgccacctcgggcaccgttcgcacacaccatcttcaaattcaatccatagacactttgggccacgtgacccttgaataatacagtttgggtaccgaccgttgacgcgacaagtgatgttcttgtacgccaacaaacgcgcccgcgtttgtcgcgcccaggttacatttgggccacgcgccaaagaaagtttttctatgggactgccaaattggcaaccattgcagagagaacgcagggaacaagctgcgtttatgtatcaccagagagagattcccaactttaggccgagtgacactgattgcataggagcattggcgttacggcacaaaggcgtgtgtacatttgtcgcacacacaaagcgggaaaaaaccaggaggcaaccgccggaacaactggacgatcacagcattgaacgagaccaattgatccctctgaaagcagatgccgataatttagcacggccgcttcatcaggaccacaccctcaaggccacgagataagaacataccaaaaggaacacatcacaccagcgtggacaaggagtcaaggatttcacgccgtttgggaaaatattcaaccgaagacaacgtaccagattcatttagtcacagccgaggtagaaaaaaccaccattggataagagaaaccagattttacgcgatctgtaaaccaacaaacaaggaagccgaacatcagctaagggaacaagagaaccacg

SEQ ID NO: 606862 - DNA, 505 bp, Homo sapiens
  misc_feature (237)..(238): n is a, c, g, or t
  misc_feature (241)..(241): n is a, c, g, or t
tttgttgttgtttttgctttgtttccttttttagaaagttctagaaaataggaaaatgaaaaatttcattgagatgagtagtgcatttaattattttttaaacacttctttaagtacttgaattttatatcaggaaaacaaagttgttgagccttgcttcttccgttttgccctttgtctcgctccttatctttttttggggggagggtaaaatttttttttttttggggccttttnnttntattcttcctggcataatttccattttattcttctgagtgtctatgttaacttccctctatcccgccttataaaaaaattctccaacaaaaatacttgttgacttgatgttttatcacttctctaagtaaggttgaaatatccttattgtagctactgtttttaatgtaaaggttaaacttgaaaagaaattcttaatcacggtgccaaaattcattttctaacaccatgtgttagaaaattataaaaaataaaataattttag

SEQ ID NO: 606863 - DNA, 471 bp, Homo sapiens
gcatgacctttgctgagctgctcgccctgcgttctgtcgtttgttcatcattcattcatccgaaatgctcgggactggaagcacagtggaaacactgccccaggttctgtgctcggcattgagggtagaaagacttttcgaaggtggcagggtgtttcttaagatcattgacccttaaaatgaaagtgtaggccgggcgcggtggctcacgtctgtaatcctagcactttgggaggccgaggcgggcggatcacgaggtcaggagatcgagaccatcctggctaacacggtgaaaccccgtctctcctaaaaaatacaaaaaattagccgggtgtggtggcgggcgcctgtagtcccagctactcgggaggctgaggcgggagaatggcgtgaacccaggaggcagagcttgcagtgagccgagatcgcgccactgcacttcagcctgggtgacagcgagaatccgtctca

SEQ ID NO: 606864 - DNA, 219 bp, Homo sapiens
aataccttttcctcacaggtttctactccagagatcatatcatcgaccccgcgtacatatcatacacaaacgcctgatccctatctattactctcatcgctaccaccctaacaagcgcctattacactcgaggaattctactcaccctaacaggtcaggctcgcttccctagccttagtaacattaacgatcatacccccaccttataaaccccattaa

SEQ ID NO: 606865 - DNA, 152 bp, Homo sapiens
gcaatgtcatgacttacttagagcagcttcatctgaggacagaaaagtgtgttccttagatagatctagacgcccaatccttagatgtggttagctcaggtagctgtctgaggtaaaggtccatgaaccatgccctattgttggtatcagcg

SEQ ID NO: 606866 - DNA, 307 bp, Homo sapiens
cccccccccctttccaccaaagggggggtgggggtttttggggggggtttttttaaagggcttttttttttcacccccccatcccccggggggccccctccccttttttttttcccttttttaggaccccggggccccttcccctcccgttttttttcttggggggggggggggtttatattttccccgggggaccggttttgccttttggctttttcaaaaagtttttttgggggcccttttgggggtgccccttggggttccggtctgggttttccgggtgggccccccggttcggaaattaata

SEQ ID NO: 606867 - DNA, 124 bp, Homo sapiens
gacccctcaaggatgttagcgacactacgctccttatgaccgtccactgtgcttcgggcgtccttataactatgctacctcagggttgaaataaaatgagctatcgagagcctagattatctcc

SEQ ID NO: 606868 - DNA, 341 bp, Homo sapiens
  misc_feature (143)..(143): n is a, c, g, or t
ggcgactttcaaagggtattttgcccttgggggcactccaccatttttgggtggaaaaaatttagcccttttccctttggaaaaaaaaaaaaaaaaaaaaaaaaaaaaaaaaaaaaaaaaaaaaaaaaaaaaaaaaaaattgngcggcgtggatacttgggttactttcaccattggctgctgtgaataatgctgctacgaacatgtgtgtgcaaatatctccttgaaatcctgattttcaactgttttgaatatgtacccagaaatgagattcctggaccatatggtgattctatttttaattttctgaggaaccaccatactgttttccatagcggccg

SEQ ID NO: 606869 - DNA, 113 bp, Homo sapiens
caccaaggtcacagagacagtacctggcactgatttcttcaacccaatctcacaccccatgggaacgaggtcatcaatgcaggaagaaggatggatatggtactccagatcat

SEQ ID NO: 606870 - DNA, 144 bp, Homo sapiens
ggttgttggtcgcagcatcagtgtggttggtgctgtggtcggcactgccaggttgaagggcatctctggggctttggggaatttcagtgcgtgggtgagccaagcaacaatcactcaattaatcaatcagtcaagttgttcagt

SEQ ID NO: 606871 - DNA, 614 bp, Homo sapiens
gctataagacaaccaggactgaaccagggagccaatctgttgtctttgaacagtaaatcaggaataccaatggaccagaatgaacacagtcactggggaccacggatgctagagggccaatgtgcctagtcagatctgagctgagaatcatcctggtgggcgaaacaggaactggcaaaagtgctgcatgggaacagcatcctcaaggaagcaagcatctgaatcgatgctgggttcccagatcttgactaagacttgcagcaaaagtcagggaagctggggaaatagagagattgtccattatatgagcacaccagagtatgtgtctactgtgtgaaggagccactgtgaagctctgtccaaagaggtgcagaggtgctcacttgcatgtctgcaccaggaacccatgtgctgttcctggtgagtcaagctggggcgatatacctcagaggaacagtaaggctgtcagagggtgaaaggcgatcttgggagaggatgccgtgtggactcgtaagggtcctctttaaccacaaggaagacctcaatggtggtccctgatgggagtacatgctcgatcagataacaaagcctaagcaagctgtgcagcatgtgtg

SEQ ID NO: 606872 - DNA, 115 bp, Homo sapiens
  misc_feature (4)..(4): n is a, c, g, or t
gtanagagctcatcccatactagtctgtgattccagttaccctttgagaccctaggcaactctccttatctttcaggcagaatagtcactgcagctgggctcctataactcagtc

SEQ ID NO: 606873 - DNA, 140 bp, Homo sapiens
gcgtgactgctacactgtggtgggaagatgctgataaatttgatggttctacacagttaaatataattgtgattttaattaaggtgcacaatattataagaacttcaaatggagacctgatctggtgcttgtggtggtgg

SEQ ID NO: 606874 - DNA, 582 bp, Homo sapiens
acctgctagccattggctacgaggaggaagcgtgcagtcccatgtggaaactgaaaggccttgtttccagcgacttaattcaagataagttgaagcagtcaatgcctttgtgggggatcggtgtgaatcatctaacgggtacctgcctcgcacagaatggggaacgaattcgcgtactcttgggccgatcacactgtcgcgcagttcttaaggccatcgctgtccatcggtatcattatggagtcctttccgcaaccctagcgcagttcgatcctgttaccaagtcaggccactcctctcagtccagatgttcctctgcgctgggatagcttaatgtccttgtgtgacgcgtacaggggccgcccagcccgtctgaggaagcggccctcccgactgtgtcagaggagcctgggtcccgaggggacaaggaagcgtgggttgcgccccaccccgttgagggagttcctcttgcctcccgtacccccggggattgtatatagattataaatatataaggggaaaggggtgagcggggaggggttctggggctggggcctcactttcccctcctcccccttcccc

SEQ ID NO: 606875 - DNA, 354 bp, Homo sapiens
atactgaaagacccagatcatcataccagggccagatactaccttctcagacattgacagatccagatccttctatttgtgccagatcccacctcctcagacatggacagacccagatcctaatacctgcatcaaatcctacctcctcagacatgatcctacatgaacagacccagatccttgtatctgtaccagatttctaccttctcacacatggagagacccagatcctcatacctgtaccagatcctacctcctcagagatggacagacccagatcctcacatcggtatcagatcctacctccagacatggagagacccaaatcctaacacctgtaccacatcctacctc

SEQ ID NO: 606876 - DNA, 157 bp, Homo sapiens
gatatcgcgtgcatgtgcaatgaagggcgtgttggtagacattgtgaatgcagcacagatgaagttaacagtgaagacatggcacgcctgatagctttaaaattaggcctctgggctttacggaggaagtagaggttattcttcagtacatctgtga

SEQ ID NO: 606877 - DNA, 165 bp, Homo sapiens
acttcagggtttggtgtgtcatgcactacggggatttgagtcagctcccccaagatgagctgcagcccccagagagagctctgcacgtaccaagtaaccaggccccagcctccaggcccccaactccgcccagcctctccccgctctggcatcctgcacctctaa

SEQ ID NO: 606878 - DNA, 323 bp, Homo sapiens
tgaacactagtctgtgtcactgtaaacatctagcagtaaatacttgcagttgtgatataaaggaccctgtatgtgtacaaaagaaaacatgtaacataatggttgtgaaatgtaacatgaagcaaactaactgacatattcttaacatatacgatggtaaaatacaatgatagaactttgccagtctttaagatcttggataaattcaatgtatcaatctgttagcgcacacataataccaccattcaaaaatgttaagaagatgagttgcagatcttataatagattgtttgttagccattgtcattcacacctctgtactc

SEQ ID NO: 606879 - DNA, 988 bp, Homo sapiens
tggctatgccaggaagccactccaccacatgaatgctaatatgccagtggtacccagtacctcttgtatataggttattgcacctattgttctgaaatgcttaacttcagaattacatgtgttaagagtatttaattgttttcaatctatttggtatggatatagaagtacaactagaattctctggagatacagattgatatctatttgcactaacacacgtgacgtgcatgatttaattccatataagctttagcgtctcccctaataagaaagacctcgccattgtagtaactaaacaacgaggaacaatgatggaagcaccggtcatgaacatccctctacacatcctcgcgtggcccgcatggctcatgactcgcggcattgaagctacacgcggcatcgctgaccctcttcaagaggtataccttccatgcacatcgtgcgacactgcttcacgggcccggacagatgcagcatcgctcttctcacgccagcggaccaacgaatcccactgctacgttcatctcatcgaacatactccccctgcaacacgccctccaacaaccagatgatgaaccagaaactgaatacacagcagaggtgaagaaggccaaccacacgccctcacagtctgccttccctccacaagaatccctgaatagtcgaacccgcatggcctcaaccggatacgcatcatgcttacacagccattacccacggcatccagcactcaactagaactgacaagcacacatgcgctacccgcaccctctgcaacaaccccttcgaatagcacagaagcaccagcagaactgaaaagacacgacgactcaacacctccaacagcagaccaactcgcagacaccaccaccaacccaacacccccaacaccaagacacccacacctgacgctcagacatcctcacccacagccacccaggtccaccacacacaaaaacggaaccctacgctacctccactcatc

SEQ ID NO: 606880 - DNA, 772 bp, Homo sapiens
  misc_feature (252)..(252): n is a, c, g, or t
tgagtccgagcctggggacccccttccggcgtcccagttagcagcagccatcctgggtggtgtggacccgagacccacaacaaacccgggggctaaagttttcttacctcggggcttcctcgggcaccccggtgttccccaagtctctgacaatcgttggtcccggagtggtctagatctaacgccgctcgaggctctcccacccgccttctggccggctgaggcctcacttataacttggtccccaagaangagggggcccagcactcaacattcccggtgaatcgaggatgtctcgacaccccaccacccaatatccgcacatgcttactctgcccaatggctggaatgtgaatctttgctcgaatgtggggcccacgcccacgagccacgaacccgcgagattgttggcccccgaagatgcccaccacccctcctggcgtatatggaaggacaactttgtgagtttctccattataggcccaactgcacttgagactccacacagcctcacagccgagggccgctgtttgcctccgagagtgtgaaaagagtgccaccacaggaggaacactgtagcccgccacggagacacagttgagcccctgaggccacatattgaaaaaagacccatgccgctggttcgtgggaagtgtaacaaggccccccccccaggtgaagaaactgaaattcagcgctgtcaggattgcgagagatttgtgttgatactgttgcacgtgtgtttttttatttaaagactcatccctttcca

SEQ ID NO: 606881 - DNA, 552 bp, Homo sapiens
  misc_feature (70)..(70): n is a, c, g, or t
ggttcgagaagatgcttggccgtgaggttgaacgccaggtgaggtatcaggtcgcccgcaagacgctcgntcagttgctggacgaagccgagggcgtagcgcagcgcgtgcgggacacgttgcgcgccttggatgacatgctcaatacgcatgaggccgaggtagaccggctcagagcctacattcaagccgggcgcgagttcctggacgagaaccccgaggccggcgcggccaaggccggcgtgatcgagttcgacaagccgcgcgaacgcttcgcgcgcaagctcgccaacctggcaaccctcatggcgtcccatgaaatgagcgtcactcagatgaagctcacgcgggcgcaggccgtggacatgctggaccgcttctctgaaacggcatccgtcctggtgcccgtctggcgtcagcacaccctcgcgctcatcaccaccaagaacatgaatccggcaatggtcgccgaggcggccaaagctcaccaggcgctcatgcggagcctttcgcagagcctggaaggcatcaaccaataacacggcgggagaa

SEQ ID NO: 606882 - DNA, 152 bp, Homo sapiens
tatcacagcctcgcgtaaactattcctaggacttctaacagccctagacgtcaactacctaaaccaacaaaacttaaaataaaatccccactatagcacataattatatactccacacatcctcggatatctaccactagacatcacagcac

SEQ ID NO: 606883 - DNA, 311 bp, Homo sapiens
gagaggtagctctagagatcccactaacctaatcgctactctccaaagagtagaagcacagttctcagataggtctggctgcctccaagcactggaggcagctgctgtctatcatcctatgaaagcctaaaactatctactccatgccaacctaacagtttattcaacccataatatcaaagacatagctagctcaccacagagtaactaagtctacatactctgccccgaggactcctccaactgtatgctacggtcatagagaaaccccccaagagtcacgcgattagggttagcgggtaccggagctc

SEQ ID NO: 606884 - DNA, 330 bp, Homo sapiens
gggcccattggggttccgggtttttaaaaatccctcctggtttcccaatggaaggtttagggattttggctccttaaggggccctaaggggggttattatggggggtttggttttggccccccccattggggtttttttgaatccagggtttttcccctttgggtccctatttttttggtgggccggggttccgggttttttttttttccccctggttggtttttttgggaggccctttttgtggtgcccttttttttggggtttttttttttgccaaaattggccaatttaaaaaggttttttttttttccccccctttttttaagggg

SEQ ID NO: 606885 - DNA, 260 bp, Homo sapiens
gatcgagctcggtaccaggctatacaccctataccactactaacccctagcacaccattctactttctgtctctaggaatttgactattttaggtagctcatgtcggtggtatcagccagtgtttgtctttttgagtctggctgatgtcatttagcatgctcatccattcaaggttcatgcttgcagcaggcgtaaacacttccttccttttaaaggctgagtaatattccattgtctggatacaccgcggtggtatagt

SEQ ID NO: 606886 - DNA, 749 bp, Homo sapiens
  misc_feature (296)..(296): n is a, c, g, or t
  misc_feature (320)..(320): n is a, c, g, or t
tatctgtagccatgtcccctaatggctattagtgttcatggttagtgtgttgaagatgagccaggtacataacgcggcacattttctgcaggtcagcagtaaggtttcaaggtacagttatggaggaaagaagaaaatgacacattgataacacaggtctttatttcctaagggtacatatgaattattcccttttgaatgagacagtttttaaaagttgatttataaatacaaaaatacattctccaaagatagtatttccaaactgttatatacccatctactcccaacatggntataagttttttaaaaaaatagtngtatataacatacatatctgccccagtgttacttcacaggcctatgccctacgggaactccactctcccagccccactttttctcttggttctcccacattcttattctcccacatccctacccacgtttgagctggaaaggatgtccctaccctaggcatgaggtatattttattctgggcaccacacatttgccccatagataacaatacacgtgatgatgtcactagtcctacctttctaggttttacatacttaaaagtagtaactagaacagttattactggaactaagaattttccccacagaggtgaacagaccaagaactaaaattttaggaaacctgtttaatttcttttgtattttgaaaagttagtttatttctaaaattctttccattgcttataatcaactgtatgttaagctttt

SEQ ID NO: 606887 - DNA, 270 bp, Homo sapiens
taacgagtcccagcacagcatcccctcagcgtaatgtgtcgtctagacgccagatttccctattcacactgtgtatccatgttgtatagcaattggctgtgtcctgcttgtggttcccttattttatcacatgtattattaggctcgtctctcccactggatgtcagtcagcatatggaatgtcatgatattaccaggttatggagattaattgtgcacgtggaatttggtacacatccctatttcaccctcttcaggctttgtgttaat

SEQ ID NO: 606888 - DNA, 432 bp, Homo sapiens
aggctcggtaccgaaaatgacatagaggcaggcagatcacctgacggttaggagttcaagaccagctgcccaacatggtgaaaccttgtctctactaaaaatacaaaaattagctgggcatagtggctggcgcctgtaatcccagctactcgggaggctgaggcaggagaatcgcttgaacctgggaggcagaggttgcagtgagctgggattgtgcccctgcactccagactgggcgacagactaagactccatttccaaaaaaaaaaaaaattaaggaggtaccgtgtgcagctttggtacatgggttgtatggtataatcgggggttggggctcccagtgaactcttcacccaaaatagcgaacattagtacccaataggttagtttttcccaccattttctcccctgggggggattcctctagagttc

SEQ ID NO: 606889 - DNA, 738 bp, Homo sapiens
gcatagtcacaaggcttccttgcggacagggaatcgaggtctatcttaggcagaaatgatacaccatggattggcttagcaggggcgacagattcctagagtaccgaacagaatgttccacgctatggtcgcgcgagaggtaggaacatacagtgtggcaagttgacaaacgttttcttggaactagagcacagagatctgccaaaagtaccgtaggattgtcacagaatgtctattgtgtgccaggcacaatgctaagcttggcgaacacagtggtgaacaagaaccacatgtatcaatggctcagcagaaagcgtagcaatcctaggtgaccgaaaagagcatagtcacacatacctgaccgtaattacggaattatgatgttactaggacaataagtacgtggtaacgtcctgagaagattcccccgtgaatgagcgctagacattcctgagatttcgcgtcacgggcacacggtcactgaagccggtcgccaccatatgatcctatctcatcgatcatactgcacagacccgtctggactcccatggcacccctgagacttggcaatagttgccccttacggaaacctagaacgacgaatgcgaatgcgctggtgctggacatgagagactacacggactaggcgatccaaccaacgtgccttaggcatgtccggcaaggacctgaatagaaaagacgatccctagacaccaacagactaccctcctacccaca

SEQ ID NO: 606890 - DNA, 149 bp, Homo sapiens
atcttatcaggagagagactgcaacagactgtaggcaggaaacagcaggctggagggacagcgcggacaggacacagcctggcggaaggagggggccgggggtggaagcagataaggcaggagaggggcagggcagttacaatagcctc

SEQ ID NO: 606891 - DNA, 100 bp, Homo sapiens
tggcgatctcttgagatccccagctcaggatcttagctccagcgtctcgagctcgaatctgtatctgtcatgcttttcctgtgtaaaaccctggcgaccc

SEQ ID NO: 606892 - DNA, 241 bp, Homo sapiens
taggatccctcagggttgacttcggggtggcggggcgtacgggagggtgctgcctgaccaggctgtgctgagcgggtcagtgagggcgagcagggcgtcactgctctgtgcctgcagcccctgtgggccagtgggtgagctggctggagcagttcatgtggggccttgtggggacaacaccagtgcatggagcccttggactcatgggcatgctcgccatgtccctgatcctgtcttgcag

SEQ ID NO: 606893 - DNA, 369 bp, Homo sapiens
  misc_feature (75)..(75): n is a, c, g, or t
tctgaggatcccgacactgttccccaccccgacgccgacggcgttgagtgaggcggaggctatgccgcggcggangcgacgtatcgggcgtatgtcgacgcgttgaaccgtgtggactctccgatcccacgacattcgagcccgtgttcgcgttgacgaccggtgaagcgcttgccgcggaccgaaagaccttttccgacatgcacgccgcgctactcggtatccggtaacactcgcgttcagtcgatagtcgaccgtcggtttgatagttcgaccggagttgtcgagcttgccgtgtgtcaggacgtctcacaagtgcacgtcgtggacgagtcggggaacagtgtcgtcactcaccaaccaaggatg

SEQ ID NO: 606894 - DNA, 999 bp, Homo sapiens
tttctagagcagaacacgatcagactatagcaggtgcagcacttcacttattaacgtagactggagacaggtagtatcacgttatattaacttggctctcgctctgaactgaacgtactattccacggactttcacgaaagctgcagctttcacgcttgcttggctaccagagcaacttgacaactttgcacttgcactgctggcccgcgctaacgacaaacttcattcctgagcacacggtacgctggctacactaccctaacttagcactacccagctgcaacactacctacacggtgcaacccagattctgcaacgctacactagcttcgtgacacacagctactgcccacacacttttgacgaccaatgttaataaccactttagtcctcacgcccggcaccacaaaccgactaacacacaagctgcgcgctaaactaagtgattgaaaagtggggaccttggacgactgctcaccactggggctagagctttaccatcctattcccctaatccctgcctctagcaaaaccctaaacaaccgcttgggcaccttgaaacttcaaacgtgacactcctgggacttctccctgaaactagccacccgctgcccttgaagctgttgctgcttccccctacttgttcggccccagctcccacccaaccctttacgaaccgcaacgctggttggcgaatatccagtaacagtacccggtcacatcatccgacattggctgaagcatctctcagccttcctcatcctggcacgccaccgctccgcgcacactcaacaggacagaacttcgcaacgctccttccggactaattcctaaccccaagaaccgttcttcctaacaacaagcccggcaggccgcacttgttcagaccataccaatgggcctaccagggccccgcctgcgcggtgccttccatctttccgtgattcaacacgccataccgggtatctactctctattctacacacggtcattgtgcg

SEQ ID NO: 606895 - DNA, 843 bp, Homo sapiens
gctctcggacaagtcaactgagatccagagaatcctggatgtgaatgctaaacactgggacccttaactcacattcaatgtaattccacttcccaattaaccatcaagttcatacgctcaatacatcaacataacgaattccgacgcccagtacaaagatggaactaacactcatttccttaccactgcttcgcgaccccacttacaacgaaccaccaactcccaacttccaaaccaactaagcaccaccacacgtacacatcacactgcacaactcccacaacgaacacccctcgcgcccccaaagggacacaaccaccgaacaaaaagaatacacgacacactacaacgaacgacgttggcccacaagagaacaaatatgcaactaccagacgacaatcatccactgacagtacgacacaaacgaacagcaacacagaaggacaacaaacacacactatatacgaaccattctatcacacaaccacacctcagataaacacaaccaccatccttcccttaaacaccaatataccaccaacaacataacccccacaacacaaccacaccacacacaaaaaccatacactacccacgccaaaaccacccatagaaaacacattatcccccaacaaacacacaaaagatgcaacaaaaaagccatacaggaacacaagtgagacacgaaacaacacaacaacgacaacaccacatcacaccacgcggccaaaacaccaaacatatcgggaccaaaacccaattcaaccacacaacagaagcccacgacatacaatcaaagcaacaagcacgaaaaaaccccgcataaaacaacagacacacaac

SEQ ID NO: 606896 - DNA, 135 bp, Homo sapiens
caattgccccgattagctttcgtgtcgatccattttgaaacaagaggccacttttaaagaaccgtgcctcaaatgttaaaggactgctctttgactccacgttccctaaagccccttaattgaacccccacggat

SEQ ID NO: 606897 - DNA, 144 bp, Homo sapiens
aaaatgtgaccttctatatctactccaggtcacggagacctcattgaaaaggtaatgtgagcaaagactcgaaggagagtaaggggattaccatgtggatatctgtaagaagattgttactaggcagataaaacggtgcaaagc

SEQ ID NO: 606898 - DNA, 273 bp, Homo sapiens
ccctgccggagctttataagtcgctaccagcgcgtgtacggcaccactttcgcccgcagggcacgtgctcggagacacggacggtattggaaggtggaccacttgtatacccgtcgtccggtccgccttcagggggctgtccctcagatcgggacccgtctctaggcgcggggtgccttcggggtcaatagaggcaggccttggtggtgcctgtgcgataagcaccttgcgcctgtctatctacggcgtgttattaagattgccggggcgaag

SEQ ID NO: 606899 - DNA, 822 bp, Homo sapiens
agcgggtcttactgctaacctgtgtggatgtttctggtactcagaaagaatcaggaacatcattttgcaatgctgaagaattaagataatgaaattcaataaagcaggataagaaaatggctggcatgtttccccattacctagaatagctctgtggagaccaatccattccatgaaaacaactgcgaaacaggataattccatgtaataaacatctgctgaatagggcatcatgacaaactagcaaggcagctagactgagaagccaagatagcagaaagaagggtgtgctagagatggtccgctcacgtagttcggtgccacttgttccttgaggcattatgtcgaactcctaaacagcagcctatagatgaaggagctgagcagatattcgtaagagtttcacgggggatacaggaataacatggcaagcttaagagccaataagaagcagacaaaatatccctagcatttcaggttggaaccctggatgggattcatgtcaggagtaatagggaaccagaaacagacaggacggtcgatgaagattccagcccactgagattagactagctgatctgctctaccctaactttgcaaccagaaagaagaataaacccgctagcagtaacaccatctagagtctggaattatctctgaaaattttgcacattaccatatcctgatttcgatgaaaaattatcagtcatattaagaagcacaataagtgatcacaagccaagaggaacaacaactcaggttaaagaaacgagccaacaggagaccggacaccggtggctcacggcctgtaatcccagacaa

SEQ ID NO: 606900 - DNA, 688 bp, Homo sapiens
gctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgctcccgtgctgtcttgtctccccctctctgttaatgtctggcgcggaagtattaaaattcaaagcctcctgagcattctgtagaggtaccacatctactccttcgtgactacactctgggccatcttctatactacttgaacatataccaccatctataggacctctgcatcatcactgaacccatctctgtcagtctcatcagcctttatctcatgggttaagatcccccactccaaggctctgagccccttcttcccccttacctcaaaactggctgctataggcagcagaaccctgaacactgagataataccagacccagggagggaggagaccccaggcagcgaggacagaggacagcatcatcaaatgtccccaggaacaaggatgtggatcacgagagactgccagaaggagtagaaaaagaaagcagaacactg

SEQ ID NO: 606901 - DNA, 558 bp, Homo sapiens
tattccacaggggcagcatcagccactgtcagctgctcattttcccaaagcccacaagcctcagccacgctttgcttctgcaagacgcttcttcaccttttcaataaacctgcctgaatttaaactgacgggggtttaattctccttcatcataaatgaaattcttcaccgcaataatctccaatgaattttgggcacagcaggcaggcccatttctgcttctgttccactatctcccctgtaggttgaaaaggaggaggtactgaattacctccaaatgttcctctggctctgatattctgttattctggttccttttcagctactttgtttttggtagcatgtatcctaaggcatccagttgaacaacctttgtctactgtgtccaggcattcctcgtggtatttcagataagacactcttgggttgctgaactcacaaccactgaaccaattctatgaccatctgtttcatggccacatgtttgctcattttatatgtatataaagggaggggacagacagcaaacttgcgtgttataaattgtatcctcttaaa

SEQ ID NO: 606902 - DNA, 355 bp, Homo sapiens
tgactgcgagcaggttgagtggagtgcagtgcgacggtcgactcactgcggcctctgcctcccgggttcaggagattctcctggctcaacgtcctgagtagctgggattacaggtgcctgcactatgcctagctaatttttgtgtttttcgtggagacggggttttgccgtgttagccaggatggtctcgatctcctgacctcgtgatccgcctgcctcggcctcccaaagtgctgggattacaggcgtgagccactatgcccggcccaatttgtgtatacccgtgtgacgcaccgggagatgtagccatgctcgtccgtgcgctcctcgtgcttgctgattatctccacgaggc

SEQ ID NO: 606903 - DNA, 109 bp, Homo sapiens
agggctctgctaccgacgctcatgaacaggctatcttgcggttgcacgtcaacaatgttctgtctcagcctcatgactcaggccactgttaaactagaacatgctaaat

SEQ ID NO: 606904 - DNA, 281 bp, Homo sapiens
  misc_feature (18)..(18): n is a, c, g, or t
tctagaggatcccatggnagaccaggtctgaggagggaggatggcttgagcccaggctgagcaacatggcaaaaccttgtctctattaaaaacacaaaaaaattagctaggtgtggtggcaaacgttggtaatcccagctactcatggggctgaggcccgagaattgtttaaacccaggaggcagagactgcagtgaattgagattgtgccactgcactccagcctgggcaacagatcgagactctgtctcaaagatacagagactcgctctgttgcccag

SEQ ID NO: 606905 - DNA, 208 bp, Homo sapiens
  misc_feature (97)..(97): n is a, c, g, or t
aaaggggtattaatttaaaactcccttattaggattaccttttaaaggtttatttatgaattccccttaaaaatgatatttccaaggttaacccatnccatataaagaaaaaaataaatatattaataccggcttcctgtccccatttttaacctcagccttccctactgtcccccacaacccaggtaaataaagtcccccgccttga

SEQ ID NO: 606906 - DNA, 814 bp, Homo sapiens
  misc_feature (6)..(6): n is a, c, g, or t
  misc_feature (63)..(63): n is a, c, g, or t
  misc_feature (75)..(75): n is a, c, g, or t
  misc_feature (81)..(81): n is a, c, g, or t
  misc_feature (128)..(129): n is a, c, g, or t
  misc_feature (153)..(153): n is a, c, g, or t
  misc_feature (177)..(177): n is a, c, g, or t
  misc_feature (180)..(180): n is a, c, g, or t
  misc_feature (204)..(204): n is a, c, g, or t
  misc_feature (256)..(256): n is a, c, g, or t
  misc_feature (306)..(306): n is a, c, g, or t
  misc_feature (311)..(311): n is a, c, g, or t
  misc_feature (313)..(313): n is a, c, g, or t
  misc_feature (337)..(337): n is a, c, g, or t
  misc_feature (341)..(341): n is a, c, g, or t
  misc_feature (364)..(364): n is a, c, g, or t
  misc_feature (367)..(367): n is a, c, g, or t
  misc_feature (397)..(397): n is a, c, g, or t
  misc_feature (661)..(661): n is a, c, g, or t
  misc_feature (667)..(667): n is a, c, g, or t
  misc_feature (679)..(679): n is a, c, g, or t
  misc_feature (682)..(683): n is a, c, g, or t
  misc_feature (691)..(691): n is a, c, g, or t
  misc_feature (699)..(699): n is a, c, g, or t
  misc_feature (713)..(713): n is a, c, g, or t
  misc_feature (715)..(715): n is a, c, g, or t
  misc_feature (725)..(726): n is a, c, g, or t
  misc_feature (732)..(732): n is a, c, g, or t
  misc_feature (776)..(776): n is a, c, g, or t
aaaacnaaataggcgatagaatattaatctctgtgaaacaatatagacaagagtatgaaaatnattttacagccncttttncatggctgttgacctactggaacaagagcaaaacccgcattagatgnntggtcataagactctccataagtngatgtccaatatataatgcttttnaangccattgtgagacttctgcaaganatacacgtccatctaccacaaatggctccacatctgtattgtctggctttanacaacccatttgaattaagtctgaatatgctatacacgtagcctcatcanatttntntccccaaatgtagatatgagaganagtnagacttgccttccccgattgggnaantgcaacaagtccttctccctctatgttgtngctgactactgacaacgctttaagactcctgttgtgtgaagtaagagtttcactgagatagtttgcgcctgcattttctattctgttaaaggaaagatctattacttccagggtagtgttgcttttcagtacatcagccaaatacaccattccatcatgagttattttgttgcagctgacatcaaggtagcgcaggctactgttcagatacagtgcatcacatatctgttgtataccactgttttttatatcatgcttacacangtgtanagcaacaagacngtnnttttcttncaacatgnggcctacatggacngnagactcttcnngaacancgtacagtataggtcggattaagtttattgacttaaatagcttnattttgaattaatactgtagctaaaaaaataacacttt

SEQ ID NO: 606907 - DNA, 200 bp, Homo sapiens
cccccccccccccccccctttttgggggtaagggggaaaaaagttttttgtgggggggggttttttttccccccccccccggtttttttggggggggaaaattttttttttcccttttttggggggggggggtttttttttttggggggggtttttttttccccccccgttttttttggggggtcccccctttgggggga

SEQ ID NO: 606908 - DNA, 217 bp, Homo sapiens
agaccgcagtgtatagggagcagggataaaatattttcttgataaagtacgtgaagtgttaactttttatcgatctggtagtaaaaaatatatgtgcaaaagtgtgtttctattttattccattaaatagctgagtatagctactacttcagaagtcttcgttaaacatagatttgcgggtgtctattaaatagtgtcttcgtgtagcagaaatagg

SEQ ID NO: 606909 - DNA, 594 bp, Homo sapiens
tcggctcggacccggtccagtgcacagttgtaaaagagactttaagatcggcaggcacggtggctcatgctgtaatcccagcactttgggaggcagaggtgggaggatcacaaggtcaagaggttgagatcatcctggccaatatggtaaaaccctgtctctactgaaaatacaaaaaaaattagctgggtgtggtggtgttccccttatagtcccagctactcgggaggctgaggcaggagaatggcatgaacccgggaggcagagcttgcagtgagccgagatcacgccactgcactccagcctgggcgacacagcgagactccgtcttaaaaaaacaaaaaaaccccacaaattttagatgtgcgacatgctgcccaccctggggggatactgctcattgtctcactggtagccaccctctaagcttcctggaatccatattgtgtcgtacactaagttgaattttattctctcataaccatgaccatattaactatttaaacaaatgaatacccagagagtaaaaacgaaaagcaaaacgaaaaaaccctaaaagtattacattagaagtcaaagcacctcagacaattt

SEQ ID NO: 606910 - DNA, 95 bp, Homo sapiens
aacttaaccttcatttcttgtagttaagaaaccatttcttcaggatcatgactgaagttttgccatgttccatcattaatgttccaacatcacca

SEQ ID NO: 606911 - DNA, 463 bp, Homo sapiens
  misc_feature (93)..(93): n is a, c, g, or t
gtcaggatagcaggaatccggggtcaaggttgccttaaccattctggtcacacccctgtgagtaattgggaccaaagttgtgtagcacttgtntctgtcgtaagtgtaacaggtctcagaataatcgtcatcaggacagatgttgctttggctagcagtaaacacctgattgtccagctctatttccgtaggatcacattttttacagaggttagccaaattatacttgaattcggttctcagtggtgaggtgggatcagagatattctccctggtgttcagaggaacgataattctgatgtttctctccacaatgtcctcactggggttgtcgggatcacggatgatcctggaagtgatgcggacacactggcatttgttgtcaacaagaacagtgctttcgtcttcacctgtgacaagaacagcctgaacaaaaatggccaggatgccccagagaagcaaa

SEQ ID NO: 606912 - DNA, 1397 bp, Homo sapiens
  misc_feature (394)..(394): n is a, c, g, or t
tgggagaagcttagaggatactatctaacaactgaaattagtgatttggcaagtttcatgcaatcagttgttgtgtaaaaagttacgcttataaactgtaatgacagtgtcgtattattgactgtgtagtactccgaaggtgagaatcgagtgtacgactccttcaaggttatatagcgagaccgtagtatgtacttgtgtagagttgtgcagcttgttgagatctgaacaagatacatggttgcccactgtagaagtgagcgaagatgccttgagcccaaatggactacgtatctgtcgtgtctagcatgtagttcatcgttctatgtcacgcgttttagagtatcctatggagtcggaaggtttcctgtaacggaatttgcataagatctcntgttactaaggagaatacgggtcgaaggagctcgctgattggtgtagtggaagcgtcttgcatttgagtccctaggattattacgcgaggtgaacaattgattaatactcaaagtcctttccactagatatcttctggggtgacgacagagaaattcttgagaggctccaagttagtctgataccgactggatcacacgttaccattatgcccaagatgatctatttctaatcgaggattattcgtttctgggactcgtttactagtttcgccactttgtaaaaaggccgcggctttcctgcgcacaaacgcagggcggctgtatccaaaattctgaagggtatcccgatatatgtcccatccgcaattgtgacggaactcagccgagcctttgacttttctactggcccaatgtgcccttgccttccaagggggaaggaaggaggtccgcagattattattgcttccttccactatgtagggggacaaggtccattaaccccgaggacaacaacaagttggaagattttgcgggaaccgattcatatgggcctggatttaatcgtttgtgcccaaggggtaaccacacacggcttggggggcacacactacgaacaccttggggggggactcgggtggaggaaacttcgccaacagggaagtgcttaacacatggttgggcgggccaaaaaataaattatcgcaccaaaacagcgagccaactacattctcttacgctgacccagccgagcgcaggcttactaaacagccgatcttcctaagaaatgggacacgcgagaacggcgacgaaagtcgatgatgaccaccacacccgcagaatctatatttttgcagcgattattatgaagacaccacagcctactattataaaatgaaacacatgtccccccaaccaaccctagaagggaggccatactaaacaccagacgagaacgacaactctacttattgaatgcgaccacgcgcgagcgacacctcaaaa

SEQ ID NO: 606913 - DNA, 966 bp, Homo sapiens
ctggctggggggcggaaagggcagactgcaaactggggggctgcgttacgttgcaggaggcgcggttggggctgcgttggaggagggggccacgttgttagaaaagaaagaaaatgtggttggccggagattggagaggcgcccaaggaacctctcctgtgggaggggcgccttgcatttcatattgtttggtggagctgtggagacttgggcttgaccgccctgtgcatttcagcctgtgttgcctttctcctgtaggggttttcttttctctgttctctttctcggaggaaaagggcccgagaaaggggccattaccagggccgcggcgcttgggtttgccacactttggaaaagcagcccggaagcctgggttgctggggaaggcggggcgcgttagccttcccgccgcccttgcggtttggcccggttggaggcccaggcgtttgctaggatttgcttcagtttccctgtttgtgccctatttctcttttggttaacatttggcccttgtgtttgaagttattttcgaattttccttcctttgcctcttgaaactttcagcgattctccattgggtgattaggcgcacaaacagcacgtgtcttgtcggtaactcggatactacctttatttacagtgattttccctgtttacccgtgttttgttagtccttttgggcacccccaagaaaaaacaaaagagcaaaagaacaaaaacacaacgacggcaaagaaggaccgtacaagcgaataccccgcacagatatgacaggcaaaacaagagcgtacaaaatcaataatgcaactgtatttgaaaaacaataccacatatcaaaaaaaaagaaaaacaaaaaactcaacaaaaaaaggacgtaaaaaataaaatagaggaagttcccaagaccaacacccaacttaccttaactagtcacaaccactcttaagaaataaatagacacacata

SEQ ID NO: 606914 - DNA, 139 bp, Homo sapiens
atcaatgaggagacgcttccgtataattcgtcgtcagtcacggctcccatggcgtgccggcggcggcggcggcggcggcggcgcaagctgaggcggcggttggcggcggcggaggtcaaactcccacaatgcagccggg

SEQ ID NO: 606915 - DNA, 106 bp, Homo sapiens
ttatgactggcctgtgcgtcgcagatacgcgacactttttgtgcggacagctgcttctgagcccccattgtggtcttcctgggctttcagcgatggcttgtgcggt

SEQ ID NO: 606916 - DNA, 359 bp, Homo sapiens
  misc_feature (2)..(2): n is a, c, g, or t
  misc_feature (66)..(67): n is a, c, g, or t
  misc_feature (75)..(75): n is a, c, g, or t
  misc_feature (97)..(98): n is a, c, g, or t
  misc_feature (102)..(102): n is a, c, g, or t
  misc_feature (107)..(107): n is a, c, g, or t
  misc_feature (109)..(109): n is a, c, g, or t
  misc_feature (112)..(112): n is a, c, g, or t
  misc_feature (123)..(123): n is a, c, g, or t
  misc_feature (125)..(125): n is a, c, g, or t
  misc_feature (184)..(184): n is a, c, g, or t
  misc_feature (188)..(189): n is a, c, g, or t
  misc_feature (195)..(195): n is a, c, g, or t
  misc_feature (199)..(201): n is a, c, g, or t
  misc_feature (203)..(203): n is a, c, g, or t
  misc_feature (209)..(210): n is a, c, g, or t
  misc_feature (213)..(213): n is a, c, g, or t
  misc_feature (221)..(221): n is a, c, g, or t
  misc_feature (225)..(225): n is a, c, g, or t
  misc_feature (231)..(232): n is a, c, g, or t
  misc_feature (236)..(237): n is a, c, g, or t
  misc_feature (240)..(240): n is a, c, g, or t
  misc_feature (248)..(248): n is a, c, g, or t
  misc_feature (251)..(251): n is a, c, g, or t
  misc_feature (255)..(255): n is a, c, g, or t
  misc_feature (270)..(271): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (293)..(293): n is a, c, g, or t
  misc_feature (296)..(296): n is a, c, g, or t
  misc_feature (300)..(300): n is a, c, g, or t
  misc_feature (302)..(302): n is a, c, g, or t
  misc_feature (305)..(305): n is a, c, g, or t
  misc_feature (309)..(309): n is a, c, g, or t
  misc_feature (317)..(317): n is a, c, g, or t
  misc_feature (323)..(323): n is a, c, g, or t
  misc_feature (341)..(342): n is a, c, g, or t
  misc_feature (358)..(358): n is a, c, g, or t
antgaatgatatatggaatgaggaggatgatgagagaaagaaaaaaagatgagagaaaatgaaagnntaggtgtnatggggaggtatagatgggagnnaaanaggtnanagnatttggaagtnantgggtcagagcctgtatcacatcctttaccagcatggtgccaatcaccattttctcgcngttnncagtcngctnnncngctccnnctngccgggcntccngggtcnncagnncgnggcttccnccngtcngtttcctccctgccnncctgtcctcntcncncgtcccnccnggcncncgncccntgtttgcngttgcngtcactttctgcaccacnntgtggtcactccgacnc

SEQ ID NO: 606917 - DNA, 106 bp, Homo sapiens
cttcggctacaccgctgcaacatccccctttgtccatgcaaccaagcaatttcacggactcagtttacagggtctgtctcagctagggggtgccgggtcgcggggt

SEQ ID NO: 606918 - DNA, 1086 bp, Homo sapiens
ggctgattttcatgagtcgccttcaagactctcgtgtagggttgacaatgtgggggggtggtgggatccagcttatctctttgtattgttcaagtccattcttggggctggctgcgaggaggcagggacggaataccgcctcccataagacccttaggtgtgtgccgagtcttgctttgtgatgttggcatggggaggggagaccttggtgtggtgactgagttcccttaatcagacccttcaatgggcacaaacattgagtgcttgattttaggttataattcttgttctatgaatgtccaagatctgtgtttcccccttgtgcctcccagactgtgtggccagttgaaagtgtctgggtcagtgttcatctcatccctcatttctggagcagggcctgagaccctgccacatctcctatgctctgcatccacgacctcttttggaccattaaaggttcgattgatgcaaaccagagagggacaacaagaagggagacacaaagaatcacacctgggagcggacatttcagggccgtgggaggagtgagaataacacagcggttagaccatagggagagccgtctaggaagcggtgacacgcaaatattccccactggcagcactgacgagagacttggccatccaaagaggcgggtaccatgcgtcaggcgcgtgcacctcgagaagggggaatgaggacaaaaaaaccggtacaaagacatcggaggaagacacagaaaggcctgatgaggtgaaggggacagaaaaatcccatgggagacagttgaaagaacgacgacccagggaaggggcagaggacaagaacgcaaaccaccgataggaagaaagaatatgagcaggagccaaccgaggaaaacataaccgcaagagaaagaaacgatcataacaagtgggatacaaatcgacgcccactggtaacacaactgaacgaaagaaaaggagacaccaacgattgggacacaaaaaacaacgcacaatatgaacacgaggaaacaccatccaatgacccaagcaaacgagagcgagggcaagaaccaaaattgagagtggaagaacccacgac

SEQ ID NO: 606919 - DNA, 142 bp, Homo sapiens
  misc_feature (93)..(93): n is a, c, g, or t
accgagattagaaaccttaaccttaactactagttgttccaaaacatccacttaagtactttgatttgtaccattccttcaaataaagaaatntggtacccaggtgttgtctttgaggtcttgggatgaatcagaaatctat

SEQ ID NO: 606920 - DNA, 207 bp, Homo sapiens
acggatccaagttaatgaacgggaagaatgggtggcaatggtgtgctcctggaagagctcagccagcagaggtgccctgagctcggggccttgcgtctctgtcacctggggatatctatactttagataaagtttttactataaagtacgacagagacaatagaacaatatacaaatcttgagtgggtcaggggaacgaaactgtga

SEQ ID NO: 606921 - DNA, 450 bp, Homo sapiens
tgggcgcacatttacacaaaaaatactgcaggacactgctaattactgcctgtccagtctcacactgaagtcacccatgttattgatcttgtagcccaaaataattatttcaggacaagtatgtaatcctcttcacttttcctttaaaaacccttgtcttcctcagtgtggcgattcctcaaggatctagaactagaaataccatttgacccagccatcccattactgggtatatacccaaaggtgtatatgtggcacatatacaccatggaatactatgcagccataaaaaaggatgcgttcatgtcctttgtagggacatggatgaagctggaaaccatcattctcagtaaactatcacaaggacaaaaaaccaaacaccgcgtgtactcactcacaggtgggaattgaacaatgagaacacttggaacacaggaagggggtgttata

SEQ ID NO: 606922 - DNA, 128 bp, Homo sapiens
cacgagggccaccacggctatgggaattcaccgctatgtcttctatttatactgtcccatcagtatgattgcaaccacacgctgtagaaccgtatgctgtcctttgctaaagacactactctccggca

SEQ ID NO: 606923 - DNA, 106 bp, Homo sapiens
ttggaaggatgtccttggttgatcagcacgttcttgcccttgtagttaagattacatgaaccttcttggtgccagggccacagatatcgggactgtgaaagtccag

SEQ ID NO: 606924 - DNA, 312 bp, Homo sapiens
  misc_feature (42)..(42): n is a, c, g, or t
  misc_feature (47)..(47): n is a, c, g, or t
  misc_feature (146)..(146): n is a, c, g, or t
  misc_feature (151)..(151): n is a, c, g, or t
gcggccgggggggaggggcgagggagataggagagaaaaaantttangttgtacctagccttctgcttgcccatgccacacatatcctgtggcccccagagcgctggcagaaattggaatctgggggtctggggagcgcttaccantacanagagaagaggaatgactgcatgaatctacctgagttgctggcattgggaggccagttactggaaaggaatggaaaaaagaagcctccgaaagggaaaaacttctgacaatatgatgctgtgcgagaaatggggcggggcattaaaacgatctgtattatta

SEQ ID NO: 606925 - DNA, 353 bp, Homo sapiens
accgtcgacgccacctgactaagcttgtacctaacatgaaccaatcactggctatcgtcacacgagttgtatatatacatactctccccgacacatcccgtaagctgcttatgatcattggccaattaaatagatagggaaacctaattattggaaattaccttgagcttgactaatatgatgacaagcttttagatcggctagtgaagcccaggcccacctatcagagtccaagctctcagacactatgcttcgttgtctgtctcatagtatttcatgctaaacagcacagactcacataaatcaacttccacaatatagtatagatacgtggaggctctggccatgaactg

SEQ ID NO: 606926 - DNA, 432 bp, Homo sapiens
  misc_feature (43)..(44): n is a, c, g, or t
gaaattcgccggcccctggtttcccccccagggggccggggcnncccccccctggggtttttttccccccccaccaaggggtttttcccgggggggtcgggggggagggggtttcccccccccccgggggccccggtttgggtttaaaaaaccccccaaaaggggcccttttccccggggtttggggcccccggggtttttacgggtttcccttttttccctttgggttggggggggggggggcccccccccccccccccccctttgggttcccatgcccccccggtaaaaaggggggggtttttttccccctctttaagggggggggggggcttttaagccccccgggcgggggccccccggccccccctttttaaaggccggtttttttgccccctccctgggataacccccgggggtggggttttttga

SEQ ID NO: 606927 - DNA, 111 bp, Homo sapiens
ccaaatgtttttttttttggcccctcccccccttttttattgtggaagatttgtcccccatcctccctgggtccccctttaaaatttaaaaggaacttttggggtccccca

SEQ ID NO: 606928 - DNA, 230 bp, Homo sapiens
  misc_feature (113)..(113): n is a, c, g, or t
  misc_feature (201)..(201): n is a, c, g, or t
aaggatctgtgggcttgtgataagagagcatacatatctgcatttgtgacaaccctggaaggtgcatttgctcttcagaaggtgcagatctgggaaaactgcaacaaggaggntagaaaaaaagaaaacatcaagaaaagcccatagcttatagaaccatgccttttaaatgtggctcagaaatagcttacaatattcatnataatgactgtctttgccccagaatcctt

SEQ ID NO: 606929 - DNA, 275 bp, Homo sapiens
  misc_feature (236)..(236): n is a, c, g, or t
  misc_feature (271)..(271): n is a, c, g, or t
cacaagatagagaaaaagggaaccctcgctaaatcatcctatgacaccagtatcaccctaataccaaaaccaggaaaagacataaccaaaaaagaaaactacagaccaatatccctgatgaacatagatgctataatcctcaacaaaacactagctaactgattccaacaacatatcaaaaagataatccaccatgatcaagtgggtttcataccagggatgcagggatgattaanatacacaagtcaataaatgcgatacaccacataancggg

SEQ ID NO: 606930 - DNA, 387 bp, Homo sapiens
ggtacgacgccgtggctcgtgcctgtaatcccagtgctttgggaggctgaggtgggaggatcacttgagaccaggagtttgagaccaatttgggcaacacagtgagaccccatctctaaaaaaattttaaaaattaggcaggcatggtggtgcatacctgtaatctcagatacttgggaggttgaggtggtaggattgcttgagctcaggagtttgaggctgcagtaagctatgatcacggccactgcacaccagcctggtagcctgggtgaaagggggagacctgtctcttaaaaaaaagggctggcctgtaatcccagcacctttgaaggccaaagcgggcggatcatttgagcccaggagttcaggacgagcctgggcaacatg

SEQ ID NO: 606931 - DNA, 623 bp, Homo sapiens
cccctcccctgaccaagcgccacagtcccaggtggatctcagattgctgcgtgtgctggaagcgagaatttcaaaccagtggatcttactttcctgggctccatgggggtgggaaccgccgagccagaccacttggctcctggcttcaggccccctttccaggggagtgaacagttctgtctcgctggcgttccaggtgccactgggatatggaaaaataaaataaaataaaagctcctgcagctagttcagtgtctgcccagttggccgcccagttttgtgcttgaaacccagggcctggtggggtagtcaccagagggaatctcctggtttgcaggttgtgaagaccatggaacaagtgcagtatatgtgcccaagttcctcaggctgagaccctcacagcttcccttgggtacagggggaaaatttcccgattccttgcgcttcccaggtgaggtgacaccccaccctgcttccgctcagcctctgtgggctgcacccactgtccaacctgccccggtgagatgaaccaggtacctcagttggaaatgcagaaatcacccaccgtctgcatcgatctcgctgggacctgcagactggtgctgttcctattcggccatctg

SEQ ID NO: 606932 - DNA, 378 bp, Homo sapiens
cgctttcctcaagatcaagtctccaaccttcctgttctctcaaaaggattgttccacagagacacctgagtgttcatgaaaatgccaagccttggcccggcgcggtggctcacgcctgtaatcctagcactttgggaggcttaggccggcggaattgcttgaggtcaggagttcgagactagcctgggcagcatggcgaagctccgtctctactgagagtacaaaggattggccgggcgtagtggtacgcgcctgtaatcccggctaaactggaggctgaggcgcaagaattacttgaacccggaaggtggaggttgtagtgagcccagatcgtgcacctggactctttggactgtgtctcaaaaaaaaaaacaaaac

SEQ ID NO: 606933 - DNA, 137 bp, Homo sapiens
ctcctgacacagcagaccaggtcggatgggaggaggcggaggaggaggaagaaaccaaccttagatgagcccgttttgttttgttttgttttgttttgttttgtttttttcaggcagagtctctgttgccccaggca

SEQ ID NO: 606934 - DNA, 1437 bp, Homo sapiens
  misc_feature (996)..(996): n is a, c, g, or t
  misc_feature (1167)..(1167): n is a, c, g, or t
ttgattctgtgctgattgcatgtcccttcactttttttgttgtgatagcgcaccgccgtcctttgtgcgttgttagcagcttgagcggttctctcccctgtgagtagctcggtttcaagtctaatggcgcgtgatgctcattgtgtctgacacttcggcgggggttgtcctcccttctggcctcccgggcgtgtcccactttggctgtgcgccctcgccacatggtggacggttgtggttccgacccccttcgatggttgtggaccatagatcttttggggggacacaagcactttatggtgttttttgtggcaccacgttgttgttgcagcctgccataaagttggtttggaccacctgggggaaagataccatgtttcgacgccttgtcgggggccccccccaggttttcccgtcaattctgtgtgtaaaatgggggcgtgaacccagaggtgattgccccgtcctctcttattaggatttaaaatgggatgttccaagcgtcccttcaacttgagaggcccccttcatgccccttccggtggagcccccacatttgggtgccggacgcccccctcccgggtattatttaccccctctatagcgcctgggagccgcccctgtaggagcgtttcttggagtccccccgccttaatttagggggaccacgatagaaagccctctccaaatcttgtgaaagggtgccctgaaatgcgccctggcctgaacctggggaaaaacttttcaagggcaacttgatatggggttctttaccctgggtaaaccgggaagggccctgagaggaaacaccctgtaagcgcttccaaaatctaaatgtcttctgggtaaacccccggggtggccccttgagagcgcccacaagatctttggggtctttttgagaaggagaatatataggggaagagaaggtatatcctcgggcgcacacacatccacacgcgctataacaccctcgctgaggggttacacattttnatagggagaactatacccgctcacatctatagctattataagggagtcacatgccacgaaggtcacgccaataagcccgcggtggcgagatagaggctcacgccccttaactcacttcaccactacacccactcaccacactttaaatttccacaattctcgtaataattngctcttttataaaagttaaagtgccactttctatattatacccacacaataatgcactgaaattcactttctccctctttgagagagagttagagttgttaaagatagtcctcacttcacgctatccacaccacctccttgagtccttccctttttagtggctgttgtttgttgtaacttccctttagagctttgttttaaatgcttgtaacggaacaataatgtggactcattgggaatattgtgtgtttaatgccaatgatatattga

SEQ ID NO: 606935 - DNA, 578 bp, Homo sapiens
cttcacgatataaaataatataagaacttctggtttacaaaatgtaaaatcttaagcctatggaacccttgatttcctacctcagtgtacactcaactatgggtggtatcagttggtgtatgtcgcaattgtcaacataatctttggcttaatggctactgtacttgctttgaaagattacctactattttatgatacactgtagttgtctccagagcttaaatatacttggtaaacgcacttggttaaaatttctctctacctataaacagtttagcatcaagggttcctattaatgacacagaattattggcgcacagtgtacatttcttaaaaatttagcatactttaaatagccagcatgtaatacaagtaactacactacctcatatctacatgatttccaagttgtaatgcacgatggccagataacacaagatttcacgttcgtctttgtgccataagtgggaaagtctcctgtatatggcatagcttacacatttatgcctattttaacattaacttctaaagaagttttcctaagacacatgttcaaggcaatattcttagaggctgcc

SEQ ID NO: 606936 - DNA, 417 bp, Homo sapiens
  misc_feature (5)..(5): n is a, c, g, or t
  misc_feature (7)..(7): n is a, c, g, or t
  misc_feature (62)..(62): n is a, c, g, or t
  misc_feature (67)..(67): n is a, c, g, or t
  misc_feature (73)..(74): n is a, c, g, or t
  misc_feature (81)..(81): n is a, c, g, or t
  misc_feature (120)..(120): n is a, c, g, or t
  misc_feature (137)..(137): n is a, c, g, or t
  misc_feature (154)..(154): n is a, c, g, or t
  misc_feature (162)..(163): n is a, c, g, or t
  misc_feature (168)..(168): n is a, c, g, or t
  misc_feature (179)..(179): n is a, c, g, or t
  misc_feature (213)..(213): n is a, c, g, or t
  misc_feature (237)..(237): n is a, c, g, or t
  misc_feature (270)..(271): n is a, c, g, or t
  misc_feature (275)..(276): n is a, c, g, or t
  misc_feature (278)..(278): n is a, c, g, or t
  misc_feature (315)..(315): n is a, c, g, or t
  misc_feature (339)..(339): n is a, c, g, or t
  misc_feature (376)..(376): n is a, c, g, or t
  misc_feature (399)..(400): n is a, c, g, or t
  misc_feature (402)..(403): n is a, c, g, or t
gcagnanagtgtattgctatatgggtgccaagattgaatatgaagaagccccagtgtttgtnagtantatagnncttaagncaaatgctgtgtggtgatagcagccataagaatggggcntatataaagccctgtancatgtaagattttgtancagagaanntttangctttataaantgtatatgaagcatgtaaatgctttaaaatgtancataaaatagctgtatttttttancttgtgtgtgatagtctagtgcattgcatgtanntatnntntattatgtattctgtagtataaagcatacattgatgncttacatttttactggtaagtcancatccgttggatgttttctgaagtggctctttttgangtgataatagattgtaattcaanntnnaattattaatgaat

SEQ ID NO: 606937 - DNA, 227 bp, Homo sapiens
tagcctcccaccttagcctcccaagtagctgggacacaggcacatgcaccacgccagctaattttgtattttttagtagagatgaggtctatgtgcccaggctggtcttgaactcctgagctcaagagatcctcctgccttggcctcccgaagtgctgggcttacaggggtgatccactgtggctggccacaacaatccatcttgggaccgcttgcttgttccgctg

SEQ ID NO: 606938 - DNA, 210 bp, Homo sapiens
gagtattgtcttggaagtaaggcttgacaaaagagggaagggaaagactaattaacaaatgtgaaaaattaaggccctttgtccaagatgattcccttgtttaagtcagctgtttttgttgctggccctcttgcaccttagctttactactgtgggtggctgttagcagggtgctttgggaaggactgtccccaattcagacaagatggg

SEQ ID NO: 606939 - DNA, 455 bp, Homo sapiens
  misc_feature (191)..(191): n is a, c, g, or t
cacgattgcaaatcactgatctaagcacatcccaccttattctatacactctccttttcacctccaatattacacttctatttttatatatgtttcccaatctatttcttttggtaacatttggccctcaggaaaatagagaatcccaatgttggtttgctacaaagaagcctggagcaggctgggcacanatcgtcacgcctataatcccagcactttgggaggccgaggcaggaggatcacttgagagccctggagttcgagaccagcctgggcaacatggtgaaacccagtctctacaaaaattagctagatgtggtggcatgtgcctatagtcctagctactcaggaggctgaagtggaaggattccttgagcccaggaggtcaaggctcctgtgagctgtgatcacaccactgcactccagcctgggcagcacagagagatcctgtctca

SEQ ID NO: 606940 - DNA, 121 bp, Homo sapiens
gtttatagaggatcccagtctgtgagcctccgttgtagacaagttcttgggacacacttcatttggtaagtttgtttctcccctacctgtcacccccggcccccatccaatactctactct

SEQ ID NO: 606941 - DNA, 527 bp, Homo sapiens
gcatttggatgcggtatccgcaggcggcgtcacaccacgttgtcgagctcgcaatgcgcttccagccgatacccgtcgggatcgacgacgaacgccgcgtaatagccggggccgtagtgctcgcgcttgccgggcccgccgttgtcctggccgccgtgctcgagtgcggcgcggtagaacgcgtcgacctcgaccggcgaagcggccttgaacgacaggtgcaaccccgagtcgggatcggcagcgacggggcgcggcgcatgctgcaaccacagctcgggttcggtcgtaccgtacccgatcgagccgtcgtcgctatacagccgcgtgtagccgagtgcgccgagcgcgtggtcgtagaaggtgcggctgcggccgatgtgggcaacgccgaacgaaaggtgatcgatcatgtgaggctccttggactgaagagggacgtcagtgcggcaaacctgcttataaccaccacgccagccgcttgtagcggagtgcgccgagtgtgctgtcgtagtacgcgcggccgc

SEQ ID NO: 606942 - DNA, 270 bp, Homo sapiens
gtcccccgtaaaaacccctgggatgggggggggttggggttgtttaaggaaaaacaacccaacctgctttgtgaactgaaaggatttttatgcaattttgaggggcccttccaccctaaaaagaaagggtttgttttaccgggtggtgttaaaaagttttgaggattctgggtttgaaaggttgggaaaaaaaaaattcccttttatatgatgcccgtaaacccccccggatttataaatgaggaaaaaaaactgggtttttccttttga

SEQ ID NO: 606943 - DNA, 166 bp, Homo sapiens
atagttcttgtggtactggaaaattaacattacatatgtgacttgaggccttgctcagtggctcgtgcctgtaatcccagcattttgggaggctgaggtgggagaatcccttgagcccgggaggcagaggttgcagtgagtcgagatcacaccactgcactccagc

SEQ ID NO: 606944 - DNA, 248 bp, Homo sapiens
gagaagaagaaggaggttcctgctgtgccagaaacccttaagaaaagcgagggaatttcgcagaggctgaaggatcaagcgcctcagaaaggaagttttgcccaaaagatgcttcgaaaggcaaggaggagcttatctataaaagcaaagcactatcacaggaatatggcagatgtacagacctcaaatcgatgcaggatggccagaaaagctggccactctatgctgcctccgcacccaaattggcg

SEQ ID NO: 606945 - DNA, 221 bp, Homo sapiens
tatctctatcggcagtatgtagctctggggggtgcacaccgactcctgcaggactacaaatccctccaggtatatcattgccatcctggagatatgagatgcactttgctgagtgaagacaagttgaccgtgtcccgtgcacggcacaacatacagcgtttctgtgtctccagcccattcccagggttgctagcaggatcttccacagcatccaaccatca

SEQ ID NO: 606946 - DNA, 593 bp, Homo sapiens
cgcggtggctcatgcctgtaatcccagcactttgggaggccgaggtgggcggatcatctgaggtcaggagttcgagacctgcccgaccaacatggagaaaccccatctctactaaaaatacaaaatcagctggacacagaggcgcatgcctgtaatctcagctactcgggaggctgaggcaggagaatcacttgaacccgggaggtagaggttgcggtgagctgagatcgcaccattgcactccagcctgggcgatagagcgagactcagtctcaaaatctttgtatttcctttttctcccttttggaaggagaatatctattctctgcctttctcaccattgtgttttggaagtaaataactggttttgatttcacaggctcacagcaggaagggaatttgcctcaggatgtatcatgccttgactctcgcttatatatgatttagatagactctggaatttgacttttgagttgatgctggaatgagttaagactttggggctattgggatggaataatatatttggatgtgagaagacacgaatttgagggcagggctctatggttgaaagtgtccccgttattgtggtt

SEQ ID NO: 606947 - DNA, 346 bp, Homo sapiens
gtaccacgttgtagtgtgctgcttgtgtcacattgatgcttatacaagatagtccatctgttatcaggcataccaaacacacacgacggttcacacagcatatccaccgagggaaaataacagaactgacacactgcgataggaaaagctttggagctaacaaaatctcttcagaagaggcacatttcataatattcgtcatcacagcccacatcagatctggaggagaccttttttagaacagtcgtccgatacctaacgaaaactcctgcctccgtctataggcggaactctgacgctcgtctcagacgatagcaccacggttggaaggtagtagaaattgcaa

SEQ ID NO: 606948 - DNA, 322 bp, Homo sapiens
  misc_feature (247)..(248): n is a, c, g, or t
aaggggatattaatcatcttctctctggtcaggagtagctgataggaggccgggcgtcggtgtcacgcctgtaatcccaacactttgggaggccgaagcaagcagatcatgaggtcaagagataccatcctagctaacatggtgaaaccccgtctctactaaaaatacaaaaattagttgggagtggtgcaggcgcctgtaatcccagctacttgggaggctgaggtgggagaatcgcttgaacccnnaaggcagaggttgcagtgagccgagatcgcaccactgcactccgagcctggcgacagagcaagacttcatctca

SEQ ID NO: 606949 - DNA, 112 bp, Homo sapiens
aaatggatcatcgattttttttttaatcaacgtgcaatgaagaatgttggtttatatatcactataaaatccagttgacctggacagctattatagtgtacatagtctagtt

SEQ ID NO: 606950 - DNA, 749 bp, Homo sapiens
ccagctcctgaccgcgagtgatccgccagcctcggcctccggaggtgccgggattgcagacggagtctcgttcactcggtgctcaagtgttgcccaggctggagtgcagtgtcgtgatctcggctagctacaacctccacctcccagccgcccgccttggcctcccaaagtgccgagattacagcctctgcccggccgccaccccctctgggaagtgcggagcgtctctgcctggccgcccattgtctgggatgtgaggagcccctctgcccgagtgccagtctggggaggtgaggagcgcctcttcctggtgcgcgatgccatctgggaagtgaggcgtgtctctggccgactgcccgtcatctgaggctgtggaggagcaccttcaggccaccgtccgatcgccggtctggtgcgatgtgaggagacgcctctgctccggagcagccggctcccagtcttggtgcaggtgttggcacctgtcgcttgggccgtgcactgcacggtctgtgcacgaatggcacctaccgtgcagaacagtacgtgctatgagcggaaattgatgcagcatttacgaacagctctcatgaggccacaatcctattaattcaacgcggcttggtcgcaaggggaagacgattacagctgacgacaaagcgtgcgtagagaagtaataaagccacagaaaaaaagataagagaaaattgtctcatacgtatcaagcctgctgagcgattacataaaaattc

SEQ ID NO: 606951 - DNA, 1043 bp, Homo sapiens
  misc_feature (1043)..(1043): n is a, c, g, or t
ggttgcgctgggcttggttgctgctccatgagccctgggagttgcgatccgttactcgcggtgggctccctgtcagtaatactacaccagctgctgctgtccaaggcagagccttgcctacgatgtcgttgtggctctgggctgcaccagtgcctgggtagagccattcacgcgccattgtaaggtgcggagttgcagccccgcggcctataagtccctgggtggggtctgtctctcgacctcaggtcggatggcttctagcagtgcgtggcgcctgggggaccgggtgactctggcgggctcgtggccttcgtgtcgcggtagaagcctgagtttcctccgtcaccgtgcggcctgcgctgttacacatggtccgggcgggcccggacctgtgtgttgtttgcgccccggtcgaggcctgagcgggagggcgctacggattgaggcggtccgcgcgtaagaagaagttgattctgcttgacagccgccttgccatctattgcctgagaagtaaaatgacctcacgaataatcacagcctggattagcaattttgcgggtacctagtggaggcccgtacaacttcctggcaagcaggagttgagcctcccaggggagggaggggtgacttgtgactagagccaatgtagccgtggtgctctgagcagcggctggtattggtagcagcccctaggttgttgattctgctctaattgcacaagctggcgtcgctgggagcatggcctttcgttggctggagacccggccattacgagcagtgatgcccggttccttgtcctttgatcttgtttatgatgcggatccgcgcgccgttgtcatcggaccgtgtggtggtgctgcatggcccataggggcgtgttcggtgtggcggggagtggcccgtggttcacccgggcacacgcaacaggtggcggcttcggttgcctggtgcggccgggtcctttgtgttgcccctctttgtgcccggtgggccgcggagctttgggggccggcggctccttggcgcgggcgggagggcgcgcn

SEQ ID NO: 606952 - DNA, 988 bp, Homo sapiens
agcgggtcgtccaacggcaggcctcaggagtgatcgggcagcagtcggccggccagctggacggcagagcgggcggacgggtaggcccggccaggctctagcgcgaggaggaatgaaggtggccactctcgcacggtcccctagtaacctccccagcacgcacagacgaagaccagacacagaagcggtcaaggggagacagctgcagagagaccagaggagcaggcacttaccacgcagtgtagacacggccgatcagaacagcacagacacaactgagaggagcctatgaccgatagacgtagagaagtctgagaccaggtaggcagtacatcgagcgtggcgatgaaactgtggcttgacagcggcgcactggggaggaccgagcagaagtgcccgaccaggaaaccgaacgaagtccaggagtgtctcgaaacacttgggggggagaacctactaggatcacgacgacgcgcggcactcgcgcctcgcaacacgcggcgtcatgccacacagcaactcaacccaggtaactcgacgagcgaatcctaaagcaaaggggcaagcccgggggcgggcaaagggaaacaacccccgggaacgtcgcgaagacgtaccacaccaacagacggccccaaaaacaagccatgtggatccacacctaggactaggagcagaccagagacggcagggtcgccgcagaccgtgcacatcgccacaacgggggtcccaacacgggcatggtgcaaccaaaggaagcgtgcggccgtgaaaggcacaaccagagcagcagacgccaacagacacacacggcccgcactcccaccacgaggaccgaccgccacaggcacaaatccaccgcgcgtgccgacacagacagacacgccggcggcggctgaaaccaccccccgtgtcacgaagggcagacgggcagcgcacgcggcacaaggagcacaacaacagaccgacgaggcgcgagcaacaccac

SEQ ID NO: 606953 - DNA, 1235 bp, Homo sapiens
gctgactacgagtccaagggcatcaaggctcacttcaacctggatgagcagtggcgtgctcagctctagcacaggggctgccgctctgtacttctgcgacacctggtagacggacagcgcagaacgaggaactcgtactctcacgcaaaccttggcaacaccactttccagcctgctccgcgcacggcggctaccaccaccagcaatgccaaggcagaactggatgcctgactacatgtccaaggcaggcaacacggcaggagccactgccacgcagggcgacgcgacgcgaccgacgccatggcgcgagcaccggctgcgcacgcctccccggcacggacacggcccagcgcgggcccccagcctgcgaccgagcactgcgcgtatctcaaggccccacccagcagcccccttgcacaccatatacaacggggactcacatcgctagacaccgcctgcacggcgagaccaacagcggccaaccacgaaccccaacgaaccaactgggccgaacacacgcccgtggcaggccacccccgtaacacacacccagcacgattcgagcacaatcggccacgaaagggcgccccgagcccccttgcccgcgacagactagccgacccaaagctccccaaggaagcgcactaacggaaaagaacagtccaagccaagccccccgacccaggggacacggcagaggccgaagacttggcctccacatgcgcccaaccgccccagccggcccccccgccccgcagcctcgacaccctgcccaccgcacccaagccccagacgcgcacccccccaccgcgccccaaccagtgcccgcccaccaacagactccacgcaccccgccagccaccaccaccacccagcgcccaacgcacgcgacccgccccaccacccaccgagccatcagccctctccagagaccccacaccacaccgaacaccccccggcccccaccggccacccccacacgcaactacccgcaacccgaccaccagccggagcaccagagccacgaaacccctgcggcagggccaacgcacccatccacaaggagagaacgaaacacaggacgagccacccccccccgcgacaagcgccacaacacacgaccgcacacgaacacacaaccaaccgcgaagcacagcccacagccccccgccccccgacacacacccctcgcacaaacccacaagcaccaaaacacccaccccggacacccacac

SEQ ID NO: 606954 - DNA, 641 bp, Homo sapiens
tgaaaagaaaccagaatctgctagaaccccggtcagaagcgagcttatttgctgctgctcagtctacgcttaaattatcttcagatccttggggaactcaagacgtatggtgggaaagtcttcaatgccactttgatgttacaggatagagaatcttacattgccctcctggttggggccaagtacgggattagccagatcatcaacagcaagctcaacatcatatccacgctggcagagttcgccaacatcagccgcgtggagctgacagaagagtctgagaaagtgagcatggtcaaggtctaccttcaggacgttaacggttctgacttgtgttgctggaatccagcagtgcaaaagacctggcctgcttgatcgctgggtactacaggctgtttgtggacccggccaactccgtcttccactggtctggaaacagacggccgacgcaccgggtatccgctgaagaaggctacgagtccagggcctgcagtgactcggaggagtcctctgaagtggactgtgtactggagcccctttctgaccgatgcctggtgaagctgagcctctgcagaccatttgctagagaggagctgccccctggcgacagcccacacctgaggcaagcagaagaggtccaa

SEQ ID NO: 606955 - DNA, 331 bp, Homo sapiens
tgcaatcgtcctccttctcgaatgtgctatttctctgccctaagaaatgaggcaaccctccgggccaaggggcaataagtgtccctcctgtcctgtgttccagccatcacccggaccatcaaatgtgcccacgagcggtcagtgcacctgttcatcgactccgtgctgcaccccggcatgcagagcacggcctacctgtgcaaggacatggacagcttcagccagggcctgtgcccgagctgcaagaagggccgctgcaccacgctgggttactacacccaccaggagcagcagagcaagaagagcaagagcctcttcctgatgactcgag

SEQ ID NO: 606956 - DNA, 417 bp, Homo sapiens
tcgcatttggggttgcggttcccccccttaccccttccccggggtctgggtggtagacattgtcaccgcgcccctacgtggggtcgcgttgccaccccatgcggactccccagctgtcgcgccctcgccattgcctgacctggcaggcaccaccactactcacctacccatctgaccaaacaataggctggctgcggtgtactctcgagctgcacatgacgtcgcgtccagacctggccttcgctctttactctttgcatccacagatggctaggtggaccccagcatcaacgatacatcactccttggttcgcagaggcgcatatccccgtactcgctccatccctgtcatgaacataagtggtcagaacacaactcagctcccacgtagaccccacccgccaaatagcccgacca

SEQ ID NO: 606957 - DNA, 1288 bp, Homo sapiens
tgcagaagtaccgcctgcggagtaactgcaaagatgctgtccagtgcgcgttgctgcggacgtggtccgcgcccttcctcggcgggccggactggtctccagaaatgctttggagttcatctttcattgctgccacaggcaacttccatgcctctcaaccactccatcttcacaacagcactgggactgctgcagatgtcctctcatccttgacagcagcgtcattcttgtgagctgcatcacctctgttgcatctctgcacagcaacacttgggacgtgtcattcaagtcattcggtgcatggtcattgccctgcgtcacatggagctgcaggcacatgttccaagccagcacagcacacatggtcacagttccactatccaggctttcacacagggtccatgtcccattgtcaactttgcgaacaccttgccaccacattgtcacgcgtcgtctcgtcaggtgtaaagggcaacattgcatcaacactccaattccacggcaaggcaccatccatccagtcgcacagcaaggcaccagtgcagcaccatctcgttggagcacgtttcaccaagatatgagatggccatagcaaccatgcaagcagggtacgatggtccaggttcgcattgccccctctgggttccacataggcctccattcgcattgggacacaagggtgtcccccgattcagggtctccccaacaagcacacgccagcacagcgccgacagcttctgggaccatctggccaccagacccccccggtagcacattcacatattccctccggcaacaataccccgaggctagcccgggagcaaacccaaaataggcaaagcacctagcggcactacttcacaacgggcttggttcgcacaattaagacccttgaggattgaccccacattctagggctaccacaatgggaatcacagtcatgattgcaacaccctcgtcgcatctacctctcgcagttcgaacccagaagcaacgcaacgcgggggtcgacaagcaaaccccctatccacaactgggccacactccaggccacacccccacaagccccatccacaaccagccggaacaacacacgggatccccagccgcctggcaactgacgaacaccccatcgacacggcaccaacacacaacggcaagaccagcagcaccacaagacacaaatcgaaccacggtcggcccaacaactgtgcgacacacaccaaccaaccgaataccccaccaatgggcatcgccccacagaagaggcagacacaacgaccgaagc

SEQ ID NO: 606958 - DNA, 642 bp, Homo sapiens
  misc_feature (155)..(155): n is a, c, g, or t
  misc_feature (216)..(216): n is a, c, g, or t
  misc_feature (318)..(318): n is a, c, g, or t
  misc_feature (334)..(334): n is a, c, g, or t
  misc_feature (424)..(424): n is a, c, g, or t
  misc_feature (590)..(590): n is a, c, g, or t
  misc_feature (596)..(596): n is a, c, g, or t
  misc_feature (604)..(604): n is a, c, g, or t
  misc_feature (611)..(611): n is a, c, g, or t
  misc_feature (619)..(619): n is a, c, g, or t
agatcgacaaagctaacaaatgtctcaaatggttaactttccgggacagagatgaacactctaggaatcagcggactaagtaccttactgaatattcctcgggcgtggaaacgtccgggactgaaccttagccgaccagaaagaaacaagtagcnaatataatcagcttcgaaggaacctaactaacctcaaaatccaattacctcatagatcatngaccttataatcatctcactttactttcaagaacctcaagctatcatctagataatacgtctaaagatacaaatgtagacaaacgacaacaccgtacaagcnaagaaacaaagagcanaaaaataagacgatagacgaaactaaacgaggaactcgaacaacccggaaaaactctgaaccataggccgtagaagtaaaagtggtgtantagagcaaaatagaaaacaaaatcgaagtaaaaatctaacgctgatcagacgctctaggatagaatttcaagatactcacccacataaaatgaaacaaaacgacagcagatgggttaacaattcaactgtttggtttacagaacgacaacgggttaagacgggtcntgcganttgacggnagcttangttgtccntaaatatccgctcctcttctccc

SEQ ID NO: 606959 - DNA, 1084 bp, Homo sapiens
  misc_feature (963)..(963): n is a, c, g, or t
  misc_feature (1084)..(1084): n is a, c, g, or t
cgtaggtctatccatccttcccgttcgacatgccgtgacagcctgactgcacaactctcggtatctctgccagtggcggcgaacgagagaaagcccgtggaaggagtcaccattgctaacaacgatcatattcactatgcaggtaggccgggcgctaggaatgtgattcttagttcgtgtggccgtttatcaacccatagacaggaggtgctcttccatcctaatcttatgatgagggctcaatcgaatatgccattactagtagcaactgaattcgaggtattgtcaactcgcacgtgccacgatcacgcactatccagcactatatagagcgcgcggctacttccagattctagtttgcacagaccacgtaagactccctgccacacgcttcgcgtaacatcgcgtaagtgcatcgacacgcataaccacttagatgttgtggccaatccactcatgatgagtagagtagtactcagcctaggacacatacggggaacccatgctttttccttttctgacctcccccaggcacagcgtacgtggatgtggatgtatcacacacgaatctcatataatcccaaaactttccctcaatattctagaataaatatcttcggcgaactatctcgcgtgtaccacgtcaactaattctccttgtaacttactaaaccaggtgactatatctgtgaatcctcattatttcctcattcatttgtcacctcctatctcacctatctgcctttaatagtaaacactatataaggtgaatctcggttaattgatagttgcgtctagaaggccataatgagtattctctatttgggcttcccaaaggggatataacaatccgctagatgggtcaatcgtcccaggattatgccccacctcgcataagtggagcataacccagcggtatggacggcgcacagaagccacttagttttttcacccgtgccgaanatttacccctcacattttttccgccttatacgctgggccagggcggcctcatacagagtcatcttaagcttgtacacctgggcaaataaattcccagagtgaaagccccatgtttggcacn

SEQ ID NO: 606960 - DNA, 141 bp, Homo sapiens
tacatgatacgaaccgaggtgtaccgccctcggatcatcatcttaggagcaagacagagacgcaggaatggaaagcggagttcctaacaggatgaaagttcccccaggcagcaatgtgctattgaaacttctaaaactagg

SEQ ID NO: 606961 - DNA, 190 bp, Homo sapiens
tttaaaattctacttgtatccatttcaaaacctacctgaatttcactcagtcccacaatattaccataatctttgagctgttggcaaaatggatccattttataagtcatgccttttgcattgagcttttgcctgtctcatatttagataaatttgaaagcaaaaggaatatcactgtgttgaatatctt

SEQ ID NO: 606962 - DNA, 214 bp, Homo sapiens
ccttttgttttttgttgtaaaattttttttttcatgcctatgctcatagtaaatagtttgcaaatgaaagttgatttgccatacttttaaataaaattgttttagcttgaatattctataatacccttttatagagtataacatgctaaatccctgttttgttgtaaaaagggtgtaaacattttgttaataaaatgctatgtttccaaatata

SEQ ID NO: 606963 - DNA, 180 bp, Homo sapiens
cagacggtgcctggaagtaacgtagcgtagcctttggattcttaatcgccatgcttgctgcactgtctccaaagaatctttcattttctttcagggtcgcgatcaccggtgttttcctccgagattccttattcaagacaatctacaacttccacaggagctcgcccctgagctgcaggg

SEQ ID NO: 606964 - DNA, 420 bp, Homo sapiens
gtgttgggctacagaaacaagaccatttttaaaaggtcttgccataggtacatacgacagttgtgcatcaaacatttgcccagaagctttaaaaacctaataaagctaatatcgtttataaaccgaaaagcacaaacagagaggtataaattctcagggaagaaatggcagtcagcagactactaaagtataggacatcagtagaggacaagacatagtacaacaaaaataatagttcaatataggacaccaatagccttcataaaccaaatcaacagccactttggatatgtggtggatgaatagtctacagtaccagtggtggcactgtgtatgaaataggacagattgtctcaagaaatattcatgatattctgtagaaattgctaaatatgaatcaaagggaaacactatgtagga

SEQ ID NO: 606965 - DNA, 138 bp, Homo sapiens
tgggaatacgggtggactacctgaactgcaggagctgtccccacctcccctgctatctgaacagctcgctcatacagcagggttgggacttctgttaaactagaatttaaacaaaaggccaagtcgtattaagcactc

SEQ ID NO: 606966 - DNA, 316 bp, Homo sapiens
atgttcacggctgttgttcaagacgtgactgcgtgcctgctggacgctcattgccccccattgagaagattcgtcgtcctgagaagtcgcgtgctggaggtggagtgtgtctagaagcatttgcggtggacgatggaagggccggcctcgtcgtactcctgcttggtgatccacatctgctggaaggtggacagcgaggccaggatggagccgccgatccacaccgagtatttgcgctccggcggggcgatgatcttgatcttcatggtgctgggtgccagcgcggtgatctctttctgccattgggccaagcggg

SEQ ID NO: 606967 - DNA, 354 bp, Homo sapiens
  misc_feature (16)..(16): n is a, c, g, or t
tcggtaccatcgctcnaaaacctcaaaggcagctgtgcgcggtggcaaacgcctgtaatctcagcacttgggaggccgaagtaggcagatcgcttgagctcaggagtggagaccagcctgggcaatacggcaaaaccccgtctctacaaagaatacaaaaattggggtgtggtggcacacatctgtagttccagctactcaggaggctgaggcgggaggattgcttgagcccaggaggtggaggttgcagttagccaggatcacgccactgcacaccagtctgggcaacacagtgagaccctgtctcaaaacaaaagaattttttttctttgctgtgccaggtgatggaggaac

SEQ ID NO: 606968 - DNA, 493 bp, Homo sapiens
  misc_feature (38)..(38): n is a, c, g, or t
  misc_feature (59)..(60): n is a, c, g, or t
  misc_feature (89)..(89): n is a, c, g, or t
  misc_feature (106)..(106): n is a, c, g, or t
  misc_feature (113)..(113): n is a, c, g, or t
  misc_feature (145)..(146): n is a, c, g, or t
  misc_feature (178)..(178): n is a, c, g, or t
  misc_feature (183)..(183): n is a, c, g, or t
  misc_feature (256)..(256): n is a, c, g, or t
  misc_feature (279)..(279): n is a, c, g, or t
  misc_feature (337)..(337): n is a, c, g, or t
  misc_feature (351)..(351): n is a, c, g, or t
  misc_feature (375)..(375): n is a, c, g, or t
  misc_feature (412)..(412): n is a, c, g, or t
aggacacccttcaccttagaagttgtggctcagtgcanataaagttgagacagagtttnnacatccagccccacctctctggaacgggnagatgactggggagganacacagnccagcatgggaacaggggtcacagtggacacnngggtgggctgtctctccacctcctcacattangctancagggacgcagacacattcaggtgcctttgcagaaagagatgccagaggctcttgaagtcacaaaggggaggngtgaagaaatcctgcatctcagnccctcacaagacagctgtctcaggcttttcaagctgtgagagacacatcagagccctnggcactgtcgctgnacgcagcctgagagtagctccctncttttccacctgagctcttcctcctacacatcacagnagcgaccacagctccgatgaccacaacttctaaggttaagcttaaccttagaagttgtggacagcctggtaggcaaacaag

SEQ ID NO: 606969 - DNA, 115 bp, Homo sapiens
tctgtagtccaggtactcatagaagctgaactgagcccagaaatcaaggctgcagtgggccgagattgagccactgcacttcagcctgggcacaacagaagtgagaacttgtctc

SEQ ID NO: 606970 - DNA, 138 bp, Homo sapiens
tacgtctgtcagcatgtatcaaacacaatcacagcagtctaatctacgcgaaccatcttgcttatcagaggtgcatatctaaattcaatagcttaccaatatcttcttgggacgtaggcaaaaggaaacagaaaaccc

SEQ ID NO: 606971 - DNA, 175 bp, Homo sapiens
gttcggtcacctcacgacgcggacgtcgcctctagttcccgggtcaggcgctcgctttcctgcttgagccgttcattctcttcagctagcggtgccactttcctttcattctccgtgtctttctccttctggcgtggctttgcagggtcgggctggcggcacatgaccactctgt

SEQ ID NO: 606972 - DNA, 846 bp, Homo sapiens
atggagaaatcacttgaaagtctctttaggaaatggaaatttggttctaatatttctctacctggaagacatttcctatttctggcatgctgcattttaagaatatgcataatgaaaattacagccataggacttgctgaatacaattttatcttacacagagcccttacactcttttacagtctacagtttggtatcgttttcttctacttacacttttctttccaaatatttctcttttaatgcccttacgttcataaaatacaacaaataaaaatcgttccagaataaaaacaacctaaacttctttatttttccaaaatttccacctaaaggcagtgcctactccaggattacaaaagaaagtatgagttcttccgaagaaagtgaagaagcaggttagtcatgttataataaatacttaagagtccatcaatatatagatggaaagtactgggcaatgttttttacagtaataattgtctatattgtaaaatttgagtgaacagtttttcctagagaaaggatgctcatttttgagtagctgtgatatatcactacagaccataattagtttatgtcttcatctcacagatatttataatattcaacaatgccttcaagtgtgcttccagagtctaactggtgtatcccggtgggttatggggtgacttggcaattggcagagtgggcccggaatttctttggctagtttgatggtatagagcagccggactcacggcctgggtcaggagcatcatctacgccaagagcggtataaacacacagcagggctggagtgcctgataagatccactcagcaaactggaacacgcggccggacag

SEQ ID NO: 606973 - DNA, 914 bp, Homo sapiens
  misc_feature (1)..(1): n is a, c, g, or t
  misc_feature (10)..(10): n is a, c, g, or t
  misc_feature (599)..(599): n is a, c, g, or t
  misc_feature (736)..(736): n is a, c, g, or t
  misc_feature (741)..(743): n is a, c, g, or t
  misc_feature (749)..(749): n is a, c, g, or t
  misc_feature (752)..(753): n is a, c, g, or t
  misc_feature (755)..(755): n is a, c, g, or t
  misc_feature (764)..(764): n is a, c, g, or t
  misc_feature (774)..(774): n is a, c, g, or t
  misc_feature (777)..(779): n is a, c, g, or t
  misc_feature (790)..(791): n is a, c, g, or t
  misc_feature (799)..(799): n is a, c, g, or t
  misc_feature (805)..(805): n is a, c, g, or t
nctggccgancaggctttattcattattgaaccattggtaagcatttaaaaatatttgtacacacacacacacacacacacacacaaacaggacttgacaatatcactgcccctgctcagtagtagctttgtcaacaaacaagtagagtcactgaagtgaaatattcactgtcaattagcagctgggtcaatgttactaattgtcaaactattttttttgctataaaacacatttacacacaatcttgtgtagaaacccactatataaaacagacaagggccaggtgcagtgtctcttgcccataatcccagcactttgggaggctgaggcaggaggattgcttgaaactagatgtttgagactagcctgggcaacatagggagaccccacgtctaaaatcatacaaaaattagctgagtgtggtggcacatgcctgtagtcccagctactcaggaggctgaggcaggacgattacttgatcccaggaggtcgaggctgcagtgagctgtgatggagccattgcactccagtctagatgacagagtgagaccgtagcttaaattcactttgcttgtttttcaattggtgtatttataangcacttgtcttccaaagtagatttgtatttcagatgataatggcaatagtgctttctttgaaaacctatctgggtgatcttggcgaaatcaactgggtgaaacatagaacacacatttgttctttgaatggggcttnatctnnnggctanccnngnggtggcatnaaaaataacngtnnngctcccacagnngggacccntcccantgtttaaagctgaattgtctggttttgccgaatccttgcacaacctggccatcaaatttttgcaaaggaatgtgtcctttttgtcagacctattctaccgggcctggag

SEQ ID NO: 606974 - DNA, 184 bp, Homo sapiens
aagagaaagtcagaaaatgttcttagattgtactctaatttcactaactgacaaggggtagaacagaataatctcagattgcttcattcctattaaagatgaagcccaaagaacgcatggcgactaactttagcaggaacaatatagcagacagaggcagggactgtgcatgatccccatctgg

SEQ ID NO: 606975 - DNA, 148 bp, Homo sapiens
  misc_feature (12)..(12): n is a, c, g, or t
  misc_feature (29)..(29): n is a, c, g, or t
  misc_feature (105)..(105): n is a, c, g, or t
  misc_feature (116)..(116): n is a, c, g, or t
ccgtgagggggnaaccatgcggttgatgntgggggcttcaagaacgcgcaggccaggacgtcaagcccggacaaggccgggtcggccgggttcaagtcaagggtntttccaggggnagggaacgggatcaacaaaagggccacttgaa

SEQ ID NO: 606976 - DNA, 173 bp, Homo sapiens
cgaagtcacttggccaccatctcctcaagtggatcatcaactccacctatccaaggcctccccagtccgtagtgtgcacgcagtcatccattgccaaccacggctctcctgcacacacgtgtagccactggttgtcgacaccatgccgcttcctcaggccttaaccccagctc

SEQ ID NO: 606977 - DNA, 198 bp, Homo sapiens
gagtactctccaggttgtgggcttgtcgtgtgtgtacgacatccgggggatatccttcatagattagatgctgtcatacgttgaggacatttgacaatgtacgattttttgctaaggtctctgtgctctggaacactctctcgcgcatggattttggttttcatgctctgtcctcccctcctttggtcctcacaagac

SEQ ID NO: 606978 - DNA, 937 bp, Homo sapiens
gcagagtgccaggagccggagcagccgaagcctgctgccctctggcgcgcatgcggagagtggcgtcatgaaacccgtgtgaatccagatcaagaccgactccagcgctccgtcaactcgagagattctgcattcatccatcaaggattcccgtttgagagtgaggacagacagggacatcgtgtatgaccatgggatggagaccgggcactcagacccatgaacgaagccaagttggagagaagaacatcctgtaacaccatgtttgaaaactcctacagcaaagcaggttatcaaccgacaggtgaggagacctgaagaaacttcttactgggatgggacacttggagagcaacaagaagcccataatgatgacgactgccgacgtacatgaaacacaacacagtcatcttaccaggatgcatcacaaagatagaagaggatacttatgcagatgacatgaagaaatgcatccgaaatttaagagcaaagatgacacatgaaagaatgactgacactcaatggttgcatagacaaatgggacaagaaggataataaaatgatagaggatgggaggaaccccaagcacacatagagacctaaggtagagacgactcaaaacgacatagaagacacttgaaaagagcacattgccaacgggtattcataatccaaagacaaccatgccaggatccaaaggaaacacaaatagacacagccggggccagaagacccaggacatcgacgcccaatgagataacaggaaacaggggccaacattgaaaagcaacaacaacgagaccctagataaacccccagcattggcgttacacaaacggacacattgagaacaccagcacaataacctggggaaaacgaggaccacatggagccctaaaagcaccaagaggcattagagcaacaacgacaacacaag

SEQ ID NO: 606979 - DNA, 380 bp, Homo sapiens
  misc_feature (337)..(337): n is a, c, g, or t
  misc_feature (355)..(355): n is a, c, g, or t
  misc_feature (379)..(379): n is a, c, g, or t
taatccacacattcaatgagttaggctttgcacttgtaaggaaggagaagcgttcacaacctcaaatagctaataaaccggtcttgaatatttgaagatttaaaatctgactctaggacgggcacggtggctcacgactataatcccaacactttgggaggccgaggcgggcgggtcacaaggtcagggagttcaaggaccagcctgaccaatatgggtgaaaccccatctctactaaaaatacaaaaattagccaggggtggttggcagggtgcctgtaggtcccagctacctgtgagggtggagattgcatttgaggccaagatcttcaacactngcactccagcctgggggnaacagcgtgaggacttccaccttna

SEQ ID NO: 606980 - DNA, 472 bp, Homo sapiens
ctatctagaggatcccagtgctacctccacaaacagcatgatactggtaccaaaacagagatatagaccaatggaacagaacacaggcctcagaaataacactacacatctccaaccattgatcttgacaaacctgacaaaaacaagaaatggcgaaaggattccctatttaatacatggcgctgggaaaactggctagccatatgcagaaaactgaaactggactccttccttacaccttatacaaaaattaattcaagatggattgaagacttaaatgttagacataaaaccataaaaaccctagaagaaaacctaggcaataacctttaggtcaggcatgggatataattaaactaaagagcttctgcacagcaaaagaaactaccatcagagtgaaaaggcaacctacagaatgggagaggatgtggagaaataagaacgcttttacactgtttgtggaggtagcact

SEQ ID NO: 606981 - DNA, 455 bp, Homo sapiens
atttatgaggtggacaagcaagattgtcgccaattttgccctactggcatcgatggagccatgacaatttgggatttcaaaacccccgagttttccatccagggcctccggataatgtgaaactgagtgagcctcccccatccagcatgacaaactgtggccgaccccaactgttccgtggcacgatggcgaggaagccagccccaaggaaaccctgaaaacccatatcccgccaatgccgtgtggttttgtttgaatataaaattggtgaaagggttggtttttttaaggcaggaaattttttgtttgtttttttgcgatttcattccatttttggcccaagcttctctttaagtagtttattatggaaaattgtccccctaacttaaaagacagggtgagggagatatgtaaattgtcccctagaaaattaaataaaaaaactgaatgtggga

SEQ ID NO: 606982 - DNA, 109 bp, Homo sapiens
acctacaaaatcccaacacatataactgaactcctcacacccaagaggacccatctatcaccctcatagaagaactcatgttcgctatacgtaacatagaacaccttct

SEQ ID NO: 606983 - DNA, 992 bp, Homo sapiens
gagcaggtccaggaccttttcaataagaaatacggggaagccttgggcatcaagtagcccggtccaggtcccctacatagcggatcaagagtaaccccggtctccggtgtatcatcgaggggctgctcccgcaggaatcccgttccgaaatgccctgtaccttgcggctcccagaacctggaggaggattcttgctgtggctgacaagatctaagttccacagtcgaccaggcctttcctaaggactcatcccaaagcctgatgaacgatgacgccaacagactcggcggagaaggtagatcctgctggggagcgaggtgaagtgaactcttccaacgagaaatacggtgaggccctgtggccatgaaccggccggtgctggtcccttataaactaaatccgggacagcccagacgccgtggaaggtcacgggatctgcctgatgaacatccctcgttcctggaaatgcctcaacactgtacgatcactcccaccgtggtggtacgaagaatccctgaaaggccctgagagtccgtgtccgcatggtcaatcacttaagcgcagtctccaaacaccctttggcctgaacatctgcaatgagtggcaaatgggtggcctagccaaaagacgggagctgattcccaaagcgcagagaaagcgggtctcggaaggaaattccgtctgctcttccctccttagttggtcctcttcctcgttcctctcagcccggcttcatgtggatctggccaacccagagtctcactccgtggttgacgttgccccgattgggattcccggcgctcatctctgtgggacgtcaaccctttgtttggaaggccgttctctggatttgggcccggggacggggagggctgggttggggggaccaccggcccggggtaaaggaccccgtgcccgaggtgccaccctcggggggccccggccgggataaccaccgggggcagggaggcagtccctcgccgcgggtgaag

SEQ ID NO: 606984 - DNA, 432 bp, Homo sapiens
ggtcctcttcccaaagggaaagccccaatcccccaattagtgtaaaaaaatgcttcgggatgctgacccaaagggctattcagaatctttggccggggaggaagtctccttaaaaaaatagtttaaaccatttgttaaaaaatttcccgtcttatttcatttctggaccagttgatatctggctgccccttttataaagcaaagtgagacctttccccaccgtgtttgataaatgttgtcccggttctattcccaaaaatgtgttgtcccaaaagcctgtttagtttttaaaaatggaacccccccccttgcttggttttaagtaggtatggaatgttattataggccatagtagtaccggtggtcccacatggaaatggtggggagccaaaaaaaaacatgtgaaataaaacccagtttttttttaaagta

SEQ ID NO: 606985 - DNA, 242 bp, Homo sapiens
aagctgctgcacatggctgcggcatcatggcaaagtgtcggatggtgctctcctccaggtactatctgctcccacttatgtcatagtaaggcctccagggccaggatcagctcactccttctcccgacacaagttccaggacgggctgggcgcattgtattccgcgcatgtagcgctggccctggccactttccactgtttctcgctggcgttctcagatgcatccacgctctactctccag

SEQ ID NO: 606986 - DNA, 113 bp, Homo sapiens
gcaatgtagcgatgtggtccaaagtcatccagcatctgcttcaccaactgcccgatctcctcctacagatgcatacaaggcacacggggtccatggttgccctgaaattgtca

SEQ ID NO: 606987 - DNA, 194 bp, Homo sapiens
tgctagtcccaatccatctcggttgcttccagaactaagacgtaatgaccatagtcacaaccgcctcctaagtcctatctgtgtgagggtatctcttattgctgccattccacctgagatgcagtcttgcttctgatttactgtttttgttggaaaggcagcaggatatttcaagggcttccatgcagtctttc

SEQ ID NO: 606988 - DNA, 504 bp, Homo sapiens
  misc_feature (381)..(381): n is a, c, g, or t
atagctgactctagaggataaaacgacgcctggcaattcctgaggcgactcctgggggcctctgggttcctaaagcgggggcgaaggactgggtgcagtgtcgctgccctgttagctggctgaagcgcactgggtgcagaagtagtggtggtggccggcagagggtttccggagagctccaggtgactcctgtactgcagccagttgcggccgaaccgttcccggaagctgctcatgagctccagctccgggtgctgctgcacgaaccatccagccggagaggggttcagagttcggggctccgggtccgtatcactgggttcagagatgcttgcccgcctcacacggactcggctcttaaccttatgaagcaggggctgngtcacaacaccccctgaggagaggctgtcactcaggtcagggccacctgaggtttcaggagtactccccactggccagtgcaaaggtgggcccatggggctgagccccaaggatgtgtgagtt

SEQ ID NO: 606989 - DNA, 214 bp, Homo sapiens
ccggggtgttcacgggacggtactggtttatgacttagatgtgccaaaattccccactctccagaaggaaagcaggtgttgagtgtaatcccacattgcttattatatagaaatggcaacgaaccctctcttccggtcgggtgtggaaaactgggcaggagctgtttaccggcaagttcccagattcccgcctgggcacggcaagactcaccta

SEQ ID NO: 606990 - DNA, 195 bp, Homo sapiens
gccacggaagattagcgtggtggcataggctctcttgatacaggaaaaagatatgcatgtgcgtaagtccctaggtgcaagcttgtgcagttatgtttaaagcacccttataaactatgtgcatagaagatattatgtacatttatttcagataaaggacaataagtttacttggtatctgaactcaaaacaaag

SEQ ID NO: 606991 - DNA, 382 bp, Homo sapiens
gcacagggacatgagggaccggcccctcagttgccatcagcagcctcggtggcacctgtgtcatcggggacccgtgcatgagcagggcacggtcactgccctctgggatgggaagcgttgagggataccacagagagtctgcgtggtgtcaccctacaagctctccacgccgcgtgtcccttgtccctggtgagggggcactggagccagggtctctgccaccggcacagcgcttgcagatctgctgtaggttccggtgtagctcttcctgctgtgggctgatgacaacagttgtgggacttgcttcacatggcactggtctgagacacttggtggctgactgggtgttgaggagtgaggggcagggaggggccgaggatga

SEQ ID NO: 606992 - DNA, 399 bp, Homo sapiens
cgttctacacggatccccctggcttgctcaggtctgaatgcaatggaactatctcggtcactgcaacctccgcctcccggtttcatgccattcttctatctcagcctcccgtttagcttgtattacaggtcgcgcaccaacacatctggctaatttttgtatttttagtagagatggggtttcgccactcctgccctcaggtgatccacctgcctcggactcccaaagtgctaggattacaggcatgagccactatgcctgacccaatttttttttattttttatttttttttttttttttgttggttttttttccctttttttttttggggttttagcgggggggtttttttccccccttatagggctctcttaaaaaaaggggcgggatttttggcc

SEQ ID NO: 606993 - DNA, 433 bp, Homo sapiens
atgccccaaatgggcttcattgccagggccacccaccctaattatagagtttgagtttccctttggacatatttgacatataaagcccgccctggttattcgggaagcccgtttttattcatttggcttaaaaaattcgttttggctgggggttaagacaaggccaaccggtaatcctgttggtattctcccggttcctggaatggcatggtgcatgtgatcaaaggcatccagtcgggatcccaaaattaaatattcttgtactaaaggataccgactcattggttcctcgtcgccacatgcatcatctcaggtgatactgtcatttgggataatgaaacacctatttgtgacagtgagttgaaatatcccttcctatttcttttaccgacacattctaatttttctctggaataataaaaataaataactg

SEQ ID NO: 606994 - DNA, 348 bp, Homo sapiens
  misc_feature (200)..(200): n is a, c, g, or t
  misc_feature (204)..(204): n is a, c, g, or t
  misc_feature (208)..(208): n is a, c, g, or t
  misc_feature (213)..(213): n is a, c, g, or t
  misc_feature (216)..(216): n is a, c, g, or t
  misc_feature (219)..(219): n is a, c, g, or t
  misc_feature (254)..(254): n is a, c, g, or t
  misc_feature (286)..(286): n is a, c, g, or t
  misc_feature (298)..(298): n is a, c, g, or t
ggcacgtggtgaaattccgtctctgctaaaatacaaaaaatagccggggggtagtgggtgcatgcctgtaatcccagctactcaagaggctgaggcagagaatggcttgaacccgggaaagtggaggtggcagtgagccgagatcgtgctactgcactccagccggggcaacagagcgagattccatcttcaaaaaaaangaangaangaaantancanggttaccatggagatcctgcagtcacggggacatnctcaaacatcacaaggatgggggtcaaaaatngaaaccgggaanaagaaaactggactatgatggtggaataacgcaaccaagtgggagtccgg

SEQ ID NO: 606995 - DNA, 122 bp, Homo sapiens
ctagtttagaagtttcaatagcatctgaaagaaaagctgggcatttcacatccatgaagtaggaattagggctctgcaccaggcgtttcttcttgtgtttcctcttctcctcttctggagag

SEQ ID NO: 606996 - DNA, 299 bp, Homo sapiens
tcagtccatggtatagctggacactgcagcccctcgtaccctgtaacacgagaccacgttggttccagcaaaggccaaggcaggggccgagctcacatccttctcccaaattcaccaggcacacaagtctgtcctcacccctgtgtcgcagatagggaacacctccagcagtcactccatgtggatacctaaatgcgaaatacctacttcccccaacaagagttatcacttttacattaccgacccccacaacaaccctgggaggcaaaaaaacaggtctcacaaaaacaaaaaaaaaa

SEQ ID NO: 606997 - DNA, 132 bp, Homo sapiens
tctcatataagagcgcaggccacagaagaactcatattcagggggattgcatattggggactctggcatagtccagtgtacttctgcttcacaaactcatcagtgatgagcttcttcacgtcccccaagagt

SEQ ID NO: 606998 - DNA, 798 bp, Homo sapiens
gagcgggctgcggttggcagcggcgcgatggagaagctgggggtggatgccggaggacggaagtgcggcggcgacggacgatggacgactgcctgaggcctgggccatgtgaagctggactggacagtgtgcgggcaggacagccacgcgtcgcatgggtagttcatgagtcaaggtgttgcccagaccaaaatgcttcatccagagtcatagtacatgtggactctggattgctttgctgcacaagtagaaactgactctcaatatccaagaggctacaaagactaacctttaggggttcaatcagaactattgggtggtaacctgcaactatgaaggctcgggacacttggatgttagcgaagcttactgaatgtcagagatgctagcgatgaacacgtgtccacaggttggtattaggttaactggagaagacctgacgccgctacatgaggaatactgtcttactagagggttccacgaacttgactggagagacattgtagtccagtctgttgacgaagcactttgcgcacttccgcttcgcacacaatcctttgttgggatcttacacacgcagacctgtgcttgcagcaaggcagaactacatgcccagtctagcatatacgctgcattgcagacttatgctagtccgagtcggaacttgtggttctgcggtacaatgttattagcaagtaaatgcaacgtactattgaacccttgccttggactgtgcgttgccaccactcatggacttaccttgttgtgggatcttccagccattgcgcccagacgaag

SEQ ID NO: 606999 - DNA, 296 bp, Homo sapiens
  misc_feature (41)..(41): n is a, c, g, or t
  misc_feature (89)..(89): n is a, c, g, or t
  misc_feature (190)..(190): n is a, c, g, or t
  misc_feature (217)..(217): n is a, c, g, or t
  misc_feature (220)..(220): n is a, c, g, or t
  misc_feature (236)..(236): n is a, c, g, or t
  misc_feature (289)..(289): n is a, c, g, or t
cagccctgagcaaaggggttctgaggtccataccaagaagncggtgatgatcaagaccatcgagacacgggatggggaggtcgtcagtnaggccacacagcagcagcatgaagtgctctaaagacagagaccctctgccaccagagaccgtcctcacccctgtcctcactgcttcctgaagccagccttntttccattccagggcaacacaaccagnctnagttcttccccttaanaggcttttgaccccttcttaattggccattccttggtgggtcccaaaaagggncattggg

SEQ ID NO: 607000 - DNA, 115 bp, Homo sapiens
tgatccaccgccttggcctctcaaagtgctgggattacaggtgtgagccactgtgcccggtctcggcatgctctttgattcctggaagcaaacgtgggactgctggtggaaggga

SEQ ID NO: 607001 - DNA, 112 bp, Homo sapiens
atcatcagatcgtgggactatctcctatggctacatggaaaagaaagctgtcctgaatccccacgagggcctggtcagcctcttcccaccacaggcacaccagggtcagaag

SEQ ID NO: 607002 - DNA, 564 bp, Homo sapiens
gtgtaaagagcatccacactgtttattttccttcacaatgttcttctatcagaaaacatttaaaagttagcgaatataacctgagctactatagcttcataaataacacagatgtgtgctaccaatggagtaaaaaaggtatatgaagatacataataaaaaacccagataaactaacttaccactactatgtctacaaaagtactcacattcatccaaaagacggcagcaaaagggaactagattaaggaaaatatcataaggcataaacaaaaacgaaataaacatgataaaactaaatctcgcacacatatattaccttatatataaatggtctaaacactccacttatacagatagtgccccaatagatttttaaaaaatatccacaatagaagtatatgctctctattatgctatatcagaaactcactttaaatatgattagattagaagcatgataaatgatatgctaccctcaaaataaccaaaagaaaactggaataacctatcagtattaaataagtacaatagaacgcagggaggggtcactctaaaagagcc

SEQ ID NO: 607003 - DNA, 303 bp, Homo sapiens
  misc_feature (294)..(294): n is a, c, g, or t
cataatcccagcactttggaacgctgggtggattgcttgaacccaggagttcgagaccatcctgggcaatatggcaaaaccccatctttaccaaaaataagctgggtgtggtggaacatgcctgtggtcccagcttcttgggaggctgaggtgggaggattgcttgaacccgggagtagaggctgcaatgggccatgatcacgatcctgcactccagcctggggcaacagagagagacagtccctgggcccactgcccccttccctgggcccagtctcaaaaaaaatgaggctngggcgtggg

SEQ ID NO: 607004 - DNA, 229 bp, Homo sapiens
agctgactctagaggattcacgttttattgaattagctgcatgcaggagcaattctgttcttcccatgagcagcagagtcgagtgttagagtgcagtatccagagcggggagaggctgtacgaagttggtgtcctgccgcctgttccctgtctacttggtgacgtgcagagctctctctggggggctgcagctcatcttgtggggagctggactcagatgcccccgtag

SEQ ID NO: 607005 - DNA, 327 bp, Homo sapiens
ccgaggcccgagtcggtgaggattgggcagcagcagaaatttattggtctaggtctttgcgcaactgagtgcggcgtggtcggctttagtataaacaggtgctgaaatatggcgaatcaaatctgctttttctgactggggagtcaccgtgatcgcaacagctctggtactggtagcggcgttgttgcacgcgacgtggaacaccttgatcaaattcagcggcgagcgcctgttggtcatcgcgtgcatggacacggtggcgttgttgtttgtggtgctggcggtggggtttgtatcgtttccaccgctggaaatctgggtcgacgc

SEQ ID NO: 607006 - DNA, 382 bp, Homo sapiens
gtgatttggggccttttaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaatttttgtatttttagtagagacggggtttcaccttgttggccaggatgatctcgatctcttgatctcgtgatctgcccgcattggcctcctgaagtgctggggattacaggcatgagccactgcggcccggcccaaatcttttatttttttaacagccttagttatttataatt

SEQ ID NO: 607007 - DNA, 324 bp, Homo sapiens
caggcatactacgtaaatcgaatgtaatgtgaatggaatatcaaaacaggatctaagatggtatagtagtagaatacaaagtaatatcatataaaagttaaatgagtatggaaaaggtctgtactctagttttgtccagtacagtttactgaaggcctatcattaacattcatattcatatcattaaacaaataaaaatcatgtagaattatcgtattttattgccactagagggttcagcatgatagacctcaaaaaatcgacaatactaggttgaaatattgtagcatccatttagttattctttttaatactaataactag

SEQ ID NO: 607008 - DNA, 359 bp, Homo sapiens
gactaggtgcaacgaacatctaatttgactactctgtctccaggtcaccgggaaagatcatacaccgcatgcattccataagggggcaataatgtataggaaggacatgaaggcatgacacagcattccttcaggttatctgttgcatgtatactctatgcattgtattgttccagttgctgtgtatggagggataaaggaaacaaacacctctgctctcatggaccttttacagaaatatgccatatatggcaaagtcccctaatggacatataacaggccattgcaagagagaacatgggggcctctgaagagcataacatttaagctgacatcttaagaatgggcatcccatttgg

SEQ ID NO: 607009 - DNA, 196 bp, Homo sapiens
cgggcttttttggaaaacccaaaggggctagccccctgattcaaagaaatatttctcagggtgggtccttctgggttatattttcctttaaaaccccttggggtaaggttaagccttttaaaagttagttttggagaatgagacccaatactaatccggggggaatggggggggccctgccttaaacctttctttg

SEQ ID NO: 607010 - DNA, 125 bp, Homo sapiens
acaatactggacttcggggcattctggacttcggggcagttctggactatcggggcaattctggactatcggggcaattctggactctagaataggattgccccgatagtccagaattgccccga

SEQ ID NO: 607011 - DNA, 148 bp, Homo sapiens
gtcttggtgccgcggtcggtctggccgacgcgggtgtgcttggtgacgtagttcacgccttcgacgatgacgcggttctgctcgacgaggacctcgaggaccttgccctgcttgccgcggtctccgccgcgctcgggcttggcgcccg

SEQ ID NO: 607012 - DNA, 286 bp, Homo sapiens
tcagccgttacctgtgagacgggtctcatggcgggacacaggaaagacgccacggcgacgggacacgtgacgaaggtgagatggcggtggccaggcgggtcttgggagtccagtggctgcaaagggcatcccggaacgtgatgccgctggtgcacggccagcctcccacatgagcaaggacatgttcccggtgccctatcctaggagcccagaagaacgggccgccggcgcaaagaaggtataatatgccgtgtggaaagactacgaacaccttacccgggatgac

SEQ ID NO: 607013 - DNA, 129 bp, Homo sapiens
tcactggggcggtcccaatgccaagtggaactgttgactgggaccctgtccacgcctgcttttaagtcctgctcgcggtgtaaattgtttcaccctgtcccttaataaagctctctgctcccttgaacc

SEQ ID NO: 607014 - DNA, 144 bp, Homo sapiens
acctgagctgatcatggtcggataccctcctgttgacattggcttgacatgctcaatggtgtcactgggctcgaactcaagggtgctggtttgccagtgcgggtcttcacaaagatctgcatgttgcgtgcgcacgaccgccgc

SEQ ID NO: 607015 - DNA, 1501 bp, Homo sapiens
ggcgtagctctgacctataggcttgatacctgtatcatcagcgccagttcttaacttccgtgtggacagctggatgtcgtcactgcaaggcttctcgaggagcagcttgctggagctggctcgcaggctgctgtgcgaagggcggctcgacccttaggagtctgggctcacgggacgctggagtgcatgcgccgccatagttggacactctactgaagttggactctaagatgcgcttgtgtggaggccccctgtttgagtgcggcgctctgtgacgagcatactcgcagaccttcatatcttggctgccttgaggagtccagtgctatgcttgtccaggtcgtagcaacgcggtgtatactcgcgtcgtcgcgcttggggagttgttccccaaggtcgtcgtagtggcctctttgtcatgcctcagtaggaactggggattcacccttgtgtgcttggtccttggttgagcccccgactggaagcggcgcatgctttgcacggcgttgtagatttgcccttcccgcctggcgagggtgacgagcgactagtgataagcgagcgggccctgtttggccattgagaccgttatgcctcagcgtcgtttcttgttgcctgcgtagggcccgcgagtgtgggcatcgacgttgttgacgccgccctttgggatggttcccgtcacataccacgtttttggtccgcctctggagggcgtggtatcccaattccctgccatagccccacgtttgccgcaaagggagagacccgtgtccgcttccatttttagccccccgttttacccaatgagttaaacgtcataacacgattcaatacttcgagaattagggccgtaagcaaccacaagagcctcacggcactcgcccatagggttatacaagcaaaaacacaaacatgagcacgagggatacatttaggcagtggaatcaagaagtggccttcacacagcagagtaggctatgagcccaaccagttttaccataaaattttgggaaagaatatcggacgttgttgtgccccggtcaccccccgatggatactatatagtgtgacacccacaaattattgacgtgaacatgacccatgtggccggtcctctgggggccttgcacatcttatacattaagcgtcgcggcgcacgcggcattgcataagagctttgccagaggatcacccattggacagtatagattacaaataccaccccgagtataaagcttaaaccaacacgaagttaatcttaatacacgaacctatgagaattagaaaacaggcactagtaggtggctatataccaccaacaataggagacattagtattagtaaccagaaaaaccaaggagacacccatatagagcatagcatatgaacagaccccctaggggcccaagttgaggtaactaggcgcgaacaagaaacagaacagggacacacccattacattggtcccaaggagagcctatgggtatggggccacaccact

SEQ ID NO: 607016 - DNA, 843 bp, Homo sapiens
  misc_feature (26)..(26): n is a, c, g, or t
  misc_feature (109)..(109): n is a, c, g, or t
  misc_feature (147)..(147): n is a, c, g, or t
  misc_feature (159)..(159): n is a, c, g, or t
  misc_feature (334)..(334): n is a, c, g, or t
  misc_feature (369)..(369): n is a, c, g, or t
  misc_feature (377)..(377): n is a, c, g, or t
  misc_feature (387)..(387): n is a, c, g, or t
  misc_feature (406)..(406): n is a, c, g, or t
  misc_feature (416)..(416): n is a, c, g, or t
  misc_feature (423)..(423): n is a, c, g, or t
  misc_feature (435)..(435): n is a, c, g, or t
  misc_feature (439)..(439): n is a, c, g, or t
  misc_feature (447)..(447): n is a, c, g, or t
  misc_feature (449)..(449): n is a, c, g, or t
  misc_feature (452)..(452): n is a, c, g, or t
  misc_feature (475)..(475): n is a, c, g, or t
  misc_feature (479)..(479): n is a, c, g, or t
  misc_feature (481)..(481): n is a, c, g, or t
  misc_feature (499)..(499): n is a, c, g, or t
  misc_feature (508)..(508): n is a, c, g, or t
  misc_feature (533)..(533): n is a, c, g, or t
  misc_feature (535)..(535): n is a, c, g, or t
  misc_feature (548)..(548): n is a, c, g, or t
  misc_feature (556)..(556): n is a, c, g, or t
  misc_feature (573)..(573): n is a, c, g, or t
  misc_feature (629)..(629): n is a, c, g, or t
  misc_feature (642)..(642): n is a, c, g, or t
  misc_feature (722)..(723): n is a, c, g, or t
  misc_feature (735)..(735): n is a, c, g, or t
  misc_feature (745)..(745): n is a, c, g, or t
  misc_feature (813)..(813): n is a, c, g, or t
cctggctatcggggtgaacgcatcantcagctcatccgtcagctgaactagacccaggtgccaaactgcggtaaattttttatcagtgaagtggaagcatgtgtttttnttttggaaatttttatcaagtatcttcagagaagattntttcctgctttntcttcagaaactggaaagggtcaaagaaaagacagtagctggccggtcgtggtggctcatgcctgtaatcccaacacttagggaggctgaggtgggcagatcacctgaggttgggagttcgagaccagcctgaccaacagggagaaattctgccccgactgaaaacacaaaattngccggatgggggggggcatgccggtaatcccagcnacttgggnggctgaggcnagagaatggcccgaacccngggaggcagnggtggcngggagccgagancacnccattgcncnccnccttgggcaacaaaagcaaaacnctgncncaaaaaaaaaaaaaaaanaagtgccancgtatgaggtaattagattggttcncnccagaggtaaccngccaagangagatgctatagatgtnactcctatactgtaaaacattgtgaaatcagattactttaaaatgatgtattacanagttatgcaaaanagcagttgtgactatggaagcccaaggcttatatcccagctctgtctacactaaatatgggtacagtgtttccactctgnncataaaatgggngctaatatcncaacctgtgtgccacatgatggttaagggattaacaaacaatagttgtaattatctgcagacaactgntggtaataaagggctagtgcgaaattattt

SEQ ID NO: 607017 - DNA, 666 bp, Homo sapiens
  misc_feature (151)..(151): n is a, c, g, or t
  misc_feature (177)..(177): n is a, c, g, or t
  misc_feature (229)..(229): n is a, c, g, or t
  misc_feature (242)..(242): n is a, c, g, or t
  misc_feature (252)..(252): n is a, c, g, or t
  misc_feature (266)..(266): n is a, c, g, or t
  misc_feature (324)..(324): n is a, c, g, or t
  misc_feature (363)..(363): n is a, c, g, or t
  misc_feature (365)..(366): n is a, c, g, or t
cagttccgcctggtgacaagattgtgaatgaggcagtcatgtgcctgcaagaggggatcttggccacacctgcagagggagacatcggagccgtcttggggctaggcttcccgccttgatctgggaaggcctttcctgctttgatggatcntgtatggcgcccagaagatagtggancggctcaagaaatatgaagctgcctatggaaaacagttcaccccatgccagnctgctagctgacncatgcgtaancagccctaacaagnaagttctaccagatgagcaggcctcatgcctcgctcagtcagtgcactaaccccagcngccggcagtgctggttctccaacagagtggtgtctagantnntcagagtaacgagaagacaaactgtccggcacatgggctgttgctcgccatgattaagagtgcacttcagaccaagtaccattctctctcctcctggtgaagtgtgacttcgaattagtttgcacttcctattggaaggtagagcccactgctcattgtataagccccgaggcctagagtgggagccaagagccatctgaagccacctctctgcctgttcctcccaagaggccaggtgggcaggggtggtgagggcagttctgctacgccagcaaacacataacaataaaaacaaactct

SEQ ID NO: 607018 - DNA, 817 bp, Homo sapiens
  misc_feature (81)..(81): n is a, c, g, or t
  misc_feature (817)..(817): n is a, c, g, or t
ggcccggaccccgccttcggcgctcggtcgcaggatggatcccgtacccgggacagactcgggccgtggtgcctggccctnggtccgtcggcctcgtgcacccccgccggcgggggggtccacgcgcgatctccgtgcaccgtgtccgagggggggcaccccggccaggttttgtgggcaaaagaaggtttccgcggcaagaaaattcgtgggcttatttcccgtggtggcctttaggttcttcgtggggccacgctttaaagaaggaaccccgggaaggagaaaaaccggtggtgtggccccggaattaatcccaagggattccggttgggtggaacaaatggaagccccctcgtttggccctggggtgggggcttttcttcccccacgcggtttgttggtgggacacccaagtggtaatttcccaaaaggggcccttcttgggtgtggttcccaaagggaaacgaaaacacagggaccattggttggttgcttagacacggctttggttgtggccccccgttgggtgaagggcccacaagtggtgacccaccggggcgttggttgtgctaaaggcatttgtccgggggctttagataggttggtgcaagagggacccaagagaacccagggtggcccgtttgggagttaccccctttcccgacaccttacaggcgcgcgaccaatgtggggcaccgggcattttgttcggccaaattcgttgggtggtgcaaaagagaagggggccaaagtgggccccccggaaggccaataggtgggcccaaaaagggccccccggaggggtacatcaaaggcn

SEQ ID NO: 607019 - DNA, 134 bp, Homo sapiens
gtgaggagcacagagacactgtgctgggccagctggacacagtgagctgcaggacctcgtctcctctatcgtctcttgtacaggatggtggtagggatgatcttgctgctggaactgccagagacactgccacc

SEQ ID NO: 607020 - DNA, 394 bp, Homo sapiens
cccaaataaagtataggcgataaaattgaaacctggcgctataatatatgtaccgcaaggggaaagatgaaaaattattaccaagcataatatagcaaggactaacccctataccttctgcataatgaatttactagaaataactttgccaggagagcccaagcttagacccccgaaaccagaacgagctacctaagaaacagctttggggaacacacccggcctatgttttcataattgtgggaagatttattgggtagagggcgacaaacctaccgagccctgggtgaatatctgggttggtcccagaattgaatccttagttcccacctttaaattttgcccaccagaaaaccctcctaaaaatcccccttggtttaattttaaccggttt

SEQ ID NO: 607021 - DNA, 132 bp, Homo sapiens
tagagaccctgcggtctctacctgatgacgacgaagctcctcagcttttgacggcttccacctgggggcgcctcagcctccttggtgtcacgctggcctccctccaagagcgcatgaagggtcaggaagaga

SEQ ID NO: 607022 - DNA, 403 bp, Homo sapiens
  misc_feature (92)..(92): n is a, c, g, or t
gatccgatttcccaagacaactaggaatggaaaaggaacccttcaatgaagttccataataaacgtgtctgggggggagaccaccgcttcanaaaaacctgatgaagggattgtgccaacagtctcctgccactgcgaccacctaaactaagaactccatctaaatgatccacagctggaccaacacagtgaggagacctccaccttcttcaatgtctccctgaggggccagtaatttcagggcaagctgagaggtctccacaggtctaaccccatataaatagccaacagtgtctagagtacattttatacccaacagggtataccccatggtgatcaaaataaaataaacctgttgtacaatgaaaaataactcaaaggcgtggcctcggtggcctcaaca

SEQ ID NO: 607023 - DNA, 123 bp, Homo sapiens
ttcggtccctcagtagcggagcggtcagtaagctcagtaagcggagcatagtaagcggagctcacgcctgctgggggtatgttgtgttgtgagctgtgttcatgtatgtgctccgcttactga

SEQ ID NO: 607024 - DNA, 411 bp, Homo sapiens
aaaaaagggggggggccccccccaaaagccccccccgggttaacaaaaaaaaccccgggccaaaaatgggggggaaaaggaaagaaaaaaaaattttccacaaaaaaaacactttgcccccttttttcccccaaggttaaaaaaccccccaaaaaaaaaaaaagggggcccccccgaaggccgggcggaaaaaaccgggggaaaaaaaaaaaaaaaaagggggaaaaaaaaaaaaaaattttttttttttttttttttttttttaaaaattttttttttttttttttttttttttttttattttttttttttttttttttttttttttttttttttttttttttttttttttttttttttttttttttttttttttttttttttttttttttttcctcccttctgtcgtct

SEQ ID NO: 607025 - DNA, 229 bp, Homo sapiens
cctgggttatgcattcattttttttgttcttgatcaccacataaatgaaccatatcataggcactattttgtgataagcttccatttcttttagagtaagtcctggcattcgtccatatagatgcaagagtcagtagttcattctttatagttcattgtgtaaaacacattttatttttccattctcctgttgatagacatttggtttcttttgatgattgactattat

SEQ ID NO: 607026 - DNA, 137 bp, Homo sapiens
  misc_feature (86)..(86): n is a, c, g, or t
tgtctagccaagatgaagcaggagctggtgaaactgaagaaggagagatatgggggaggattgcgcttttgtgtacatggagtgtncagcaaatgaccaaatgatggagtgagagaggtttctgaatggtacgagag

SEQ ID NO: 607027 - DNA, 531 bp, Homo sapiens
gctgatatcagtaatttggggagagtagggtgggtgccccagatccgatgaagccttcatacagactcctcttccaggagatatcttttcaaagcacatgtggtttcccactccccctttcaagcccatgaggaaaattaaagcatctaattgtagtgatgaattttactgatacagacaactgcttttccagattttctccaaatgtaagcacaattgctacatcaaccaaaatacctcctactgaacacaaactggcgttgtgtggcgcttgctgattcctggtaatatattaccgaatcataagctctgtgttggacagcactctctatctttcaatattgaaccaagccaggggagcaaattaaataggagaactgaaagttagctaatatctgcaaacttacttcctcttaaatgaacttgtccatcaaaccttcagatttcccctactttctcccttaaagaaacagatccaaaatatttcgtgattgcacaagctagctaatgtcacacagctgaagcactgga

SEQ ID NO: 607028 - DNA, 1049 bp, Homo sapiens
  misc_feature (282)..(282): n is a, c, g, or t
  misc_feature (642)..(642): n is a, c, g, or t
ttttgtccgtgagatgcggtagtataaaatagttcagaagcaagcaagcgggagagagagaaaaacagaaaaacagacagcaacgacactgaccgtgtgggcaccgatcatttggcgggcgcccctatctaagagtgtgattcgaaaggcaaccggattcgaggtatcctcgtttggttggttcgcctccgactgtgttggattggagccgcccggctctctgtggtagcgccgcccttgtcgctggtgctggagtgctcataccgccgcccgtggcccttnatacgacagattttatgggtgctcacccgctggatactagactgtcccatcgggtcgggctctactctcttctaagtttggtgccccgagtggttttcaatcacgggttgccgccgattatcaattattgtagcgctgaaatgatttcccccgtggcctgttgtgcggcaggccacaaagagaaagacgagttgtttctggcgcagctggtagcacacccactacattgggggggcccgtgctccctcttattctcggccaccatgagcgcaccggtgcgtggcttacactacacggtaaacagccccggcgtaccagcgagtccctcatctggtgaatggatggtcgtaccctacactntgtcgatatcttcttgttacccacactgcccgctcgttgtgtggtacccatcctcacaagaaatgcaccgccacagagtgagtggagctatgttcttatgcaccacgccgggacaccttcttttaggcgggccgcaatagcttgataatgttgacgctctcgccccgcggctcctcttttcaagtggcgtctcctaacccacgggaccttgatagggagtcccgccgccagtcatctttgccaccgggtgattgccactcttgcgtgcttacaggggggggggcgagctatgcaaacaccatccgcctcagaacacagtaataagaagagatttgttagaataaacaagcgcccttcaattcctctagtacaagtctcagagacgtactgattaaccgccttgcgca

SEQ ID NO: 607029 - DNA, 278 bp, Homo sapiens
  misc_feature (72)..(72): n is a, c, g, or t
  misc_feature (108)..(110): n is a, c, g, or t
  misc_feature (142)..(142): n is a, c, g, or t
  misc_feature (271)..(271): n is a, c, g, or t
caaggctttttccaaaaaacattcaaattacacatgcagtctcagagactatttagacaaagttcaagttanggagcttttacggatgtgggagaaaagctttaaaannncggggagggctggctgctggaagaaggaagangccagactggttagacagtactcttcactcctagcccagcctagcgtgccctgcccctctggccactgctgcagacacctgccttaacacacacatctggcttctcccttaagaagagagagatacttntagaatt

SEQ ID NO: 607030 - DNA, 267 bp, Homo sapiens
taatagacataccaagagaggaagatccatctactgtatactcactgttcgctgaacaggtcccgttgcagatacaaacttggattttttccagtctgatccttttgtcggccgtgatcctttcacggtactgatccttttggaagaatcgatccatttggtggtgatcctttcgaaggttcggatccatttgcatcagactgtttcttcaggcaatctactgatccttttgccacttcaagcactgaccctttcagtgcagccaga

SEQ ID NO: 607031 - DNA, 816 bp, Homo sapiens
  misc_feature (70)..(70): n is a, c, g, or t
  misc_feature (333)..(333): n is a, c, g, or t
gagccgtccaggtctcagtgctgtcccccccccagagcctagaggatgtttcatgggatcccagccacgncgggcataggagcccctgggaacaagccggagctgtatgaggaagtgaagttgtacaagaacgcccgggagagggagaagtaagtgcaggcgcccaggctgtcccatcacacctcatgcgcatctggctgccctggggcagcccctccagacccaccccaaactgaggggtgggaggacgcagggtcagtctggggaactgttcctgaggcactccaggatggacgcgagaggtacgacaacatggcagagctgtttgcggtngtgaagacaatgcaagccctggagaaggcctacactcaaggactgtgtctccccctagcgagtactagcatgcagcactgctcccggcgtcctggttccaatacaaagctgccttcaggcaggtccaggtctcagaaatcagctctattgactgaattctgccgtaagttccgcctggactgcccgctggccatggagcggatcaatggaggaccggcccatcacgcatcaaggacgacaagggcatatcctcaacctgctgcatcgctagacgtggtctcgctcttgatcacggtcatggacatagctgcgcctggatgatccgcggccatggatgagatccagcccgatctgcgagagctgatggagatcatgcacctgcatgagccacctcgcaccgactttgagggccgcaggacggtcagacagtggctgcagaccctgagcggcatgtcggcgtgagatgagctgggagcgatcaga

SEQ ID NO: 607032 - DNA, 125 bp, Homo sapiens
tgtcgaccaggttggagtggctgaggagcgagcttgggttaatgcaatctcctcctcccttgtcacaatgatactcctgcctctggactcccgagtagctgggactacagcgcgcctgctaccac

SEQ ID NO: 607033 - DNA, 663 bp, Homo sapiens
  misc_feature (70)..(70): n is a, c, g, or t
  misc_feature (180)..(180): n is a, c, g, or t
gagccgtccaggtctcagtgctgtcccccccccagagcctagaggatgtttcatgggatcccagccacgncgggcataggagcccctgggaacaagccggagctgtatgaggaagtgaagttgtacaagaacgcccgggagagggagaagtacgacaacatggcagagctgtttgcggtngtgaagacaatgcaagccctggagaaggcctacactcaaggactgtgtctccccctagcgagtactagcatgcagcactgctcccggcgtcctggttccaatacaaagctgccttcaggcaggtccaggtctcagaaatcagctctattgactgaattctgccgtaagttccgcctggactgcccgctggccatggagcggatcaatggaggaccggcccatcacgcatcaaggacgacaagggcatatcctcaacctgctgcatcgctagacgtggtctcgctcttgatcacggtcatggacatagctgcgcctggatgatccgcggccatggatgagatccagcccgatctgcgagagctgatggagatcatgcacctgcatgagccacctcgcaccgactttgagggccgcaggacggtcagacagtggctgcagaccctgagcggcatgtcggcgtgagatgagctgggagcgatcaga

SEQ ID NO: 607034 - DNA, 559 bp, Homo sapiens
  misc_feature (103)..(103): n is a, c, g, or t
  misc_feature (265)..(265): n is a, c, g, or t
  misc_feature (269)..(269): n is a, c, g, or t
  misc_feature (304)..(304): n is a, c, g, or t
  misc_feature (437)..(437): n is a, c, g, or t
  misc_feature (450)..(450): n is a, c, g, or t
  misc_feature (462)..(462): n is a, c, g, or t
  misc_feature (484)..(484): n is a, c, g, or t
  misc_feature (507)..(507): n is a, c, g, or t
gggctgcaggttttttttctgtttgaaaaaaggggtcagggggctccttgatattagggaacagggacctgagcttttacagcccttcatatttattaggtanagtgaatagggaggaagggataactgtcggtcagctatttgatttaacacaggcccacatgattcctttctttgttcaacaggttctggatgttcctgtggataacctcaaggagcacgggacctgggacatgactgcccccagcattccttctggcggcanacanagtttgtcagttcgccaacatcctgctttcatganaacagtttgctgtttgctcacagagcctccagtggtatactgagttggtcacgaacctcattccttcggcctccaacatctcccccttttgttttttgcattaattgaataaaggtaatttcaggctgtgcanctttcaattgccngttggtggtccnccgatcctataaaccccaggancctacagctagcatggccaaaantgattcggggtttttgcctaaccctggcccccatattccccaccccgttttc

SEQ ID NO: 607035 - DNA, 1333 bp, Homo sapiens
gcgtctaatggggctactctcgtgaaccttgccggattgttgcttatgcgaggttatggacagtagaaggcatacgctccctggtagagcgtatcttatgcgtagtctcggtgaacgttggctgatacgggaacagtggagggaagcgatggagtggtctgcgatatcatcagcggaggatcgtccgagagacggcacggagatccgagagatcgttgtgatatcgaaggtagagggaccgaaggaagagcctcctccgtgacttttacagaagagtgcggagcagaagccctgcgtttgccacatagctcgggaccgactagctgcaggtagacaacccatggccaccgctgtctgtcaaccggactagctcgcgcgcgtactgataggggacatggcccattgagtagctctacttaattagtggcaagacatgattcgaaaagcctagacctagtagtcggaggaagacgcgatcagtcgttgcacgcaatagtcgatcataggggcgacgcacttagccctagttccctcttgatagaaaatcaaaagctgattgttgagtccctagtatcccagacgtgactgcgccactaaagaagatacgtacgctagaacaatccgcagtctgaggcatagagaattcgccactgcggagaggtcgcatacggacgagcatgggtttcgcagggaggtttgctacaacacttcggttgaaacgaaacaggttccgcgttggggccctagtcgcgtgactcttggcttgccactggcagagacgaaatcgcccgaaaagccccttcatttctttccccactagttggtacgaattgccttgatagggttgggaccgaaagccccctgttgcacctgtaacgccagggctatgggaaagcgcatttggcgcccattggacactagacagaaacgaaggaaaggggcgcgataggggcgggtaggtcccccctttaatccaagcgcaaggggagagggggcaaccctctgggatttggttaaaccctgcggacagggggggcatattcaccaaaggagcggcgttgggtggcccaaaaggtaacttaacggatttgccccatttgctcttggaccttctaaaggaaacccttgtccgaattgaacagtgggaacctaggcctttgtctgtcgcctctcgcaacttggttcctctggctgggacgaacggcagaatttcaccgccccggtttgcttggcttccaaatttaacttggccaagtcgccaaaactttggttggtgcgcaagggaagtaacccacgaaaggtgctctgggaacaccttgctccttccaatcct

SEQ ID NO: 607036 - DNA, 992 bp, Homo sapiens
ggagagagaactagtctcgagtttttgtttatttaattaaaattatggtaagggggtccgcccaaaaggaaggggtggagggtggggtccctgcaggggacacgggaccacgatgacttggccagggccacaatttcttctgcgtggggacaaagggcttgcaaaaagacacgacgcagggctggagctgggggtggacacggagaggggcgaccagggatagattcccccgcccccagagaagacaaattaggcccgtggaccacaaagacacaccatggaccaccgaagacaacaaatcctaccacatatagccatatgacccaccatgacctaacactaccagcacacaatagaactaataccccccatgaacagaatactcacacatacgagacggaaatgtacaagggaccagtgaaaaacacaacacagccaaaataacaacatacagagcgggatacacaccaatcgtgccggagcccatgctacaaaggcaaaatgcctaaaaaacaaaaggcatgaaaaacgcatagatgagggaaaaagtaagtagaaacccgaagatacataagacagcagaagcaggccagcaacagagaagaaaaaaaagcagacaagcgaagcagaaacagtcaacacaccaaccagagaagaggagaagaccaacaaagacggagaagacagaaaaaagagaaaagaaacaaaacaaacacgaagagagcagagggacagagcgaagcaacgcagacgaacatacagcacgatgagaaggccaagcatagacaaagcatcagccacaaaaaggcacagaagaaaagacataaacagacagacgagaccacagacacgacccgaaaacgcgaaccacaaggacaagagacacacaacagtgaatagagcagatcaaacagagctaacaataaaagaagaaacacaaaacagcacacacgaagaaaaaacaacacaccaacagcgaaaagcactgaaac

SEQ ID NO: 607037 - DNA, 635 bp, Homo sapiens
ccctcctcccagggagccttgtttggggttttttgggtttttttccccccggggggtttcccggccccccccgggtccctttgcaatgagaaaggttatccccggggggtgtttcccccttccctcccccccaggaggtggtttttcccccccccccccccttttaagggggagagtgggttcccccccggtttgtttcccccctccaaagggccggggtttgaacctcccaaaccccccccaagaacccgcccaaatttttgctcccctccaaaggaattttggcgggttcccttttccggttaaggaaccgcgggttcttaaggggttccccctttgccccaattgaagccttaggggattttaattccccgggagggtttttgggaaaaaaaaaggttttaaaatggatctttagggggaaattttccccttttttttttggcgggggaaccttttccctttggtttacccccccttttataaccccaaggggggggtttttttttggtatcttcccggggggggggcctttaatttttaaggttggggttttttcccccaacccggtttttccgggggggggggccaatgtggaaggacccttttgccttaaaaaattttaggttttttta

SEQ ID NO: 607038 - DNA, 251 bp, Homo sapiens
agtgatacgataaagaactggccgacgagcgtccccctgaaagtctgatgacactatggatgatatgctgttgctcgatgagtatcctggttctatggctagctgtcatagagtggtctacacacatatagcaatagccactgcgacgagaatttcgcaagatacagcattattcccaatggcagttcctagatgtggttagttgcatcattctcaatccaaggatgatccttatcgaatgctcctggtat

SEQ ID NO: 607039 - DNA, 360 bp, Homo sapiens
  misc_feature (282)..(282): n is a, c, g, or t
tcttaccggttcgccatgattcccaggctgttcattgaactctggctcaagcgatccgcctgcttggccctccaaagtgctgggattacaggtgtgagctactgcacctggcagaatttgtttcttaaggactgagttctggtatcttcttttattttttttgagacagggtctcactctgtcacccaggctggagtgcagtggcacgatcatggcttgctgcagcctcaacctccccaggctcaggtgatcctcctacctcaacttcctacatagctgagnacacaggtgtgcaccacctatgcccgggctacatttttgtatctggtgtacgagacttgggtcttcactgttgttgcc

SEQ ID NO: 607040 - DNA, 648 bp, Homo sapiens
atcagctccgctaagatgctagcttggccaggtctgtgatgtccactgaaaaagtcttagcagagaattattgcatacccacccaaaagccctctcagccactcaaatggctatcttctccagtctacaaatttcatgttcccccccatcattacagttcttgatcatgttatttctccacttactggtctacgttggttaaactcactggataagtattataatagagctacttatctgtggttttaatacccttctgttaacaatttgcaggcaaattaatgtccttttgtaacataattcaacccaccaatgacctcgacaccatcgttaccttgaaaccgattattgatcatgcccacaaggatccaagctactggctgcctcgatataaggggtgcagggtctgtgctagatcaaaagggccggggtggcgatgtggcagagaagttacttgtagggagaacttgcttttaacaagcttctggaaaagcaagggaaaagtggtggccgctttccccctttccctccccttcaagcacccttgaatttgggcttatattaagagctgtttaaaacagttcttaattgtagagagccagggtttccactccttcgatgtcctccaaagaggataagcagctatac

SEQ ID NO: 607041 - DNA, 513 bp, Homo sapiens
tcctcatggtaacactcgtttttatataaatatccgcaagtcttgtacaaaaaaagccccaccgggaaaaaaagtcaacgtaagggtttggtaaaatggaccccgtgcctttctaggttggggccccagccctgttggaggccgcctgtgcgtgcttgggaaaggcggggggttgctgccgtgaggctgccgaaaaagctgcctgtgttcgcccacccctgtgggccgaccccccttcttgggtgtgtggtcacatggtgaccttctcgtggccaaccctttacccttggggcagaggttttgggagaaacgagggtttcgagggaaagccgagggccccccaggagagtcccgatgggggaccatctgtggaaaatgcgaggcggtcgaagaaggggacacggaaaccacaataaaaagagaggcgggaggagaatacgcgagaaaacaattaaaaaagagccctaaacacctattggaggcgcgtggggggagcagaagaggaaacgggaa

SEQ ID NO: 607042 - DNA, 372 bp, Homo sapiens
tgcgtatcatggggcgttgaaatgtaaaatatgggatgtcttccaagtgacacattttagtctttgctaacagataaatatgactattaagttatacagcttcatgttcaaatacggctggttctaatacgacactactcctgtacatcctacccctctcccattcccagagctacctactagaagttgaaaactattgcgatgtcttcactgggaagatccctgctgagtcaaacaacaaaacagaaacatgttggagaactgatgtctttggtgcaaagaaagaaatcacagaggaggtgaggcccatgctgttgccgttggccccagggatccatggtcagctttgactctcaccatacgcccaggtaa

SEQ ID NO: 607043 - DNA, 243 bp, Homo sapiens
  misc_feature (76)..(76): n is a, c, g, or t
  misc_feature (170)..(170): n is a, c, g, or t
  misc_feature (226)..(226): n is a, c, g, or t
attctataccctttggtgaacaattcatactcataactcagttcctacagaaactgatatattcacaatgccagangttcccatttacattgcaaaggcagacaagctgacctattattttaaggtttgagggttgttgcagaaggactctattttcttaaaagtatttnccttttatattgaaatcattcagttatttcttggattagttatcctttttctaagnacgtctataaatttaag

SEQ ID NO: 607044 - DNA, 405 bp, Homo sapiens
gtcatcttacgagtatcccctccgcacccttgcagcacctggtagctagcgcgatgtcgtaatcttgatcttaagtcttgcctggtgttcaaacgctggtcacactgcgagggttcatgactgggaacaccttttgggagcgggcgtggtgatgggaaggtcctctgtcccttgctcatcctgtgtactggctcttcctccttgtgttttctctctgggccaggaggaagtagagaggtgggatcagggccgatgtccccagcctggataggcagagtactgaaccatgggttccacaaccagaactcttcatggcagagacctatggcctagcctgtcctcatctgaagataactaggccgaacagattactcttaccacaaaaggccatggaggctgcctctg

SEQ ID NO: 607045 - DNA, 446 bp, Homo sapiens
cttagatgatcccggcctcctctggttgctggtgatcgattggtgcgtgtttatggtgttcctgagcggggagcttgagcctagagctggtatcccgaaatctgcgggctcgagcttgagtgcgcgctggggaagacgcacaagggcggtgattgctccagtggtccccaacgcttggtttctttccgtctcatccgggatctgcaccagcatctgagagaaagggattccgaagactatatctccatgagctcctagaaggcagtgaaatctatctcccagaggttgtgaagcctccacggaacccagaactagttgcccggctggagaagattaagatacagctggccaatgaggaatataaacggatcacccgcaacgtcacttgtcaggatacaagacatggtgggactctcagcaaccaagtgggcggccgggtaccgagc

SEQ ID NO: 607046 - DNA, 141 bp, Homo sapiens
gatggtgtcattgagtgtggtgagctcagaggtcagagaggccacctgtgcagtcaaccgggccccatgagcctgagaggcctgctccagctcttccttggcctggctgagggtggagatggagctctgcaggtcagtgat

SEQ ID NO: 607047 - DNA, 168 bp, Homo sapiens
cggctatctagagtacccagtaaactggaaatcgcgagtcaacatgttagctcggcgtagcccggccttttccagactgaaccaactgacatcttacatgtgttgatatgaggtctcatgtctccctaaaacgtatgaccaccttggccacatgtacgtcagagacat

SEQ ID NO: 607048 - DNA, 895 bp, Homo sapiens
  misc_feature (35)..(35): n is a, c, g, or t
  misc_feature (79)..(79): n is a, c, g, or t
  misc_feature (127)..(127): n is a, c, g, or t
  misc_feature (129)..(129): n is a, c, g, or t
  misc_feature (135)..(135): n is a, c, g, or t
  misc_feature (139)..(140): n is a, c, g, or t
  misc_feature (147)..(151): n is a, c, g, or t
  misc_feature (160)..(160): n is a, c, g, or t
  misc_feature (208)..(208): n is a, c, g, or t
  misc_feature (255)..(255): n is a, c, g, or t
  misc_feature (258)..(259): n is a, c, g, or t
  misc_feature (269)..(269): n is a, c, g, or t
  misc_feature (273)..(273): n is a, c, g, or t
  misc_feature (304)..(305): n is a, c, g, or t
  misc_feature (354)..(356): n is a, c, g, or t
  misc_feature (372)..(373): n is a, c, g, or t
  misc_feature (387)..(387): n is a, c, g, or t
  misc_feature (389)..(389): n is a, c, g, or t
  misc_feature (470)..(470): n is a, c, g, or t
  misc_feature (550)..(550): n is a, c, g, or t
  misc_feature (669)..(669): n is a, c, g, or t
  misc_feature (676)..(676): n is a, c, g, or t
  misc_feature (745)..(745): n is a, c, g, or t
  misc_feature (864)..(864): n is a, c, g, or t
gagtatggataaatgaaatgtaggtagaaccaganaataaaattttattctacattaaaaaaaaaatgagctagatatntatgacaagatagagagaaaattaaatggatattaataaatgaaagangnaatttnaaanngtatatnnnnnatgaaaagntatatactgtatgatttcaactaaattaaattctggtaaaagcaaaantatgtaaaaagtgaaaagatcagttgctaagggttaaaggagagggnggnntgaataagtnaaanatagaggattttttaagggagtgaaattatnntgtataataatataaaggttgaaaaatgtaattaaaaatttgtaaaaannnatattatgtaaaaaannaagagtgaaccctnangtaaactatggactttgggtgataataatgtgtcaatgtaggttcatcagttgtaacaaatgtaccactctattataaganattgacggtaggggagggtgtgaatgtgtggaggtagagggtatatgggaaatctctgcattttctgctccatttttgcngtgaacctaaaactgttctaaaacataaagtctattttttgtaaaagttttctaaggtcaacatagttaatactgaaaaacagcattttaaaaatcagttataaaataacttgtaaganttaaggncattcttcctaattgtccaataacgttgaaacacttcaaccatgaatatatttaaaataaaaatgatanatcgctttggcgacacccagtagaataagcttgactggctaaataaagtgaccatcttttcatcttcattttcaaatgcctctgcatcatgacattattggtagggattggagcaaganagagagaaggaggaaaagaaactattttttt

SEQ ID NO: 607049 - DNA, 329 bp, Homo sapiens
tgaaaatccccgctatagaaaatcaccgagacaatacacatggatactaggaacatcactagaagctcagcatatggtaagaccaacaattgtggcagaaaccctatgtcctactattctgggcaatgtttacatgttagcccactttgtgctcatcaaccttccctagtacaaatttattgagcatcatcttactgaccagctactgactttactgaatctattccttgatttgatgttacctttcatacaaatcacagtagaaaaacgtatgaagttttttcaatacagcctagatgctggcttctcacctgtgaatatagttttca

SEQ ID NO: 607050 - DNA, 398 bp, Homo sapiens
cgaacaattgtctctcctttttctcttcaacttttctttacccccttttaagtattttaatgctatggtgtgactgctatctattcgtcacgagtcaaattactttttttttaccagcgctttctttaatggctttttttgagaaatcagatgccagattcctctctttgcaccagttaggatacctttttgttggcaatttgtgattttcctttgcaaatgctaaaaattaaatatgatgtataaaagcaaaagcttgtcttcttgcctctacctcgcctcacttccagagttttgcatacccatcaccaggctaatactgtgaaaacatcattttcaaaacactaccccctacccaaagtccttcttcacccctagtcatttagactatcccaacc

SEQ ID NO: 607051 - DNA, 227 bp, Homo sapiens
ggcctttggccccccccaaaacaaggaaggtggttggggccaaaccccaagggcccctccaagcactttacttcttgttcctccccagccttaaccccaaagccctcctgccccccaaaaaaacccctaagggtggccaaaccacactttttccccaagggggttgacctggcccaattgggtccccagggccagcacatggaataaaaaaaccagggcccccctca

SEQ ID NO: 607052 - DNA, 126 bp, Homo sapiens
tcagtaagcggagcagtcacgcctgcttggggtatgttgtgttgtaggaatgcggtagtagttaggataatataaatagttaaattaagaatggtatgttgtgttgcatggttgctccgcttactg

SEQ ID NO: 607053 - DNA, 248 bp, Homo sapiens
  misc_feature (38)..(38): n is a, c, g, or t
  misc_feature (40)..(40): n is a, c, g, or t
  misc_feature (42)..(42): n is a, c, g, or t
tttttttttcattagtttttcaacgttgtggttggggngngngtgtgtgtgtgtgtgtgtgtgtgtgtgtgtgtgttggtgttttatgaaaacgtgatttttttattctattatttgaaccaggtattttttttctagctatatgtgagtgtgttttatgtgtgaagtttaaatttctatctgtgtatatgtgtgtctagaaaacactatggggtctactttttttttgtgcttttttttagcagaca

SEQ ID NO: 607054 - DNA, 138 bp, Homo sapiens
attctcttctgaatccttgcaatgttggatattacgatgttgctaagatacatattgcacctgtagcagattttacacacaagattatatattacactccactccatgattctgctagtaatgtgcacagagatataa

SEQ ID NO: 607055 - DNA, 684 bp, Homo sapiens
gaggaggcacaggtataagagggaagagcatgagctgagtgtacctgaccacggtggtccatgttcatgtgcctatttgctgctatgaggatcaagacttaggggagaagtttgccagttactaggaatctccagacattgtaccgcagaaccaagccttaacatttggtggcatcttcttgtgagatgtggagaccagaatcctagcagcattaaatgttagacactagagatgatgcccagctttgtgccacatgatggtggctacgtgcctgtaggcattttccagtgagctgaaagaggctgctagtggtcgaggatgagatatcatgcaattttcctaacaagagattgaaacccttcatattccccagaatgaataactgctgttccccatgtcttcagacatctgcatcaagctgaagttctgtgtcctcgtgagctgatttcagcttggcacagatcttgggggaggtgatcgacaattagaccctggaccttcaactttctcttgtctgaagcttgcatggggggccctgaagggtcagggcagatcggtaggccacacaggatcaattgtggatcaatgctcttgctctcttctccagggttcttgctgtgactctgagactggtgtaaactaaagactggttatcactcttctgtggtgcctgttggtcctgg

SEQ ID NO: 607056 - DNA, 263 bp, Homo sapiens
  misc_feature (52)..(52): n is a, c, g, or t
  misc_feature (84)..(84): n is a, c, g, or t
  misc_feature (107)..(108): n is a, c, g, or t
  misc_feature (115)..(116): n is a, c, g, or t
  misc_feature (121)..(121): n is a, c, g, or t
  misc_feature (173)..(173): n is a, c, g, or t
  misc_feature (191)..(191): n is a, c, g, or t
  misc_feature (198)..(198): n is a, c, g, or t
caacaccaactatctataacctagccatggccatccccttatgagcgggcgnagtgattataggctttcgctctaagattaaanatgccctagcccacttcttaccnnaaggcanncctanaccccttatccccatactagttattatcgaacccatcagcctactcattcanccaatagccctggccgtncgcctanccgataacattactgaggccacctactcatgcactaattggagcgaccctagaatatcaccatta

SEQ ID NO: 607057 - DNA, 186 bp, Homo sapiens
aggactggtcatgtcggcacgcccagcggcggctcgatcatggcgccggccttgacggcgtcgggaacggcaggtcctcggcctcgacgcggtcgatgacggccgggtcgacctgcttgaggtgcaggtagccgatgcgctcggggtacttgcggatgatcgcgacgttgtcgccgcggtagtagg

SEQ ID NO: 607058 - DNA, 740 bp, Homo sapiens
cgcggaggaggaggaaggggagtgagggcgaggcgtggagtgtgctatgagtggaccctcgccatggtgtcacgggcctagagtggcgtgaagatacctggcctgtgtgccaaactggctactgctgcttcctgtgtgcctccatgtgctgagtgactggctggactgccctgggccctgtgtgccctgtggctggaatgctgcctgctgaatgtctttcgcaagtcagggtgccacctgtggcactgctcagacgaccgtattaccagatgccccacatgtgagacagtgatccgaagcaaatgtttgagcttgactcgataccttgggaccctgcgtgttgatctcacccctctttctgaactttcaatacgaaggggcatctatgttgctaatcgcagacgcccacaagtgggccaatcacctgttggcaagtatgcgcagcgaacggaatgccgaagacgacagccctttcaatgtgccaagggcgaatgacatcggaaaagcgtccagtgttatgggcaacaccaaagaaaggtcgcgctagaggtggtccatgaggaaaagcgcttgtggccaccaggagtgcgactcgcatcagccacaaggtgcttgacagcctggaaccaacagtgcgccgcaaagcctatccattcccacttgcgctaccgtggcgatgacagattcgagaaaccttggtcaggcgaatacaagacttaattccagaggggattgtgcac

SEQ ID NO: 607059 - DNA, 782 bp, Homo sapiens
gttcttgcagattttatgtgctccccaccaccccctgttgtgcttgtgtagtagagttacaacaaggcatggaggctaacaggtgtgttcattttagctaatccagtttggctctgttatatagaggttaccctttcttataccgacagacccaattgaagactcctgtcttgatcctgtgtgaaagcaggaaagctacagattgacttggaaaccgagagtttggcttctattaacccatgcctgtcaaccgagaggagaactcatcatgagagtgtcttagcagccacgatgtgaatatggagcacttgaaatgggcttgtttcaattggagaaatgtgtttacaaagtgttaaaaactagcataagctattttaaaagcatgcattagttaggtgtatacataggactaggatacgtttgtagaaggtactgaaaagatgggtgctaacacatatgtttgaatttaatatacttgctttaaagtatagggctgtggtggttgaaagtaattaatttatgacatagtatctgagacttaaatttgctgtgtccttttggcttttcagccatttggttagtagaaattcagatgcatatatatagcatgcattaattctttaggataacattgctgtcggaggtcacgcaagctaacggcaagtgtgtctatcagtagtggtcctggatcctagaatcccattaaaagtatcctaagatcagctgggcatggtggcttacaactgtaatcccagcacttgggagactgaagcaggagactc

SEQ ID NO: 607060 - DNA, 436 bp, Homo sapiens
aatggtccatagcgtgcaacctggaatctaccaaactgcccatcccacccagaaaggacacattctacagaaccatatctatccaaagtaaaaatggggaagtgaggttcccatataaggaaaaatgccccataccaaaatacgacctataggagcagggtgacgtcatatggaaatccgaaataaactgaggggtgggggccagtggggggacgctctgtcactatctggttaccactgtattgaagcttcattgtggctaatccccctgcagaacctcaaaccacttagagatcaactccatagatctataggttaacatacatctagtatcacatggaacacagattacacctagtactgtgctttgaaagctcacgtgtaataaacttcctcttgtgataaacaatcagtggacaatccattccgaccctat

SEQ ID NO: 607061 - DNA, 206 bp, Homo sapiens
agcaccgcgtctagagtctaaaattgactggcgctggtggcgtgttgcctgtggtcccgctactcgggaagctgagacaggataatcgcttgaaccaggagttggaggttgcagagagccgagatcacaccactgcactccagcctgatgatagagcgagactccatctcaaaataaataaataaataaatcaataaattagctag

SEQ ID NO: 607062 - DNA, 530 bp, Homo sapiens
tacgccgacaccgtcattgacgcggcccgagccgggatcgttaccgaggcgctaaggggcacgttctggaaaagcgtctggacgaacatcttctccggggcgctctacacggtcatcctaatcgtcttcgctctcattctttcgaagtccggcatcgatctcctcggaatatttgagcacatgacgaagacagcaccggctacaggcggctaagtccgctcccaacagcagccgtcatccgtaagcctcagaagcgaggcccatagcgatatagagcggtcgtcgtttccgtgaaacgatgaagcggtctaagtggcgggctctaccctcggccttccgatgccgcgcagcctggccgccaaggcgggacttaccttgttgatctcatgcaggatgcggcggcggctgaaatggacctgtcggcgcgcgcgccactgcaggtcggtgtcgatggtcaggctgcgccggaaacgcgccagttggagcgcatgctgatccatcgcctgcttgaccgtatcgtcatagaattg

SEQ ID NO: 607063 - DNA, 203 bp, Homo sapiens
aaatcttgctatatgatagggcaaatctctcctccttgtgcttcagtttcctcatctgtaaaacggagataacagtacttacctcatagagctgttgtgaaaagtgatgactgaatatgtaaaagcacctagaacagtgcctggcacatgctaagggctttgttcattattgttgttattatgtaattttctctcaaactgag

SEQ ID NO: 607064 - DNA, 694 bp, Homo sapiens
ctagagtaagagtatatagacccaaggattcttatgcaggtcaagttcagatattgatatgaatatgagaataccaaggtcccatagtagttcagtagtaacgtggtcatgtctgaacagagaatgacactaaactaatgctagcaggtaaaaatcaatcataatgttgaaaaatggatgctgtcctcagcatgttatatcctcaggtctgataatttgactggtcgtggttatacagagaatttgatgttgaacgttataaagtcaaagaactgcttgtttagatgaggtttatttttatttttgatattattcactcttgtcacacatcaagaagaaaacactagagtgctgctggaattccaaatctgaagaattctaacggctgcattctttgttattaaaaagggcacaatccttcctttttatttggcagtttaatttcagtaggaagcatgtcacatgtgcactgttggttagaattatgcatctgtcatgcctgactgctgaaccctacctaagccttttggcgcagtttaaaacttatactggtggactgtgaacctcaaaacaaatgggtatttcagggctttgaggatagatgttactccttaaagtttgtatttggggcatgacaaacttactgaagaagaacagtgtacagatactacatttcaagacgtggcatttcccc

SEQ ID NO: 607065 - DNA, 271 bp, Homo sapiens
ctcccacgttcaagtgattctcctgactcagcctccagtgtagctgggattacaggcatgtaccaccacgcccagctaatttttgtcttttaatagatacaggctttcaccatgttggccaggctggtcttgaactcctgacctcgggtgatcaacccgccttggcctcccaaagtgctgggattacatgcgtgacccaccacgcccggctcaccaactgatatatttcacagtaagcacagtattttaaaaggagaatttaaaatattga

SEQ ID NO: 607066 - DNA, 548 bp, Homo sapiens
cgcacggaccctctacttcagtgtttaatgagccaaggagactcaaacccagcagctattccgcatgcagcagaagatattcaaggagatgaccgatggatgtctcagttgccaggtattaactccgaattgttaagccaccaaaattacccctagagaataaacccaaccctgataaggatggtccagattatgagcccaacctctggactgtgggtaaatccctttcgatagtgtatccccctggaaagctggcaggtctcaggacgtaggaacgagggaggacctgacaagcacactccccgtcctctcagtgcaccccagaaggatggcatgatgccagctgctcagaggccgcaggggtggaatcactgtcccagtcctccatcaacgcggtctccccctcggaagcggtttgcctttacccccagcacctgggagacaagcacttccccttataccggacggcccggaaggctgcgaagaatactgtccgtcacaaatctctgttaacgagacagctcagagaaagtgcctgtcagcatgca

SEQ ID NO: 607067 - DNA, 143 bp, Homo sapiens
tcaccactcgtacaaaacccggagggcatagaaatctggtaaatgcatcgccaagcacgggggctgattgcagtaattctctaagcaaggcaaacatgatctagcttggaaggcagcatgaaggcagccggtgggcttcatgt

SEQ ID NO: 607068 - DNA, 767 bp, Homo sapiens
  misc_feature (461)..(461): n is a, c, g, or t
agcggcttggcggagccggtgcgcccggggtgccgctccctgcctggcgcgctccggacctggaggtgccttgcccctctcctgcccactcgtcggaatttccctgtggctccttggatcctttccgagtctcctaggctccttctccgcttcctagccttgtgtccgcccagagaaaggctcaggatccttggtcccctgctacggtttcttggggcctatggctggtctgggcccctggcggtacgcgcgcattcagagcgggggagccccgagccccatgttgattgcgacgtagaaggggagctcgtagagtgcaggaaaggtggtcgctacgaaagtcaagagccaacaatgttcaacctgtctctgctttccttcaaatgcgaggacctctaactctttccttgccaaggtcgcgacctgctacactgcactaacaatcatcggggggtatttcnggagagaagtcgagggtgccacttgccatagtgatcccaaggttcttcgctatgccttgtatagatcgggtatccaatccagtagttgattgctcgaaaggaaacttgtgggttgaacacctttgccgattggtagtccaaagggggtcgattcgccattaacggttgaaacgccccaggaacgattttcgggttgcagagcgcccctgagaagtagaccgcggcaagctccctccacggatagccccctagaagttgcccggtgtagccccctggtcaagtttgtaaagttccttcgagtcccag

SEQ ID NO: 607069 - DNA, 310 bp, Homo sapiens
ccccctcctccccggcctttttttcaccaaacggtttttgccttttccgggagattccagcggggatagagggtgagaccctttgcaaacaacatttaagggaatgtgggcccaaggcaaaaggtctttaaaaatcatgttgtgaaaaaaaaaaacataatcatttttgaaagaggccttggtcacatccaaaaatcggctcacatcattttttttgggacaagaatattttccagttatttaccggttgcccccagaattggttagattttttaaaaaccaatttttaaaaagttttggtttgaaacta

SEQ ID NO: 607070 - DNA, 340 bp, Homo sapiens
agcgatgttgcgagacttcgacccaatgacccacacagagggaaccaggtgtgtgcaccaatctccgttccctgaggctcttagacaacattgagttgatgatttgcgaccatatactcaactgtattggaaatgtgacatctgtcacatcaagaaaccgcgtactgctcaatagtgaatgcccatactgtgcatcgtggactagatcaaacaagatgcttgccctgagaatttcagagcgtattgagcactttaagcaccattagagcctattagctacctggctctggtgcagggacatgatcagattacggaatccatgtagaagggctcatggtac

SEQ ID NO: 607071 - DNA, 264 bp, Homo sapiens
ctctagatgatcccggctatcacattatctcacgggataggggtagatggctgagatcttgtggattcagtaacatggatcatgtcctgtacctagtacgtactgtttgtgtagtagaatgattaggagattcccaaatgcctttttccccctcatcttgaaatgagatgagttttaatgtgtaagcaatatttatttaacgtatgctataaaattattgagtgcctactgaggcctttaagcaccgctaacattcctttccat

SEQ ID NO: 607072 - DNA, 149 bp, Homo sapiens
gaaagataggaaccaagcggagcaaaataggaaataagctagaagtagatgttcccatggactgactttcttaaatagtgattcagttgctgtgggtaacacatgactctgatctaacttacaatccaatgagctcttcacatcaaatt

SEQ ID NO: 607073 - DNA, 153 bp, Homo sapiens
caggctgcccccaggattatcatgcatggcaggtggcagcatttgctgctgttgaaattgttttaggtaatagcttttctaatcaggttaggtctaggaggagtaggtggcaggttttatgctcgataagcacaggccatacactcagtggca

SEQ ID NO: 607074 - DNA, 557 bp, Homo sapiens
ttgaaggccacaatgtaccacaagtactatgccaaagcactctataacgttgtataaagaattccacatccccgatattggccacctcgaagatgaaaacagataactccctaaatgttaactatctttacagcacatgcatgtaaggcaagtgatcaaaaaaaaaaaatcacaaaagcaaaaatcctaaaaaaaaggttacaatacatgggtttctggtagtactgctgtgctcgatatacatgaggtatggaataccaggcaattcatcttgcctgcatccttacttttacattggtccttaggtggcctaaaacatttaaatacaaataaaatgagtgtagcaaaaataatgaaagctaacagcaggtaactttacaaataagggaatgtgaaccgtttctgcccttatccagagtaaaaggggtcacaactttgtctaagggaacacttctgcagctgtagtccagggtgtacactttgagtattccacagatatacatggttaaatatgtggtatccatggggtatgattctaccaaagccttgtaagtgct

SEQ ID NO: 607075 - DNA, 147 bp, Homo sapiens
gccacacctgctcctttttgctttccccggggaaaaaaaggggttttggtcgggaaactggggtaaaggtttggggagggggaaaaaaaatttttttttttgaacccctgggtcccttttgcataagtttaaaggaaggaaaagtta

SEQ ID NO: 607076 - DNA, 423 bp, Homo sapiens
cttatcgtgtgcactgcaacgattacttatgagaagactggtgggtgcacgaagcttatcaaaaatattgaatatcctgtggacttgtgaacttagtaaagaacttgctttctcccagcgggttacaataagaattttaatgccaccgaacctatcggctctttgcagtgggtctaccatcacggggacagtgcgacgggcgggccttacactacagacgtcttccagatcggtctgaatggctggctgcgcatcgatgaacagacaggtcaaggtgatcaacccggtaccagggtgggttgaaaccacctgctgaacgcacagactaactcctgtattaaccgccgagtggacctgctgtaaacccctgtgtagcgctgtgttgttgcggcccccatgccccgctttcgtaggagaccacct

SEQ ID NO: 607077 - DNA, 108 bp, Homo sapiens
aattcccttgcgggttttcttgtttttggagtttttggttttatccaccaaaccttgccctttttttcttccagttttttcttgactttttgattcccattttttgga

SEQ ID NO: 607078 - DNA, 342 bp, Homo sapiens
acctagaggatctcccgctctcacccacccctatgcagtttgagtgagtttttaaatcctgagtcctagtttgattgcactgtggtctgagagacagttgttgtgatttctgttcttttacatttgctgaggagtgctttacttccaattatgtggtcaattttggaataagtgcgatgtgatgctgagaagaatgtatattctgttgactttgggtggagagttctttagatgtctattaggtctccttgatgcggagctgagttcaattcctggatatccttgttaaccttctgtctcgttgatctgtctaatgttgacagtggggtgggtggagagcgg

SEQ ID NO: 607079 - DNA, 322 bp, Homo sapiens
gtctcactcaccgaggatgcctagtgcccccttcagtgtgagcagattggagaactgaaggcagagttcaccaaattatgataaaaaatgtgtttgaacaagaaacgaagttgcaaaactccatgaagcttttgcacctgcgcaagcggctggtaaaagtcatctttcatgaactagttctatcccacaaaatccttcggaaggccagcggaaacctggagctttggcttgggggggcctatacaggaatgtacctttccgacagagcagggtcgtgagaggaagaatcatccaataaagtctgtacttcccccaccggata

SEQ ID NO: 607080 - DNA, 217 bp, Homo sapiens
cacgaggtgactccagttcggttgcatctaaagtgtttaggagttcatatcaatacaaaaatttgttgaagaaaaataaggatgagtcggcagtttccatttctcacacaaaatgttccttgttatgagacatcagttatgggaaaaacttaatacctaagaaatgttttacttcttttaagaagaatagtaaagaaaagtgttctttgaaacatca

SEQ ID NO: 607081 - DNA, 740 bp, Homo sapiens
aggcatcggcctgttacccgcgcggcagcatggtgcatccaccggcacctacggggctcacgcgcacgacacagccacaagatgtccgctctgacggaactactgccagctgccacgctccgaccctcccccatcctcctgaccatcttcaccgaccgcggatcagatccgccaacgaccgccgtcccgagcacaagaccgatgtgaggccgaagccagacggcttgcattcccacgatacggggccgagtgaatacagtgtcaagcccttttccttcttctcggaacagcaaccttcttactaaacagatcggcagattggaccaggcaggagcgaggcggcagggcaggcacggatcaatgcagctgcggcgcggcacggtagcaacgcacctgggccggcaacacccattagcgcctcagcagaacagccatcgcagaaccgcgaacggagaacacaatgaggcacgagacaagccgtaccaggcacagccaggaccaggcctgacggcagcacctcccacaggggcacgccacgaaaggcaacacaccatcaccaccgacccagacggactacccacccccaaacggaccacccacacacaaccgacacgcgaacataccaccagcgaacgaccaggacgcctccatcccgcgcgacacacaacccaatcccactcggcacgcacggcgccataaaacccgaacacagccgcagcacggcctacgacgacccacac

SEQ ID NO: 607082 - DNA, 439 bp, Homo sapiens
tttcccgcgcccgcgcttctggtgccacacttggggagcccggaaggagacccgcgccacggtgtttctacccctggacgccctggccctgcctggagccactgccattctcccccactctgtcggccgacgtgctggtggccacgggtaccactgtcccgggccgcccgggtccccttctcccacttgccacgcccctgagaccctgcaccctatagttctgagccacgctgctgaggaagggggcgcctggtcccccctgaggcccactcccacgggacggcccacgcccgctgaagacggagcctgggcaaaggtgccccagtggctgaagctgccggccagccacgaggtgagactgccagcctgaggtgccccctccgccagccccaggaccacctccttctgcccgccaggaataaagacttgtgcatcccta

SEQ ID NO: 607083 - DNA, 339 bp, Homo sapiens
  misc_feature (84)..(84): n is a, c, g, or t
  misc_feature (311)..(311): n is a, c, g, or t
ctggaacccagataagcaaacataaccccgagacacttcccccaacctgtcctaaagcctagtggttatctggcccaaatctgnccccaatagggttagtttttgggtctctctggtgttttttaaatttttgatctcttgaggtcaggaattcaagaccagcctgagcaagatagcaagacccccatctctaaaatcttttaaaattagctaggtgtggtggcatgcacctgtagtcccccaggtgcttgggaggctgaggtgggaggatcacttgagtccaggaattcaaggctgcagtgaaatatganttggccactgcactacagcttggatgac

SEQ ID NO: 607084 - DNA, 849 bp, Homo sapiens
gggtggctataggaatggtgagttttgctggcccggtggtccattcctgtgcgcttaatccgcagccaagatgtcgcgtgtcaaaaggaggtggtgcaggtccgaaagcgaataaacgaggaagaaaaacaggaagaacttgactccatgtgcagtagttgcctatgtgcggcgcgacatacactgacctattttgacgaagagctcagatctttttatatttctccctagttgggcgcttgtgacaggttcaggctgtccagaagtaaaaggcatgaaatagcaaaggctatgcttttgtggagttggagtctgaggatgttgccaaaatagtggcttgaaacaatgaacaaatacctgttgtggtgaaagactctgtggagtgtcattttatgccacctgaaaaagtacataaagaactctttaaagactgaatattccatttaagcagccatcatatccatcagtgaaacggttataatccggaatcggacactaacacaaaagctaggatggaggagcgatttaaaaagaacgaaagattactcaggaacgaaattagctaaaacaggaaatggacgtatgatttccttcttggattttacagaaaaggaaagtatttcaaaaactaatcgtcagaagtctacaaaaggcaggtttacgtaagaagaacaaacaagttcaggtatctgggaactcctagaagctggggtagccagggccaacaagttgtaacaacatttgggggggaaatcagtggtgcatgattgtgttaaggtggaatttaaggcttcggttgagagataagaatcacctacattgagaaaagaagaaggtaggtattgaaaa

SEQ ID NO: 607085 - DNA, 136 bp, Homo sapiens
  misc_feature (40)..(41): n is a, c, g, or t
  misc_feature (66)..(66): n is a, c, g, or t
cccccccccccccccccccgcgaaaagggggggggggggnnaaacccgttgggggggggggggggnagcatagcctgaaatcaactaacccaagggtgaaattgttcgaagtctcatgttttattgtttacaaaca

SEQ ID NO: 607086 - DNA, 1633 bp, Homo sapiens
gaacccccggttggatcaccaaagccatgtccacttagcacaggtagatgcgtgggctgacatctggcgggatcgaaagagtcgtggatctatggtaacggtgatcacgaagtttccacgcactatctgatatgtgtctggttctcgtccggtcggctatggatgaaagggcgctaataattactaccaagactaccatcgcgtttactcgctaagatctacagtacagtatggcgcacactgcattgcgtctaattcaagatcaacttgtacggacacgtcactgtctagctgtacacgcgtgttcatttgtacttgttaaagactacgtcttgcaggatgtctcttgacaggcctcgtcagcagttcagggacgaggttaaccgtgcaagtacgtgttagagcgaccaaatataggttggaaggggtctccttggtgtgctaactaagatgaaactattaaggtctaagcgtgaatcgtaaataaagggagttggtatcgtacagtgtgttaaaaagataactggtgtcggaaataccacggttcaatacactttttttcactaggacggggacctggaaaattaggcccgtgtaagcatattgtccgtggatagctcttcttgattgaaaagtcgtggcagcaaaatatccggaagtggcttcggcacaacgcgacttgctgcgtttacatatcacagagggctcggtacaaaaagcatagggcgaggtgtcacgtttcaccggtaggggttaacaaaacttgcgtttggcgagagaacactggttagtcccacaggacattctaattccactaaacgtggatccccgggtgcaggccctgccatgacaccgggagcgacggctaacacaagggtgtgcagcgagcgcacaaactctgcgagatacacggcttgcgcggtcgagcaaccacttggtggtctaccctattcgttcgtctcttatcaagatcctcatacctcttccttgtgccccacaccacgcacacacgacacacccaagtcaaccgcaacacacgaccacacacaaccaacacaacccgatacaaaccacagagcagacccactccaggcgcgcgacgccggcggccggcgacgagcgcggacacagcgcaaccacgcaaccgacgcaccgacaacgaaggagaacagcagagacaagacaccggccacagccgtcaaaggcggacagacaacgaaggagatcagacacgaagcatgtggaggacaacgctggaggcggggcaacgaacagcggacgcaaggaggcgacacagaggagagagacaagaggagaccgggcgaacggacgtcgagagcgcgacgatcaagcaggcgccggacgagacgaacatacgagacggtctgcgagcggcagcaggaacagaaacggagacgcaagcacaacgagagcgcccgcaacgacacgactaccgagtcggctaggagcgcgagcacaccgcccagcacgccacaccgcagcggatcgaagaaacaaggaacacatagcacagcacggcgcgagtacacagcacacgcgatcagcggcaggactgcagaccagcagcactgacatcagggacagcgaagtacgactgccgcacgcacacacc

SEQ ID NO: 607087 - DNA, 167 bp, Homo sapiens
aaacccccttgttttttaaaaaaaaaaaccccccccccccccttgggggggggaaaaaattggtggtttttgggaactttcccccccccccttttgtggggggggggggactttccccctttttggggttttttttttggttcccccccaggggctttgttacccca

SEQ ID NO: 607088 - DNA, 194 bp, Homo sapiens
ggacccaattccccctttttcccccccgggggggggaaagggggcttttttggccaggggccccctttttttcccccccccctttggccccggggggggggttttttttttttttggcccccccccccctttttccccccccctttttttcccttttttttcccgtttttccccccttcccaaaaaaaccccca

SEQ ID NO: 607089 - DNA, 242 bp, Homo sapiens
tgcaatcctgcagggcgaattttagaggatcccctccactagtgtaggtggcctgctgtaatgttagcggttaggcgtacggccagggctattggttgaactagctgtctgatgcccgccataatagctacagttcaattacactgtgtaaaagtgccttgcggtaagaagtgggctaagccattcataaaggtacatagttagcgaacaagctatgatcctacctttacacgggttgccaa

SEQ ID NO: 607090 - DNA, 783 bp, Homo sapiens
  misc_feature (52)..(52): n is a, c, g, or t
  misc_feature (62)..(62): n is a, c, g, or t
  misc_feature (69)..(69): n is a, c, g, or t
  misc_feature (91)..(91): n is a, c, g, or t
  misc_feature (93)..(93): n is a, c, g, or t
  misc_feature (97)..(98): n is a, c, g, or t
  misc_feature (250)..(250): n is a, c, g, or t
  misc_feature (444)..(444): n is a, c, g, or t
  misc_feature (477)..(477): n is a, c, g, or t
  misc_feature (632)..(632): n is a, c, g, or t
acagagaaagcacggaggaaacaggaatagaacgcatgaagccccatgaaanccggaagagnaggaganagaccgaacacccatgaccccntngagnnacgagagaagaacgaatagacacgaacaggaggaaaaggaaacgacaggggaggagagagtgcggcaggagcgccccacagaggagacggcaggacaggaagggcaccgaaaaacagagaagagaagaagaaaagaagacgaaaagaggacngggaaggacgaggacagaagagagaagagaagcagagcagagaaacagaggagagaagagggagagagagggagacacgagaggggagagaggagggaaagaagaacggagagaagcaacggaagagcgagagggacgaggaaagaggaaaaggaagagaaggacagacgagaagaacaagacagaggagaaanaggaggcgcgagacaaagagaagagagagaaanaacgagagaaagggaaggcggaaggaaacaaagaagacacggcaaagagaggagaagaggacggacggagggacaagaagggaaagacaagacgaagacgaagaggagaagacaaaagaaggagagacaaaagaggaagaaagcaaggagcaggngaagacaggagagacgacggcgagagaagaagaggaagcaagacagagggagggagaagggaagagagcagacacgagaggaagaaagaaggacgagcgagacggaagaacaagagagagacaggagaggagcgaggcgagcagagagcgc

SEQ ID NO: 607091 - DNA, 163 bp, Homo sapiens
caatcgtggcgaagttgctcgtgatgattacgatgaaccaattatttcaaattatcagttcaactttatccaacaaagcaaatcaggcgatgttggcaatgatgataacattgtccgtattttggttgacccagcagaaagtgaacgcttgcaagctggtttg

SEQ ID NO: 607092 - DNA, 192 bp, Homo sapiens
ccgactagcccgacatggacagggccggcactggtccccatatggcagcgtgggtccccgtggaaaccagcaatgcacctttcacagtgctcaccccctgtgtgaccacggtgcaggacagctcctcgtcccggaagtaaggtatagtcaggtgatgcaaactcatcatgggcactgtcgggctagtcgggg

SEQ ID NO: 607093 - DNA, 869 bp, Homo sapiens
gggggcccccattttgtggccaccaaatgttgtgaagaaatatgggcgtaagatatccgccttgttctcgtgttgggagattcgtgtgtaaggggaactctgccgcgttttcgctcacggattaggttgttttttctccccccgggtgcccccctcgtgggggacttcttctgccgccctgtctggccgcccacctttcgtgggtggaaaacaatgggggttgggtccccccccggggtgtttccccccgttccgggggtgttcgcccgcttttgtccgccccctctgtgggcgccccctctatttctctgtgcggcccctcttcctctgcggttaaggggggtttttatattgtctgttcccctgcgtattaagggggcgccccttctccacccgtttttaacaatggtccacttgatgcgccccgcacattccaggcgttgagctcccctcttttctaatattttttttcaattatgttttttcccccgcgccaaattttttcctccccattatgcgcccctgtaactcgctttttattgaaatggtacgccaatacctctggctttcgatagtgctgtcatttgtggaaataaacatgtcacacacgccgcgcccccccccaagggcggcttatatagaaaggaaaatggtgtctccacataatataggcgtattctttgcgcgtccactccggcaccagtttatggttgcacaccacgccccgagtcttttatattgcgggatcctctatcaacagtataagcgattcctgtatggtgcccaccgcgtgcagttcccgcgcgttcacgctcgcggggcctcttcgaaaaaatctgcccacaacaatagatacacagcaaactaca

SEQ ID NO: 607094 - DNA, 434 bp, Homo sapiens
tgatggtggtggcgcgtgaagttactcgagtcagagccgtcaggatcctgacttgcggagtggctaaagggcttcggatgcatggatcccagcatggcaaacagactttgtagtacctgcgctatgaagacacgctcattctggaagaccagtcaacaggtgagaatgatatggtgatcatgagacctgtaaacagatatgagtacaagttcggctttgagctgcctcaagggcctctgtgaacatccttcaaaggaaaatatggttgtgtagactactgggtgaaggcttttcttgaccgtccgagccagtcaactcaagagacaaagaaaaactttgaagtaatggatctggtggatgtcaatacccatgagttaatggcacctgtgactgctaatggcgtgtcctgcatgttcattcctgatggccgggag

SEQ ID NO: 607095 - DNA, 514 bp, Homo sapiens
gacgcgtcttgctattgagatgtcctgtatcagcagaggcataccaatgactcttctagcggtgtacgagctctatgattagtctgtgtacccggtgtgcatatttgctcaccgaaacacgatccagaatggctctttaaaacgttatcatgcttacaggtgattcgcgattagacaatttgacaccatctggaccgtgtatatgatcacacgggcttgttatgtttattgtcgtgaagggccatgatctgcttgcgcctcctcctttgcgcctgaggacctgtagacataaccagtgacatgcataaaatgcccactgcctgtaacagccacctggagaacttcataaagatgtctcacagccctggggacacctgcccagtgggccccagccctacagggactgggcaaagatgatgtttccagattacactccagcctgagtcagcacccctcctagcaacctgccttgggacttagaacaccgtcgccccctgccccacagagagagcgt

SEQ ID NO: 607096 - DNA, 556 bp, Homo sapiens
ttatccttgtgtccaaaacaactaactgaatactccaatgcccaactcattttgaatgaatgaagctgccttcattgcagggtcgggtggaggattttgaactcggaactttggccttcagtctttgttattacagtttaaagattcattctcgggcatggaggaacaatttaggtcaaaatcacaaaaatctgaaataatttaggacgaggcgtaaatttatctgcaaagatcaacacgctcaaacgaatcactaatgctcatcagtcttttacttaaagcaaacaaggtggagggtagctccttgcgaaacctaccacctgcctaaaagcgcagtggctcgggtggtccagtcccggagactttcttggcacttaaggctctgcccacgggccgccaagtggcggaagagcctcacgcacgacgtgccgcctcacactcccgcggaggcatcgcgacgcagcgacggcgtgggcggagaggccggcccttcctctggcgccttcggctcctccccctgcgcctcacacgctcattgtgaagcgacagcggccgc

SEQ ID NO: 607097 - DNA, 176 bp, Homo sapiens
taagctgtggaagacgggggggttggtactttgtttttttttgagacggaggcttgctccgtcgcccaggctgcagtgcagcgtcgcgatcttggctcactgcaaactccgcctgctgggtacacaccattctgatgcctcagcctccggagtggatgcgactgcattttcacgcc

SEQ ID NO: 607098 - DNA, 315 bp, Homo sapiens
gacagagggcatggagaccctgcccggccagaccacagagctgacagagggcgtggagacgctgcccagcctctgcagcacagcccaagtgtggtggggcacactgccctccccagtttcagtcctccctgcggcacattctgttcccagcagctgcctctgacctgaggcaggagggcagggggcttcggtcctgccctgggagctggggagtgatttctccttggggtgggagggtcgcaagtgacccaccttcctctcggccctgcttatgcccagaattaagaacagcagatcccagcactgtgcgctcgg

SEQ ID NO: 607099 - DNA, 263 bp, Homo sapiens
cctccctggttgctgtcgatggtaggccggccactctctctttgcgtatcgtagcttgaccatacctcatttattctcaggtccttggtctacttttgtgcattttactcccagctggctagtctcgcttactcagtttgttgtgatctttgggattgtttaatcttcctttcatgtttcatctttggtttaagagaatgctacttattctttttggttgatgcacagcaacctaagtggaggccatgctaactagtgggagg

SEQ ID NO: 607100 - DNA, 1683 bp, Homo sapiens
  misc_feature (1132)..(1132): n is a, c, g, or t
ggtgatgtgttgcgtcgtcttcgtttgttttgttgtcgtgattgtctgggatggatcgctggggtggtggaggggcgttactgcaggatggtgggcgcggtgtgcgagcagcgtgttttgattatggggaacccctgggggggtggatgatctgctgtagacgcgcggaccaagggtgacacgtggatgtggcatgttttgtggtctcggtggagatggcgagggcgtcccgaaccggtgggggacgcctggttgtcaggaacttggttgaaagagtggggcttgttttagtatccgctcgagctctcatgtccctcgggtgcgttgcgtagagtctcctttgtgggggggggttaactatctctaagtagtttttctgttgttagtactcttttttcggataggccttgtgcgggcggttgagtgtttgaaaagagggtggtggtcttgctcgcgtgtttgtccctctcggggacccattgttgttgtgagtggggggcgaggccgtgtattactctcgggtgtagtcatgcctctgttgcgtggtggaagcgcccgcgcgtggtgtttgtgtgtcgccgtgtttgagcgagtttgtcccgggctgtgtgtttgggtaaagaagggtgggaggtgcacacttgtgtgcccacgggcgatggtccagccccccggtggtgggggggccttgtgtttggttccctcggtggaggcccctgggaaaggtgagcctcttgtgttgcacagaaccaactggatggtgtctgtgttcccacgaagagtggtggcttttgggctgataccgcggctggttgtagtggcgagagtgtcgtacagctggtgccgctgaccgcgttgctcgcgccggcgtgagaggtgtgtatgtgcccgtcctggtgtttgagagaaaatttgcgcgcgttcttgttaggggaattttgtgtatagacacacctggtgtggttctgagaacaacatcgcacagcgggtatatatgtgggtgtgccacacgctttggggcccacagagcactctcactcgtcgcgagagagaagccgctgtgtgttccccccgcgtgtttgtggagaagggggatacgcgagacccggcgaaacttgtgacacacatgtgngtcacacgtgcacaggtagaccgcgccctggccacacgtgtgtctctctcacatggagacgtggagatctacatgggcggttattgtgacacatgtttgttgtggggaataatgggtgagagagacgtgtctctgggagatctctctggtcacagaggggtgtgtctcccacacatgtctcctgtgagacagagaggagagcttgtgttgtgcttgctcacagcccacctgtgggcgcccgcgcacacacaggcctctgtgcgccactgtctccaccttctccctctagaacccagggcgtctcatctcatctcactgtctgtgtggcgtctcaattgtgacacccatggccctcttcttaccacgcccacggccctgtggccctgttcaaaggccagaacccaccgacacccttgaatctcccgggtggggaagtggccaagagatagctggaactgaatcagaccctgaccagttgtttcaggcaattttagtttctaccatctgtattgaacacctgtggcccaaataaagttgaaattttacccacc

SEQ ID NO: 607101 - DNA, 391 bp, Homo sapiens
  misc_feature (370)..(370): n is a, c, g, or t
catggctccacagagcaaattttacttcttaggctgtgtaaatccatagtctagtttttgtctaaaatcatttcttgttcttctattgctcactactttacaaatgttcatttggtggaaattcttatcactatatacaaggggggaatatctctcagaattatttttttaaggggaaaaaataacctaagaaatgtattttaaaagtcatccagtgaacagcgaggaatgcatgctttttaagttgttatttaggaatgcttttattcatcgagtgttttttgtttttttacaaaggtaagagcagtcctgacaccagagggttggttttgttacctaaccgatttttttttctgttatgttttactcnttaatgttactacttacattt

SEQ ID NO: 607102 - DNA, 157 bp, Homo sapiens
tctcacgtcgcctgccgtcgtgcgcgtttggccgtggccgtcgtatacaaccgtcgtgcgggggcttacggacgctcccccgtcttcgcctggggggctcctctcacgtcgccctgcgggcctgcccgcttgggcctgggcgtcgtttacacccgtc

SEQ ID NO: 607103 - DNA, 540 bp, Homo sapiens
  misc_feature (62)..(62): n is a, c, g, or t
cgggttttcctcggtgttttgatctataaatacgaaaaataagaacagcaccggtgctgaanctatgtcatcccatgaatggatgaactggttgaaaaaaaaatagcctgatactgggagccaaaaaggccgaagggatcgtgaccaactcagcattccactggaggctatatgatcaatcagcaaactgtttatcctgaatgtaggatgtgagtaaaactcacagctgcgcctgctgccagaaggtttgctgagggcggtcactccctggcactggggtccttgaagttatctactgggaaatctagcgcctgttgttcgaaggatgcagtctcgcaagcctgctgtgaaccaaacggcggactgccgattacccgacaatcactgcactttgtcgcgatctcttttaccaataaatacggagggctgtgtaaagctctatctcttttaccaataaatatggagggctgtgtaaagctcagggcccttgtccactagaggcaaggtgccccctgaccccttctttcaaatataaaaaaa

SEQ ID NO: 607104 - DNA, 429 bp, Homo sapiens
  misc_feature (51)..(51): n is a, c, g, or t
  misc_feature (53)..(53): n is a, c, g, or t
  misc_feature (57)..(57): n is a, c, g, or t
  misc_feature (60)..(60): n is a, c, g, or t
  misc_feature (66)..(66): n is a, c, g, or t
  misc_feature (76)..(76): n is a, c, g, or t
  misc_feature (84)..(84): n is a, c, g, or t
  misc_feature (86)..(86): n is a, c, g, or t
  misc_feature (88)..(89): n is a, c, g, or t
  misc_feature (109)..(109): n is a, c, g, or t
  misc_feature (115)..(115): n is a, c, g, or t
  misc_feature (123)..(123): n is a, c, g, or t
  misc_feature (145)..(145): n is a, c, g, or t
  misc_feature (189)..(189): n is a, c, g, or t
  misc_feature (222)..(222): n is a, c, g, or t
  misc_feature (239)..(239): n is a, c, g, or t
  misc_feature (277)..(277): n is a, c, g, or t
  misc_feature (300)..(300): n is a, c, g, or t
atctagagcatccccccgtgagacaactttacagagcatttaataaaattngnttgntanccttangtgtggattngagaatancncnnagtaggacactgacagtaantccaangtttatgntatctttccaaagtcaggagtngacatacccctttgaaaaattattctgtgcttaagaaaataatntgtatttaaaacttaaggggtgtatgacatagnacagaatacaggttgtncctagagaagttttaaaagggagggccaggattaaaanctaacccagggagagggttgggncataagacattgttttttttagagatggacctctgagctctgatgcaactgcctgcatttatgaatgcctttgcacagctaagtctgagtgcagatttatattcctactacttagcacgcagaaaataa

SEQ ID NO: 607105 - DNA, 498 bp, Homo sapiens
cctttcctttttggggagttgttatgccatgatctttggtatttatgtaaaaggattatcactaattctatttctgtatgtttattctagataaggacatgttgagggcaagccgccaaattacacaggttaaggttagagagattggccagcaaagaactgtgggaaccatgaacttcgtcattatgatttcattatcacaggacaataggagggtgtcttagtgcccacaacagattcacatgtcagccacatccagaggggataccagcatttggtaaagaagttgaattagggccggagtgaaccaagtcttcccttatggttttacttttgttccgaacatcttacgtatcatgtgatccgcagtattccggtggatggttcatgtaccgattgggcttcttcgttaatagatctatttcatataatataatcgtggatcttttgatacaaaggcctccccctgtagggatatacctcccgattccgattccc

SEQ ID NO: 607106 - DNA, 114 bp, Homo sapiens
accccctccacttgcaaatcttacatctcaattcccatcctaaaaagcactcatacttaatgcatccccgcagctacacacacacaacacacatgcacactgcataacacatgc

SEQ ID NO: 607107 - DNA, 167 bp, Homo sapiens
atagacatgtaataagattcattcagatatggtaagagctataagaaaaggaagaagaggctgatctcaaagggtcttccctggaggccggagaaaatggaatttctatgcactggctatgtgttggagttggggctgggtgggcattgtggagaagtgtaggggaa

SEQ ID NO: 607108 - DNA, 2011 bp, Homo sapiens
ggcgacagcaccgctgccgccgtctctaaggtcgcccgggtcccacctgccgccaccattgcctcgtgggaagcctgcagcgctggcctccctggccatgccatgcctgccccagaactgcgcccatcatgccacatacacagaccacagcctcacaatcctcacgcgaacatcatgcccacgacaccaccactccacaaatactaacgttaactcccccataacatacatcatcaattattttctcacataacacctaacatacatgaacctaccacaatcttaataccccacccaacatcccccacacaccccaaccacttaaacaagaaacctaactacaataccactctctgcaaactcagagcgggcggtagccgtctcggccgccaggccgggacgagcaacgggaacgccgcacagcggaaaggggaggcggcacacaggagacgcggaaaggcgacgggccgcgtcacccaacgcttttcatcataacacccacctctacctcctctctcccactccaccccgacctcccttctcaccacaaccagaaccaagcaaacgcagcccaccctacactaaatcaccttgccctccctcctctctaattattaagtacatccagttcaactacatacccagcgtgtcagtctatcacttcatagctataacaattctcaattccataccctataagcctgtctaacattacaaaacacgagacaaaaagacacgaatgcctcttatatattgcatcttcccccaccaccactccaacccacacatcccaaacccacaaccccctcacgccacacacccaccttccaccatccgattcacgaccgccccagcaactcacaaccactcatcgaaacccacacatagccgaccacacaacaaccaatacacacactaacaacacaatacaatccactacaccccacatccacataaaccaccatcctacaatccaacaccaacacacgaaccacacaaaacttcacgccacgacacgctaaccgcaccacgcacacgcacaacactccatacacacacctaacgcacacaccccacacatcatagaacaaccagatcacacccacccatcaacgacccgcaactacaccccaccccgccagaacgacggagaggcgaggagggagacggaggagacgggtgacgaggccgtgatgagggaaaagacgagccgaagagggcggaccggggggcagacgcgtgaggcccggcggcgggacggggcggcggggggatggacgagcagggcgtagggcgcgatgcgagcgcagcgaggacgagagcgggccagatggggggagagggaagggggacagggcgaggagggagtgaggagagacgaccagtcaccacttcacgcagcataagctgaacgctaatgccacatagctgtctaactcatctgtcgtctagtctagcacgacgaactaaaatgttagttcggacgctggcttacctaactgaatagactcacaggactaatagacactatcacatatcgatgagatatctacactaacgatagcaatactaaatacacacctgagtacgacatacacaccctgaccactccttacgactgtgtctctccacctggacatcttctccagacacagtactacatcatgtacccgatacgtcccactggcttacgctaatatagaacgacacatcatatacatatgaactcagctcatactactaatgagcacgacatatgatccgtatgcgtaactcttaattacttcgcctacaccacctccacacatacacctctcacgattaacagcacaaccatctacaccacgtatagtacgcaccgctcgctctaccacacacaacttacaacacagaacaagcacgacctccctgctactccccgcgagcgtacgttatatacccgctaaagaaacatagctcaaactatcacgtgtgtcgatgagagtgctccttacgaccatcacgcgctact

SEQ ID NO: 607109 - DNA, 539 bp, Homo sapiens
gaggcaggaggacatcagaggaagacacaccaaagaaaaagaagcacaaaggagggtaagaggctttcccctctttttcccaaaagaacgaatacccatagcctgtatcccggatgtaggaacactgatggaagctgacccgagtgaagtgcaccccgtgtgccgggtggtattctgattcttacgctgcgcgcctgtcgtcagcctgtcctcaccgcagcctttgagggggtgccgttgtcaggggcattttcagtgtcgcagggacctgcccaggctttagggctgctgtggtgcggctgggctgcacctggagtctgactccagtgcctgtcctcttagccacagtgtgtgctgccccactagggacaggaggatggtgagcaacgtgttgttgacagaggccaatgtagaccactctttaagtagctagatttctgtatatctgtcagttattttatgtgtcaacatatagtgtgcatatattcattgttaattatgtggccacatttattaaatagacatgtcatttaacttga

SEQ ID NO: 607110 - DNA, 413 bp, Homo sapiens
ctcaacacgccaaggcaaagcaccagtagtcacacaagagaaaagcaagagcagcaagcagcacagagctagagaaaagaggagcgtctcatcgggaggaggtggccgagagcaagcccttcgtgttcgccgcttcgcccaagaagcagcagcaggaggaggaggaggcggcgcccgtccgccgcaggaagccggcgcagtaccggggcgtgcggcgccggccgtggggcaagtgggccgccgagatccgcgaccccgtcaagggcgtccgcgtctggctcggcaccttcccctccgccgaggccgccgcgctcgcctacgacgaagccgcgcgcgccatccgcgggcccaggccaagctcaacttctcctcctcctctgccgtcgccgccgcggccccgggagcgcgcaagc

SEQ ID NO: 607111 - DNA, 887 bp, Homo sapiens
taatggaacgatatatggatacagatatatatatatatacatatgtccttaatagaggaatgcttcatatatcaaaaattatatcctgatcaccttttggttaatggtaaagtatctctgcttatccattgctgaattcgataggatgtcgaaatgctggtcaccaaaacaaccggaaactgagcaaattcatttcaaccaacatcaaaacttcagcttctcatagtaaaaagctgaatgtcactaaatattcccatatctacaaaaaaccaaattcttagcaatgaaatgtgctgtgtaaacaccacaaacttcacatcaaatacttctgtgtataggacacatatgtatagtaggtagatagaaaagtatacaaaatgttggtggaagtatcttatttcagaatgaatggggaattgccaaagatgatccttcagggcattatgaaattattcacatgttctctgtggtttatataaattccttgtaatagattcagaattgaaaaattcttggtgaaggtcttcttaaaagtgtcccaatttatctcaaaaatctcaatatataggatcagtttaaaccataaagaaaaccgtgaattcctcaaatgttggacatgttccagaccagctcttaaaccggtatgcttgggcaccacgggcatatagggaggagcccatctcatgctctgagttggattcaatactcctattgcataaatgcagcgtggcattggaccacacttgcgctttcctagtattagcacgtaaaaaagagcgtcacaattgcggcttacagtcaaacatgatattaacaagccgggcttgcaccgcttcaaaaaaatttccccctcgtcaaaacgcacaccacaacgccacaagataaac

SEQ ID NO: 607112 - DNA, 434 bp, Homo sapiens
  misc_feature (166)..(166): n is a, c, g, or t
  misc_feature (433)..(433): n is a, c, g, or t
gacggggtttcatcatgttgctcaggttggtctcgacctcctgacctcgggtgatccaccagtctcagcctcccaaagtactgggattataggcgtgagccactgtgcacggctgctgacccacatttaatagtataatgacattccctctaacagtgtcattttngttttctttgtaccaataggtaatttgtcgtccagatgctctgctatatgtcaagtatcatttttctattgaacacaggtcatccttcagtttcatttttctcttcaccaattggatgctgcatacctggttttcagctcattcatgtgttaaaatcccctgtgtcctagatcgtatacctttctctttcttgatttactttctcattttatagagcacatcattgagtagaaagatggaaaataattttcgggatttatacaattna

SEQ ID NO: 607113 - DNA, 127 bp, Homo sapiens
caaaggaacatttccagaaatattaattaattatgactcttcaaagttcaaaatttggaccaagaaattggcatagtttatgaagctaatcctggcgttccaccagcaaccataagtggttccttgt

SEQ ID NO: 607114 - DNA, 205 bp, Homo sapiens
aatcgagctcggaccgctctcgtgaactgtcatgttcaggcaggactcaacaggaaaagagaaccactctaagtacttaaaggagagggaatgcaatgcagagaactggttacacaagtgacagaagagcccataagccaaacagaggatggtgaagaacaggaatccactaccactcctaggctgaagggacaaaagaaagagg

SEQ ID NO: 607115 - DNA, 669 bp, Homo sapiens
ttttgtaaattcccatattgcattcagaacaacttcacaacattatcagtgggagtaaatgcttcaacaaatctgctcctccctttttgctggacagattgacgtctattttgctaaaacgggtgttctattatcaattgctaaaaagtggatctgttaagcctgtaatcaaatgtctcacgtaggcaaactgtctttgcccattcataaattcgattttgcactcagacagccttgttctgacaatcttgatggcacgtctcctatatattctgatggacggctgagaggaaccttattcctcatatgtggagttcccacccatctagtgacaagtgcttatcgactgtgctgtgttttttgctggcattaacacacgatcctgtggtgtgtctagggtccttgattctttgccagtcatcccctcacttggcagacatagcgcgctcactcccgatttcaagtcttagactcacattgtgtctcagacagtaaaatttcttctcatctatattatacaattaaccagccgggattggtggtgcccttctgttctcctattcacttggcagactaaggaaattcacttgcatctaaacggcagccgtagctgtcagtgagttttgctccatctcttccccccagtctgggtctcaaaaagctacatcg

SEQ ID NO: 607116 - DNA, 861 bp, Homo sapiens
  misc_feature (76)..(76): n is a, c, g, or t
  misc_feature (80)..(80): n is a, c, g, or t
  misc_feature (123)..(123): n is a, c, g, or t
  misc_feature (130)..(130): n is a, c, g, or t
  misc_feature (158)..(158): n is a, c, g, or t
  misc_feature (861)..(861): n is a, c, g, or t
taatgaccctcaccgcatggacaggcgcttgcaggccctcatgatagctgggtcatgcctcggtgtgtcctggagnatgntttgtcctcttctggacgagcagtatgattggctaccaagagngtgcggngcttctcgacttagaccctgaagtggantgtctgaaggccaacaccaatgaggttctgtgggcggtggtggcggcgttcaccaagtaactcgtgctcggggtgaaccattctcctttctctcaagtaaaccagtagtttttcttctgtggacttctggtatactgtaattgtactttcccacactataatcggcttctgtttacaaaatggtgggtggcgtttttctttttgtacgtgtacaggattccgctggtacgagaggcttcctctttctgtttggaaaaaagagtttcactgcatatggattccattccctgttgccattcctcacctgtacctgttgggttgcggtctacttgacttgcaaagttacctcaggctcctcatacgcacaggtttggatgaactcagttgagttctcatatgtgcatgtacatctagagtgcgctaaggttgagagcggagtcacaaaaggcttcagttcgccaggtacaatctgatctcataggaatttacatgaatagtgaaaggaaactaggacggttgtgtctgaaggcagtagagtaaaaagggcggagtggccgtaactttgtttgaacgggtgagtaaaaaagggatgtgaagggtggggaggggatactgagaatggagaagtgacagtgagcacaagtagaaagtgggcgtgtagtgaaactatgcgaaagagggaagacaaagagggaagataatn

SEQ ID NO: 607117 - DNA, 238 bp, Homo sapiens
caaactacaaggatatcatcccacatatatactctaacccattacacactcaacccatataacttcttgaaaacagtcatactattaacttttgtaaaacatgtaactttcccaggtcacaaagtacagatccctatactgtatgtaccctgaacatattatcccttcttatcattattctgagacagagtcttattctgacacccaggctggagtacaatgacataatcttggctca

SEQ ID NO: 607118 - DNA, 977 bp, Homo sapiens
ccacgcggtcggcggggccgtgcgcgcacgggacccggagccgagggccattgagtggcgatggcggcgacggcgatgtgccgggggccgtgcgggatagacgggaaggccccgtacctccccgtaagtccgtcgaagttcctgttgtgggggcctggtcgggcatgggacgctagcagttttatgtccgagccgcctggtacctggttgaagaagcggagtggcaggttgaagcggggagaggggccaagtactcggagaggtacaaacaccagtcttccactgcgcctcaccaggtgatcctggaagggccgagaggtcctgagggggcatttagctctggtgctgtcggactgggcctgactgcgtacaggccatgctagcaaccattaacccgtccttggacatctataaccggtgtctgttgtgagcgacctggactggggcgtgatggtactccccactggctttctgctgaaggctgtgattgggatgaccgcaggtgccactgggtgccattagtgggaacagcagacgaagtggctcttatccgcatgactgccgatggccggcttccagctgaccagcgccgtgggtacaaaacatgtgtgaacgccctgattcgaatcagccgggaagagggtgtcctcacactgtggcgaggggtgaatccctacgcatggctcgggccgcagtcggcaatgctgcccagttcgccttcctagtcccatcccaagcaggctaacgtggactcaggctacttctcttggagaaatcttgtgccaattctgtggcaagatgaatcaagagggactggccccacggctgacgcagtgcagggtgacactggcaagacccgaagtgccagaacaggggcagactgcgggaaaccagaacaaagaacaggctgcaaacaggcacagggcagaacaaggaactaacacgggaaagacaacagaaaagacccaaggacaaga

SEQ ID NO: 607119 - DNA, 816 bp, Homo sapiens
  misc_feature (290)..(290): n is a, c, g, or t
gcgaaagagaagacagcacgtgccaagtcctggaagggggactttaggcccgcatatcctggtgactgaagacgaccgtgactctgaatctgtttcacgcccaggcaagagatgacagtggtgcggggctaggctaaaaactctggaaatggccgataaataaaggaattcaacagtactatatacttagtgcagctaaatccactaggatctggggagagtgagatgtaggaatacaatgtatctcccatggtcttgggtatccttggcgtggcgtttcatcaggaggnagaagcatgatccgtgggaggagcaatgataagcaacacttgctactcgcgttggctctgtcatggacgcactcagcagagaacaaaaaattgcgtactagttcatagctcttcgagaaggtgtatgcgtgatcggccagcctacactgtggggaagctctacttgctacggattagaacacgcagcgtagagggatgctggcatcgggcacggacggatggaccgagggaccctggctgaaggagacgtatttgctagaagagaacctcatgcatggagcccagattacctcggaaggtgcgtcgaggctaattgcccgcctagtttcgaaacggctcgtgtaccgctcgtcaacgtaggattcccccccaaggttgtcacccttggcatggggaaggccaatggcgctgactggcttggctggcacggagttggcaatcgtgtaccaacatcgctgtgcctttacgtggggaagtggcttggatctaggactcgaaggacatcgggcttggccctttcccctgg

SEQ ID NO: 607120 - DNA, 135 bp, Homo sapiens
ttcctacactttgagaggcaaggcaagaggatcgcttgtgaccaagagttcaagaccagtctgggcaacagagcaagatgctatatctactacaggcatgatctgtagtctcagctacctgggaggctgagagaa

SEQ ID NO: 607121 - DNA, 979 bp, Homo sapiens
caccaccagacagcgtgaatacatctgcctacactatatagatgggaaaaaatagagaatcctacccaggagtggtggtgcatgccggtatggtcaggcactttgcggagcgctggaggcaggatgaacacctgcagcctaggcagaccagaggttgcagggagtgatagagctacacccatgtgcactccagccaaggtgcgaacggggaacaagatgtgcctcaacatacataagtgatgaatactaggcgctaaacatgtactacggaaaatagaagaatccctgtagtcggaatgtaatagagtctattttagtggtgtgtcaacactacgagatgtacatagatgcatttcttcatgtctagaagacacggcaaaggttcagacacaggagaatgcaatattctagcaacatttaccctagagctgcaaaggtcagaacaggaaaactgtgggagggtatactcgatatggtcgtacgaatgggaatttgctagtgcatggtttgtcctcctatcaggttcttactatcaatcacttaagcaaccaagtggaaattgattcgtgtcataataatgttataccgctggaaatagcgattgcttgacccaaccatctttggcaggtctaagagcaatcagggccatgagaaagcagatcatacggcatccgaggttgggcaaaagaacaagtgagattgctttctgtcaccgtgatctgctgtgtacctggaaaagcgaaaggttctcggagagttctaaacgctggtaaattaacttccgtatgttcggttacgaatcaagatatgtaagtgcgcttttattttcctatatccgtggacaaccaaacgcagcgcgagaacccaccgtagcgaaagtaaatagtacatccacggggaaagtaggaccagcactggtacagaaagaacagaccagagtggaaaataagagcgacagagactcaactacagaaccgaa

SEQ ID NO: 607122 - DNA, 136 bp, Homo sapiens
attgagggacatgagcattttagagcttttgctgcatagttagaggcttttcctgaaacacagaaccagttgacaatatattgagcaagctctgtacctgtatttccacagctccatcaacgtggtcactttaatt

SEQ ID NO: 607123 - DNA, 107 bp, Homo sapiens
aaaaagcccggaaaaacccccttttgggttaaataaagaaaaaggtttttgaaaaaaaagatggggtccccaacccaaaaaattttttttttgaaggggggccttta

SEQ ID NO: 607124 - DNA, 150 bp, Homo sapiens
tgtggactctataataggattgcgcgtatccctagtggtcatatcaacaatagggtatacgacctcgatgtgggatcaggacatcccgagtggtgcagccgctattaaaggttcgtgtgttcaacgcattaagagtcctacgtgatcgtg

SEQ ID NO: 607125 - DNA, 302 bp, Homo sapiens
gaggcgatcagaggatcgccgatatgctggctcatatgataatgaagacagatctgtcatctaccagtagttttaatgaaattctcaatttatatcagtgtctggtagaaataacttatcttagaggcaaggaaaaggacaaagttcattaagaatatgaaattttttcggtgtcattgtcccatttaggtttacttttcatatcatttaaagaaataatctttttaacagaagccatctatctacatattggcacatggatttactagctgatatagcagtaagtacgtaacttgtcttga

SEQ ID NO: 607126 - DNA, 237 bp, Homo sapiens
gggcctggccccagggggggggtgggggctccccaccccccatggttgcctgaagttttggccgggccccccggggaagggtcctctttttttggcagatgttggggggggggccccaccccccccccagccggggtttgcccccccaacgggttggggggggttttaaaataaattttgggggtccaaaccaaatgaacccaaaaaaaaatgattaaaactttccggaaacgggga

SEQ ID NO: 607127 - DNA, 357 bp, Homo sapiens
ctgacccattctcattgtcctgacctacactcatatccaagtttggatcccctcagcggatccaaaggacaggagaactcttcactggataaagtaaacagcatcaggtgaaagaattctgtcatttggagaatacccaacaaaaagctagttgtctgatcattataatctgaagctcatccatgcaaaacgagcttccatgcagcttgtttttgtttttgttcatcactgtctgcttttgtaaccatgcagcttttaaggaccataaatgtgaactaaaagccaaggatctcaatgtaattaaggaaagcccttacacaaagactttaatacacaattcaaataacacaattcagg

SEQ ID NO: 607128 - DNA, 328 bp, Homo sapiens
cccggggggggggccgggttttccccttttaaaattttttttggggggggcccccccccccccttaaaacgggtttaaaaaatttttttttttcccccccccccaggggggggaagggggggggcccccccaagttttttttttggttttcccttaaaaaaaatgggcctccctgtttttttttttttttggggggggcccgaaaccaatttggtttttgcccccccccccccccgttggggggggggtttttttttttaaccccccggggcccgggttctttggggggggggttttttggggtttttttttacccccttttttttta

SEQ ID NO: 607129 - DNA, 198 bp, Homo sapiens
aaaaaaacacttatacaagagtcaataatatatttaaatgactactaatacattctcattaaagcacaaatatattacattagtatcttaagtataacagtagtaggtaaagaaaaaaacaaaaatggtacaaaacaatcattgtgaacatttagcaagtagtaacactagactatagtataactatcacggtcctgt

SEQ ID NO: 607130 - DNA, 467 bp, Homo sapiens
tatccctaagcctgttcttcaacctgttgaatgtttcccctaaattgttatatggagatcctggacccggaagttggctgacatgaaacaggcctagcagtgcagctgaggaaatgctccaacctcaggatccaggaagattgcacatggcaccaaaacaatcatttaaaagctaatcctggccaggcaacagtagtcacgcctgtaatcccagcactttgggaggccgaggtgggctgatcacaaggtcaagagatcgagaccatcctgaccaacatggtgaaaccccatctctaccaaaagtacaaatattagctgggcatggtgcgcgcgcctgtagtcccagctacccgggaggctgaggcaggagaatcacttgaacccgggaggaggaggttgcagtgagccaagatcatgccactgcactccagcctggtgacagagcaagactccatctcaaaaaaaaa

SEQ ID NO: 607131 - DNA, 183 bp, Homo sapiens
cctttttttaaaacccccttttttttcctttggggccccggaactttttttcaaagggttgcccttgaattggggacttttgggaaaggtttttgggggggttggcccttaacttaacccggggaaattttttggttgggttttcaaggttttttgaaaaataacctttttgttcccccggga

SEQ ID NO: 607132 - DNA, 671 bp, Homo sapiens
ggcgagaccggtccgcccggagcacagagcctcgcctttgccgatccgccgcccgtccacacccgccgcagctcaccagtggatgatgatatcgccgcgctcgtcgtcgacaagggctccggcatgtgcaaggccggccttcgcgggcgacgatgccccccgggccgtctttccccttccatcgttggggcgccccaggcaccaggcgtgatggtgggcatgggtcagcagggcatcctatgtgggcagacgaggcccagagcacgagaggcatccttcaccctgaagtacccccaatcgagacacgagatcgtccaccaaacgtgagacgacatttggagaaacatctgggcaccaaacaccgtcctacaaacggacgcttgcgtgtggctcccgaggcagcaacccccggtcgcttcgccatgaaaccggagggcccccccttggaaaaccccccacagggcccacacccggcggaacgcacggaatggacacccagcgactccactgctgcggacaaacccattcaaacgccccccccacagcgccacgtggactaaccggctaccgcctactcacaagcgcctgggtcgcctctaccacccagcgtgcataacgcgccacttcatggcgcaccgagaacccactgggacactcgacgactgggcacc

SEQ ID NO: 607133 - DNA, 628 bp, Homo sapiens
  misc_feature (247)..(247): n is a, c, g, or t
ccggcacatcagcatttatttaaactctgcactgtgtcagcactgtcctatgcactgaagatacaaggggacaaggaaggggcctgctctcatggagcttccattctgatgagacaggtggtaactgactggaaaacataccaccgctggggcaggtgctatgaaaaaaaaggcagcttgctgaggggacacagtggcatcatggatggtcaccgatgcctgggggccaagaagcttgtgcacaaanccctgctctccagagctcagtcaggctgcggagctccttcttaataactccggatgaggcaagagtaaggcactttattctatttcatttttagtaacattcgggtcaaattaatttggggttttgagaacagttaattcactaataaaactggcttaacaccaaacatggggcttgcaagataggaaaactctccctacgaattctgccagctttcattccaatgggtcaccccttatggcttcaactctggggatacctcttttttgctgcgcccatgaacaagtgtggggggagaacccagggaatgcaagtcaggggattaaagggagggggcccccttttttaaaagaaatcccaggggcgggggggttatgattt

SEQ ID NO: 607134 - DNA, 703 bp, Homo sapiens
tggggcttaagcacttgttgataatcagcagacgtgtagggtagggctcaagcctactcccccaaacccgtcttaactccctaacatctgtctcttcctctacagattgacctaactgctttctttcagcctccgtggctggcccctctcttttgaaactccctggttcccgcagctcggagttagaagtcgacctcccctcagagacagaggtggatgggctgattatgatacgtgggtggatacgctggtcaaaggacccacgggtgggggcgtgcactttgacagccgccgagggaaacacgtgatgtgggtgactggtggtaggcagtctcgggttttctcctttgaagctcttactatgcttgcactttgaacctccagcaccattccgtgggtgttacgttgtttgacaggtggttgacatgccgacgccatgtgcagcaggtgaaggagagccaggccatgtagaaggcccagccatattcccaaactgtggtggtctccagtcttcgggacccatgttgacagctcgcttgggaagacttggtgaatacttctgtggtgggccaacatccccagtgagacctgacgggacgaggacaacagccgaaagggcgctccagttgagcccccgggccggttccccggtgttaaccgtctgttttaccgaggactggtaatgagccatatggaatgcgtc

SEQ ID NO: 607135 - DNA, 238 bp, Homo sapiens
attagtaccatcatcatccgtcattgatgatgatgatagatgatccttccctcatctatccatttacctggttcatccttccttccatcgatgcatccttccatcatctacccatacacccatgggtccttccatccatccatcatccatccatccactccttccacttatccactccattcaccatgttcatctatagatatcttcatgggtgctgaagggattctccaagaagttc

SEQ ID NO: 607136 - DNA, 518 bp, Homo sapiens
ctctttcttttcctcatgtttgacttcacatgcagcctttgattgtttgtcagggtaatctgctgttttaactcgcactgaaattgcttgtaattgtcagatctgtatatttttaggactactttgcaaatgttttgggtatatatatttttattattaataaaatgttgataaaataatgatatacttatgtttataaacttagccagaatttcttaagcaatggcttgacaatcaactggaagtaaacccccagtttcagttcctctcaacagttaatattaaaattatcaaacccattacagttaattaatttacacaatgtttttacataacattgtttgaacaaatctttattaaacttcatattatttgtattttaaagaatatttggttaagcattttcagtttgatttattgaactccgctgtcttggtgaaccagcacaagtgcacagatttgtggatattgaaatatattactaaataccaaaaatatgcaaatacaaattattaata

SEQ ID NO: 607137 - DNA, 291 bp, Homo sapiens
actgtcgtctctggagcagatgacttagataggttgatacaagctcgggctgctttcacatgcttggcacttagattatattcgcaccacgttttttcactcatgaattatcctgtgattctagcagtgcctcccgatgatcaagaccatccgagttgtggaattggcaatcttaagaacctgtgtttgtgtgttaacagggcacaaccattattgtgatggtgtgctcaggttccaaccccaacagaaagacttgggtaagtattcagccagccctgggaacagactggt

SEQ ID NO: 607138 - DNA, 280 bp, Homo sapiens
cgttgagaacatattatgaacaacttattgtactgaaccacttagttcgatgactcgctgatcatgaacaacctgtgtgtaatattattccctacaaacgtagcacccttcagcaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 607139 - DNA, 181 bp, Homo sapiens
tggcggtcgctggggctgaaagcagctcctcctccacgtgcatgggctgtttatacctcccaaactcctctgcaccgccatgccctgcttatggtcccttctgtgtgctatgtccccagccagaggccgagggcaaacactcggtcccggcccaacactctggtgctgccagggaagaact

SEQ ID NO: 607140 - DNA, 262 bp, Homo sapiens
ctaagaaagcatattaaattaatctagcttgttgtgagggagttaaatctgtttagatgtgcaccagtgtgactataatagtttggtctcaacccatttctggcctgcggctgcagaaggttgactcccagcttgctttcatttgaaagatcccagcaacaaacacatttggcatttccagccaaacccactttgtgcagcgaaggaaaagttgaggcgtgcctctgttgttttcccccaaatcattaggcagaaatgtggc

SEQ ID NO: 607141 - DNA, 305 bp, Homo sapiens
ctgcacgataacagctctcagcctctgtggtcacgatgcccttctctgcatgaaactatccctgtctctctcttagaatggacacttgagcgatgtaatttcagggccctatctggttaatctactcaggatctattcacttaatctgtatcttacaaagtctccttttataggccatatgagctgacagtcacaggtattaggggattaagtagtagatgtcttcggggtctgttttatacctctgtggcccagacttcctcagctgacctcaccccctcagactcatgctgcctgaagaactc

SEQ ID NO: 607142 - DNA, 230 bp, Homo sapiens
cctacctgcgaagctcggagctgcacccggtgccaggagctgatcttcgaggagtttgccaggttcatcctggtggaaaacacgtgcgaggcaggtggtgctgcagaccgtcatgataggacatccgtgcaggactgtagaaggcgaggccgcggatgcagagcgaagcacataccatctaccggtgacagcattgggtcactgccctgatatagcgtaacccgaacctt

SEQ ID NO: 607143 - DNA, 229 bp, Homo sapiens
ttttaaaaaaaaaaagggttttggaattaaaaaaaaaaaggggttcccctttttaaaggggtttcccaaaaaaaattttttttccctgggggttttaaaaaccttttaaaaaagggttggggaaaccgggggggtttttcccaataaaggcccttttggggaaaggggaaacttttttttttaatttgggatttgggccttttccccccaaaaaaaaattttttttcca

SEQ ID NO: 607144 - DNA, 237 bp, Homo sapiens
ctctagtatgagcaggacccaaattaatttgcatgactatgaagaacagtgtcactgtttgactggttgagtcagttatgtcattgggcatgaagatgtagccacaaactaaattatgactggctttagtcatgaacggactgacggaaagtgggcagacaaagaacagcctttctttatacttatttttatatattattattattactttttctctggagccggagtctcgcttcg

SEQ ID NO: 607145 - DNA, 381 bp, Homo sapiens
gactgagctctaagagggtcaggaaactgggcagccgctagtacagtgtagtacacccctggacaggcaggtgagccacaggcttgtcacagaccacatagagacacacgcacacacacgcgcacacagacacacacacacacaaagagtgccattgagagcctatggaccaggacgctataagatagggatgtcgttctcgatattggcgcgatggcgctgggagaatacattcagcgatccacacgatgttgcgacactcctgctccttgagctacacgaaggcatagaagacaccaaagtgagagtggtccaggaaggccaacttgtcccgctttacctacgttgctcagtcgaacggactgaccaatcctctagagt

SEQ ID NO: 607146 - DNA, 422 bp, Homo sapiens
  misc_feature (311)..(311): n is a, c, g, or t
  misc_feature (393)..(393): n is a, c, g, or t
  misc_feature (396)..(396): n is a, c, g, or t
tgtaggaaccaggtcttgctttgttgcccagctggtctcaaacttctggtctcgagcaatcctcccaccacagtctccccaagtgtaactccccaagtgtaactcccaacacttgggattacaggcatgagccactgtgctctaccagagttgatgttcaaatttttatagagaacgaaagaatttcactggtaactgtcagagcagtccttaaggatatgtcagaaagaaaaaaaattatgatttgagatagaaaaaacgccaaatgtatataacagaagtgcacagtaacagggaagcgacgggaaggnacagcagacccaagacactccatttctggatggcgtggatggcaccatatcgtttaggatgaagaaagggcaacataaaacnttnaccttcatttttttttttttaaaggg

SEQ ID NO: 607147 - DNA, 468 bp, Homo sapiens
gacctccacacagcactaggatataagaaatatttaaggtatttttttctcttaggactttctcactgtttttgtgtttggttgttttgttttgtttttaagtggcaatgccacattaaagtcaaaaatgacttgttgagagctgtaagtgtgacactgtgtgcttggccgggcacagacaccaagcagtatccccagcgttgagcacaggcaaaccaaaggcatggcttatcctgcctgctgaggtcaggatagggaaggacacacccagacaggcagagacagtgggaaataaatacaaagcagtcttcccagcaaagcactcgcgtaacttgaaaatgagacggaaatgccagggcaaacttgtaagtttgtgccttactgaagaaagctgttaaaattgggcaaagggtctggaaggctcccgcagacccttctgtgaggcaggtggcacaggcgtccaggcat

SEQ ID NO: 607148 - DNA, 1133 bp, Homo sapiens
ctgttgaccccctgcagctgttggaatctctgcaagaacctctgtattcttctaataaattccctcttttatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaagaaaaaaaaaaaaaaaaaaaaaaaaaaaaaaaaaaaaagcagaaaaagaaagagagaggcgggcgcgcgcgacgcacacatacacgtcaacgacggggcgcggccacacccaatcacgcaccacgacctaaaagtttagaacgaaaagagagagcggccgcacgcaaaggaggatggtttcatttagacgtacgcgcgcgcgcggcggagcaaaacagacgcgacggacgaggaagagaagcacgcccgggagcaacctcggcgggcgaaaccacaaccacaccagtggcgtggaggagtagaaaacagaagaagacacaccacaccccaccggagaagatccacgacgccacgagtggggagaaaataaacaaacaagcagcctgtagcagatggtcaagcgtcgacaaacacaacacacacgagcatccgccgggggcaagcagacaagagacgggcacggcagctcaaggagttagccagaagaaacaatacaccaccgccgagcgcggacgaagaacaacgcgcggcaccagacagcaacgaccgcggccgaccaccaggagggatgagtcatgatggtgagcgaaggagtacggagggaggaggtgaaggacggagcgaggcgcagtggaacgatgggggagagaacgagagacgaacagaagaagacgcagagaaaaagaaagcagactgagacaggagagcagcgaggctggcgtcgtgcggacggagagcgaggacgagagagaagtagaggtcagacggggtgcggcaggatcgctgcaggaaagagaagcgaggatgagatcggagtagcaggaccgagaacacagggggctgcagcagcagcgtgagactgcgtgtggagcatgagagcgaaaggacagacgaacagaagagaacgacgggcggaaggagagtaagagcgagtacaagaacg

SEQ ID NO: 607149 - DNA, 388 bp, Homo sapiens
gatgccgaaaggaaagaaggccaagggaaagaaggtggctccgcccccagctgttcgtgaagaagcaggagggtaagaaagtagtgaatcccctgtttgagaaaagccctaagaattttggcattgggacagggagcatcccaccccaaaagagcccctccccccgttttgtgaaatggcccccctatatcaggttgtagccggcagagagccatgcttttatatgcggttgaaagccgcctcctgcggattcaaccagttcacagaggcgttcgaccgccaaacagttactcagctgcttaaggtgcgcccacacgtacagaccagagacagagcaggagaggaggcagagtctttccgcccgcccgagaagaagtttgcttgcaaa

SEQ ID NO: 607150 - DNA, 484 bp, Homo sapiens
cacaggaaagggaaaacaggactttaaaaatggaacaggaataaatagcagagaggaacatccttttttttttttgttaaacagaatctaaccaggtacccattatacgatcggcattggtctgggacggtcactggagcggttctctgagcggtcttcatgtaactattaactccccgatctttctgaggctgccggtgtgagggggcagcctggtttagtcggcaaacaagcggtggctgaggactctggacaacatgagcaggcatttcccagttggaggaagtcccgggggccggtgtcagattcggccaccagcatgcacagagctgaagcgtgggcgcaggcatgggctagatggggtccagcccctttcccagaactgaaacgggtcccaatccatctctgggctcagcactccaggagggctattggaggaagcaaacctatagggaactaagaacagtcatgtgtccatgatgga

SEQ ID NO: 607151 - DNA, 289 bp, Homo sapiens
cctgggggagactgaaatgctcccaagcagggctgtcagcagctgctggatacgaactcggcaggtcagggctcaggccttgagtcagcggtggaggccaacccgagattcctgctagctagctacgttccgcacctcgtttcctctgagaaatggggcggggtgcctcagggtccgggcctgcctcgccgtgtggctgagggtctgggccttacagggcgactctgagggtctgggcctgccttgcagggtgactgagggtctaggcctgccttgtgctagttctaga

SEQ ID NO: 607152 - DNA, 413 bp, Homo sapiens
tataacaaaaggcccatgtctgtatatagaaggaataatagagtcaaaaaagcggaaaattggctatttggaacccccataataataggggatccgcgtaccaaccatagtggggtgtaaagcccatgggtaacgggtggtgggaaaacaggatatccagggggtctaaaatatacactaatttccactaatttcaatattatccaaggagacaggtgtgtatctcccggatggggagatcgggtaaatcccatctacccaattacccaattttagcatcaccaatcatggagacagccggactatgaggtggctcctggatgtgatgcaacgggaattatgcaccctcacccaggcggtagtgtccgcaaattggtctaatctggagtcaaataggggaaccaatcagacaa

SEQ ID NO: 607153 - DNA, 145 bp, Homo sapiens
atatgtgcgagagcagtcacgctgcttcgctcagcactccactgtttacacttgcgcagttctgctcgcccaccgacaccaacgacccgcgcacgcggcagccacttcctcctcactattcctcaagttctaggatggcagtgaa

SEQ ID NO: 607154 - DNA, 360 bp, Homo sapiens
gcgcgcacaggacacgcaggcacctaatcttatgcctcccccttttttggatgatgctgatgggaaccctcatccatcaagatatcaaagattaggttctgcccgtgaaaattgcatgcaggagcatcttatgccttataagggagcaacttccccaggactgaatcaagttttaagtcaagcacgcgaaccacgagatcagcccactggacagcatgattcaaagactacaacaggagcaagacctgagacgttctggtgaagcagttatcagtaataccagccgcttaagtagaggctccataagttctacctcagaggttcattcaccaccaaacgtatgactaagacgttgtggac

SEQ ID NO: 607155 - DNA, 286 bp, Homo sapiens
  misc_feature (117)..(117): n is a, c, g, or t
tgctagatgcttgatgaatggatacgggggcctggcaaatggattcagaggaggatatgatggttaactggcccttctatatctctaatcactccaacacaggtgtgtgtatatcancaaggtctcacggttcaagtgtcgtccccccggtggatataactactgtggcgtatacaaacggcgaatgtgagtattactacgcacgtttcaaaggcgaagggctcctgtgtggcacggtgtgaacccacggtgggaagcccccaccggaagggtatacttattttgg

SEQ ID NO: 607156 - DNA, 354 bp, Homo sapiens
ataagagtattcatgtatatcgtgggcaaacctccagggggggagtcatgtagtaaccataaagtcgcctataattaaacaagtcacttaaaaattatatattacaatatcatttatccccacattcatgcaaataaagtattttcatgcacgcatatagtaacatgcaacacgtgaactataagtaaagctcttctcattaaaagtatatgatcaaactagctttaatatcagaactgaaacaaaagaccgtaaaatattacgccttacctttaaaatatccaacataaatagattctccagcttttccattacctgcaaataatcacctactttaagccataatgaacatta

SEQ ID NO: 607157 - DNA, 337 bp, Homo sapiens
  misc_feature (284)..(284): n is a, c, g, or t
  misc_feature (316)..(317): n is a, c, g, or t
ctctcttgcccaggctggagtgcaatggcacgttctcagctcactgcaacctccgcctcttgggttcaagcaattctgctgcatcagcctcccgagtacctgggattacaggcatgtgccaccacgcccggctaattttgtatttttagtagagacggggttttgccatgttggccaggctggtctcgaactcttgacttcagatgatccatctgccttggactcccacagtgctgggattacaggcgtgagccacccatgcccgggctctttctcaactttanaactgtctttcttaatcctcacatctggtttnnacaccttcatccctggtctt

SEQ ID NO: 607158 - DNA, 174 bp, Homo sapiens
tgatagcatttagacaatagtaagtagcctttaatacattacatgtgctcatagtataatatataccacaacgcaacataattacattcgtacacaaactaagtaccggattaggcaacctgcttatagctgtacacatgtattccaatgaaatataagcccagtacatcaaaa

SEQ ID NO: 607159 - DNA, 182 bp, Homo sapiens
ggtgaggcgctgagacggtatggcggtgagttctgggcaggcgcagctgaaaggcccgcaaccgggaaacgtcaaaacaagcggaaggacttggtgattcctggagcagtcgcccctatctgctggtcctgcagttgctcgaccgccaccgaccccgcgcgtaggactgggcactgaatggc

SEQ ID NO: 607160 - DNA, 147 bp, Homo sapiens
aggctcggtacctgttttcgcctgctgaggttgctgaggctgagtgctgatgcgagggggcaatggaggatgcaacggcccctgcagtgttgggctgtgtgtgtgtgggcagaaactggctgtcctgggcactggcgaggaacggct

SEQ ID NO: 607161 - DNA, 109 bp, Homo sapiens
ttccctgtcaaccgtatctggatgcgcctgaaatccgaaatgactattacctgaaccttgtggattggagttctgggaatgtactggcgctgtggtactggacaacggt

SEQ ID NO: 607162 - DNA, 111 bp, Homo sapiens
cgtgttcgttctcgagggcctgttcttgagggtgggggtacttcgtctttggcgggtcgaaggtagactgcagtacccaatggaaaaggggccccgcatagcagccggggg

SEQ ID NO: 607163 - DNA, 585 bp, Homo sapiens
cccattcgacatttttaaagaccggcccggtaatttagttttgggccgctataaaagagcttatacgttgcaaggcagggttattaagcttgaatccttgagacgggcgactttttattattatcgggttcgaagaggcgcacaaaaggaccgattggcccggggaatttttggcggtttaagccagttgtttatgccagttgaaacttggcccttccctaaagttccccttttcaggaaagcattagttaagccattcccattattaacccccttcaagccattgaggttccaatttgagattgttgaccaccatggaaagttcccagcgtattaattaaaaatctcagaggccaaaggattttttctttttaggagttttccatttggggtaattcccatgggaaggaccagcttgccagaaagccccccggggttaccactggttggcttaaataggattattcgatttttaaaaatccttttccatgttttttaagtgctttatgttaattcagtggcttttgtgataatccattccttatgtggccttaaccagggttcaattaaagggggtattgttcc

SEQ ID NO: 607164 - DNA, 185 bp, Homo sapiens
aaaccaaccctttttgggggggttcaaaagggttttgggccccccaggcagtctcctgggtttttagtcccaaagcccaccccaaggattggttttgggggggtttattccccaccccataaacatcaggccccccccgggcgggttcaaaaaaagggttttaaataaaaatttttgctgggcca

SEQ ID NO: 607165 - DNA, 280 bp, Homo sapiens
gtacttttaatgatcacacgacatctctgttcgagtgctcggccatatagtctgcactagctccagttcgcgtgtatcaaaacaacatgatatatgatacaaaaaagtcgtactacctttagacacgtagcttggtacgtattgtatagagtacagatctcgagcatataagaggaattacgtatgtgaaaacctgttaatgccatggaaggactgcaattttaccagccaccctatcctaaccgacctgcatctaagttcctgctgtagttctcactgc

SEQ ID NO: 607166 - DNA, 304 bp, Homo sapiens
  misc_feature (54)..(54): n is a, c, g, or t
tggggtcccccggcccccccctttgccccaaaccgattatttttccaaaattcnccccccataggttcccgattccctggggcctggtccttttaaaaaaaaaaaaaagggggtgttcccccccttttttttttccccccgggccctttgggacggggtgtttttttttaaccctagggggccgggggggggttttgtttttttttttaaaaaagttgggttttttgggggggtgcccgttgttaaaagtttccttttggggggtcccccttgtttcccccccgggatttttttttttccccca

SEQ ID NO: 607167 - DNA, 486 bp, Homo sapiens
agcatttttactacttgtttatccaatgagtgaatacgaaggtgctttagattcagcatactatcacgctgagtcttccatacaactcactaacggaaatgaagttaaaagtttactacaaatgttattgcttcacgcaattccagagcctgtcatttctgataagaaagcatttgatgtagctaaacgtattcttaaacttgatcctaataataatgtagcacgtaatgtgcttaaagacactgcaaaacgtatggacaacattgttgtcgatattaatgaattaaacaagcatagagatgcacgatagttaaacgtatttatctctttataatgccattagagttaccatactttaatggctatttttatacagttttctctagttttatgcattaatgtataagtctaagaggtggggttgaaaataaaaaacagtacgttataattctcactgtgaaaatctgtcgacgcggccgcgaattt

SEQ ID NO: 607168 - DNA, 452 bp, Homo sapiens
gaattgtgtggtgttgtgttcgcacaagccaaatatatgcaataaagcaaaaaagcccctaaaaatagggacttcttcagtacacttatggaaaaactttgaatgtcacttgaatagcaattaccgtcacaagtttaagcaacatcatgcccagcactaatgcctttgaaggttacatgaggagaaagcacccttcagataaaataaattcatcgcaccactgaacatattcccatttgggtgaacagatatgcatcgactcggctacaaacttggaaactgacaaatgaccagcgttaaatcagctcgttgaatgattcccatcaattaatcgagttataaaaactgggtttaagccaataagcatatttacatatacttttgggcgaatgtctaaactggatttaaatttcaaagactgtaacaagccatcgtcataacaccacacaatt

SEQ ID NO: 607169 - DNA, 1053 bp, Homo sapiens
gagtggctaacttttttcattatttacgtgtatatttttccagatgaagttggtgtaattttatcatgttaagagattatatcgtgtatagacattgaattaatagatttagggacatctgtacagttctgcacttctgaggcttgtttttgtttttgtttctttttatccaaaaaaaaaccatatgcttgtagggttggaggttaaagtccatacaaccgtgttttcccgaagataggggtgcgattaatataactaggttagttgctgtgttgacattgagaggctttcaaggactatttgctccttgtttatacgcacatcgtttccatgctaaaatatgagtgggttttaatcaaaaccgcgtgatggaagtggttttccgtttggtaatgaaaactagatctcttgaagtgagtgtcttatgggtatagtccccataaaagacctatgagtcgtcggcaagtgtacaagtattcctggggcatcccacgatttgcccaggctcgttgccagaattcttcgagggaggagtcattcacaggggtggtgtctagtggggggacccaccccttcatggtaccttgtgtggtcttccgacaactatggagatatcctcatggggcggcatccaaccaaggcctcaaatttgaggagagatctgggacacagacctgttggagggccagcctgctgcaatattaattagtctccaggcataagagccccagaaagggcaccaccaaggactcttggtgtcgtcgaacacgggcaataacaacggcccaggggtcttttagaccacgagggacaaacggtggtcggtcaacgtggaaatcgccagtagcacggaggacccgactgaaatcctaggagagggcaccccggggtggacaacacttaggaacggcggagacccccacggggtttcaacacttttgtcgctggtacccggcagctggggtgtagcagactccacaaaacggcggggggttcccaaaactggacaaaattggaggcagagcatggtgtgcaccctcctgtggtatacaa

SEQ ID NO: 607170 - DNA, 1115 bp, Homo sapiens
ggacgcgtgggttctctgatcacgcatttgagaatccttcacttttcagcaaaggtgaaggattctctgatcacgcatttgagaccgtccccgcatgtgctgaaaagtgagctcagatccagcaccatgttcctcctgacccatcctgtctatcttctcagttgagtttttaatctcacattgggtttccttgtgaagttggagggaagtttactaatagcctaacactaccccaccccaactaggaggaacctctgttttcaagagagatgcctgtcctgtgcttggatacgtcagctcaattattatgtgtactgaacacaacctgtaccaaactcaatgttatctgaaaaataactgatctcagcactttctaacgttaacatctgttaaaacacttctggactcgttctgccatatcggagtgggtttacatcttagaatcgcatgctgtagaaatgctcaaaagtgcatatgggactcagctccttaggtgtaacttactactttatacagaaactaacctcttacagtatgtaaccatatgccggctctgtaccaacttctcgtgagctgcctctgacgagccacactatcgcgaacgccggtaccagcagccgccggatcataccccggctcgaggcagacgagcgataaagccaaccaggaagacctcagacacacgacaaacaaaaagcaaacacaacaacacggccacgaccccgccactacaaaccaaaccctcagacaaaggagtacccaaacaccataaaacccgacagaccacagagctctaaccagcagacaccaccacagtggcacccaccaattacgagaggacggtccacagcaatcataccccgcacagaccgacgcacaggagaacacaaacgtgcaaacccaaccaacagacgcatccacacgcaccgacgcaacacaaatgtgcaacccaaagtgagcacaatcaccgcgtagcaagaaagtcacccatcaccatcccagcaggcaacgtcacgacagaaaaagataggacacagagacagccccacacagagagagcaaaaaacagccaccaagcggtaacacgaccacacaccaccacacacaagcacgca

SEQ ID NO: 607171 - DNA, 168 bp, Homo sapiens
gactgcccaggtgtggtcacatgattctctccgcggtcttctttgccaagagcaagtcaaaaaacattctggtgagaatggtgagcgacatgggacatggtttctgcttcaacaccaagagaaaccgactgcggaaaaactgactcttttgcattatgatcagttgtg

SEQ ID NO: 607172 - DNA, 478 bp, Homo sapiens
atcatacattttgataataggttattagatttcttgcctttatgccatcaactgaggagtaggggcaatgatcccattaatacaatccttctctttctttagtaataaggcatggctagacgcactccttcagataaggcaagtagcaccaacccgtggcccagctgggccccatgtgtagcccctcttggtggagttccgagctgacccttgctggttcttttctcatgtttccagtttctgcttcttcctaccctagacccaggtacgaaaatggagatgggtgacctacatagggaagtacattcttttcatgcattaacatttttaaaaaagtaatatgtgtatatggtaaaaagccaaatgaaacagaaagataagatgaaaagtaaacatctccctcaacacatccctcacctgacccaagtttctctctctaaagcctgtcattgttgatagtttcttacatctttttcta

SEQ ID NO: 607173 - DNA, 771 bp, Homo sapiens
tgaagttgaccacccggatccgatggaagccttctaaggtgatagcagggtctctcccataggtgacgaacaagtgagtcctgctagtccgaccccctggcgaagccacgaccaagtaatccacgccctagtacttcgtttgccccaacactatgccgctttccgatacagggcgcgttcctctcgcaaggtgccctaaggcgatgcgcatgtctacgtcaaagcgattcgacaagcaaggtccttaccactgcgcgacagatacgtggcaactcgtttggtctctactcgatggacgtgtacttaggcattctatggcatcatgccgtagcatccaggcatggatcgccttgaactccaggtagctatgcctcgcaagcctagtcttcagccatgtcggccttcaagtgcgtcctgaacgcatctcccatgtttcccacatggcttgttctcaccgtttcgtacgcacgtcatgctccctcgtaggctggccagcatccgtgccacacgactggcacaacgctgcactctgcgagcgcaggcacacgctcaggtacgaaaacgtgaggttaagctcttacgctgcccccgttcagcgttcactcaccacccttgtcagcgtcgtgcccacttcatccttgaccacgtggttcccccactcccatttctctggcactctgccataatttgttgttcaaatgctccctcgaattcctgaggggcctcagggcttgtggggggtaggctgagaccaatacccccaaggtaaga

SEQ ID NO: 607174 - DNA, 155 bp, Homo sapiens
tttttttactgacatcagcggtaccctaagggtttggcctgggataggaaatggtagggtttcattgattctaagacatacatttcctttccacattctaacatctctgaaattgatgtgcatcttaaaattgatggcatcttgcaattataggg

SEQ ID NO: 607175 - DNA, 724 bp, Homo sapiens
gaagggcaactagagagagaggatggaggggtgtctgcatttagtccagacactgcttggctcgctccccgagctcctcctgtttctgagcttcctgcataactgttgagctgagagggtttcctcattctcccctatctttaccccatcatatctgatttctttcttgggcagctggtgctacttggtgccaagaatcatgttgtttgggatggaagatgcctgctcttgtctgtgtgtgttgtacttatatgtctatatggatgatgcctgtgaatgaacagcagtgtgccgtgggtcatttggacaaatctcctcccaccccccaatccactgcaactctgctgttcacacattacccttgtgcagggaggtggtgggggggcagaggactacactgacggcatagtgacaagacctgtagatactcataagatgacgtccagccctccttactgggtagtttggtgggctccgaatcggtctgtgtaccgatgcttgtaggagtcgacagttaaatcgttttgcacccaggctgtcctggtatggggatgatccctccccaggaagcatgctggtgccaaggccttggggggccaatcctactgagctgggttcctgctccttgcttggggcctccatgaaagggagtaaagaggctagtttggagagcctcccttggccctttccggtgcctccccgctggctcaaattattgagcatg

SEQ ID NO: 607176 - DNA, 280 bp, Homo sapiens
aggctgaggcaggagaatcgcttgaacccatgaggcggaggttgcggcgagccgagaacacgccactgctctctagcctgggcgacagagtaagaccctgtctcaaaaaaaaacaaaaaaaaaaagaaagtcaccttaatactccgagcagagctgagctgagatcttcacttactcccttctcacacgaatagagctctttttgaggagagccccatactttatcctgaagtattctctggtagctggaaagcccatgtgtctgcagtcttttctgctg

SEQ ID NO: 607177 - DNA, 362 bp, Homo sapiens
  misc_feature (203)..(203): n is a, c, g, or t
  misc_feature (303)..(303): n is a, c, g, or t
  misc_feature (324)..(324): n is a, c, g, or t
  misc_feature (342)..(342): n is a, c, g, or t
tcctccccccggccatgcctttggttttgggggcccatcatggaggagcacctgaactttttggacaagacctttggccgacctggggatggcctttgatccctggagcagtggcccccttgcccggtgctttcaaaaacctcaaagctggtgggggtccagatcaggccttggccttttagccctgcctgctttgggccatncaaaggaaggacaaagggtgggggcagggccccaactcagggacatccccttttctgggggacgtcagtgggccttcctgcccccccagcctggaatgtnaatcaactgtgtggggcccgngtgggtggaaggaaatanacccttttgtagctccctta

SEQ ID NO: 607178 - DNA, 150 bp, Homo sapiens
cagcatggaaaggaaaacgaaaacggcctttttaccctctaacaacccagtagcatgttaaatttaggatgggggcatgaccctccagtgtcaaaataagttttagtagatttccctgttttataaaaaaaactccctttttccctggga

SEQ ID NO: 607179 - DNA, 274 bp, Homo sapiens
acgatgattacgccatgctacgtaatacgactcactaatggggcccctggaatttaaaccgggtgggggcaaacttttcttgaaggtaactgggttcaacaaattccttactttcggcgggaagggtctcccggtgttcaaggaagggtccgaacccgggttcgggcggtcggcgttgttcaagggggtaaccgggtcgaagaaacgggggaacaagagatttacttttaaaaaaggttttaaaaacaagtggggaagctttgggggccccaag

SEQ ID NO: 607180 - DNA, 1972 bp, Homo sapiens
tatccccatgttacaaatgaagaaactgaggctcagagggagaaaggggcttgccaaggtcatagagtgagtgcctgagtcatccaaggccagtattgtcctcaccaaccccagctgtggccatgtggagcagctggggtggggggcaccggcccagaggagtcagaggcgtgccccgcaaggtggtggaactgggagtgctgccagggttacttcctccctgggtccggatgcccgagaagcagtgggtatcaccatggccgccagcattcttgatacttaccaggcaccaggcacaattctggaaccttcccccagcccccagctctcgggtgctgctcagagaggggccgtggcttaccagggatgcagggttccacaaggcagaggggcccagcgttcaggaaaggacgtggctgggggacagggctgtgcatgcagaaaaaccccgctgaccacaggtgcagcattcacggcgactttcaggcaagcaggcaccaacagccagcgagccatcattcccagggctgcgagctggcacccacgtggtcacatgcctagagctgaggagtgaggggtcagggctcaggtgtcctgcccagcccaagccatgagcttcttccaggctcatgtggcccagcagtccctgaatggccttgcttacctgggacccctccacccacgctcacaagtcatccagggccagggactctggactccattcctccaggagctgtggatcctcttgctccatcttagggggcgccccaagccccagagactacctgccggctcccactcccgcccctcaagcaagctctgcacgtggcctagagtatgacacccctctgcccttggtcccgcactgtactgtgaagacctctccagcccagggctgcaaggaggcaggggccagcgggaaggagtgctaagatgagggggaatggcctgggcaaaggtaaggccaagcgcccgcctcgctggggccagtgaagggccttccatgcagcttcccagcccctcccctcccctaccagtcttcccggccccttccccagccagtcttccctgcccctcctccaccggtgttacagtgcccctcgggcctttggcctccccatcaatgacccccagcctggctccattcctggttgtcactctaattcacgctgaagagtgaatggctgacacttgaggattgctgtgcttgaagaggcagggcttgcaatttttctggaacaatccctttcttcaggaggaggggtctctaaggcaggtgagccaggtcccctccttgtccccacatctgaaatccaatcattcaacttgggttcctcgggcctcagaggcttctcagactgtaagaggccgggaggggaaggacatcctgtccgaagcggcaagtgcgtccactaccactcatgctggagaggacaggccgcctgtcttctgtggccagggacacaggcttggggcccaccctcagacctctgagaactgcctgccagcccccgatgcagaacccttgataggcaagcctcagtttctccacaccccactcctctttctcctctcctcagccttacagctggagggcagggggctggggaagggggtcaccccaatgccctggactgggccccacagctcccccggctgcttgcttccttctcctgacggccggctccttcccacttcagcctcctctgtgggcaccgaggcccaggagcttcaaaagtcagaccaagactgtccttggtcccacaggggcagaggtgagatctgtgcgtgccccctctccacactcacggggacagggcgtgagatctttgcgccccctccccatgatctccctttccagattttcaaaacgcccaagtgacgtgaaatggtgtgtgtatttatatccgacgtaaacaatctccttcacgagatgtcctcgtctggaattaaagctgtttattctattctt

SEQ ID NO: 607181 - DNA, 1609 bp, Homo sapiens
  misc_feature (8)..(8): n is a, c, g, or t
  misc_feature (1369)..(1369): n is a, c, g, or t
  misc_feature (1374)..(1375): n is a, c, g, or t
  misc_feature (1381)..(1381): n is a, c, g, or t
  misc_feature (1387)..(1387): n is a, c, g, or t
  misc_feature (1394)..(1395): n is a, c, g, or t
  misc_feature (1399)..(1399): n is a, c, g, or t
  misc_feature (1402)..(1402): n is a, c, g, or t
  misc_feature (1408)..(1408): n is a, c, g, or t
  misc_feature (1421)..(1421): n is a, c, g, or t
  misc_feature (1435)..(1438): n is a, c, g, or t
  misc_feature (1443)..(1443): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccaggggtaagcagngggcnnagctcnggctangggggcnnaaanccnggccanataaggcgggccnagtggcggggggcnnnncctancggacaatctcaggcgggggggaaaactaacaccgtggggacggggtggacccgagccgccaaagaaagggggggcccagacacccccgggccacggaggggcgccggcggcgagagaccggaccccccggagagaagaaccgcccacaaagtctcacgcccaaaa

SEQ ID NO: 607182 - DNA, 164 bp, Homo sapiens
  misc_feature (152)..(153): n is a, c, g, or t
agctgcttgaggatccagttctggtcccccactaataatacaacaaacagcggtgtggtggtgcatgctgaaatcccagctactcaggaggctgaggcaggagaattgcttgactctgggaggtggaggttgctgtgagcaatgatcgcacnncattacactct

SEQ ID NO: 607183 - DNA, 1235 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgacacacacgcgaacacagcacacacgaacacagcacacacagcacacacacaaacacagcacacacatgcacacagcacacgcacacacagcacacagatgagca

SEQ ID NO: 607184 - DNA, 248 bp, Homo sapiens
  misc_feature (52)..(53): n is a, c, g, or t
cttacagaccttccgtacgccaatgatgtgcttctccatataagtcataggnnttctacatatacttctctccagccacgagagctaatcccaagaatatgaggtggcgtgaattaagtgatttattagctatctacaagagaagctacgaacccccctgtaattcaagaagaaaaacccaagaagaagaagaaggcacaggaggatctctaaagccgtaggccaacaccactttggtaaaaggactc

SEQ ID NO: 607185 - DNA, 2491 bp, Homo sapiens
  misc_feature (8)..(8): n is a, c, g, or t
  misc_feature (2491)..(2491): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctcctagtgctgacattgagtggtctcaaaggccaaagggcttcccatggaaggccgccaattgcaagtagtgtccgagacctaggactgatcgtatgagcatgtgccagttgaagggagttgccttagacgccgataggttggtccttgacgtcttggtacggtgccaggcccatgtcagtcggggctcatagcaaggcatatggactgacggtcagacttgtctgatgacgtacgctaggcgaggcttgattgaaactggtcataggacttcggccgctgtgacactcggcaagcattctgcacgaccctacacgtgagagctcgcttggaggcgcgccggtagagctcggcgtggtaggtctgggagatgacagaagctagtgatgtattcataccgtatagaactcatctcatgcgggtcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607186 - DNA, 1149 bp, Homo sapiens
atgcagagagcaagcaatgtcacctaccaagcccatcatgtcagcaggaacaagagaggtcaggtggtggggaccagaggtggctttcgtggttgcacagtttagggcaacaggcttgtctggagcgggaaagactactgtgagcatggccttggcggcagtacctggttagtcatggtcattcccatgctcaccactctaggcatggtgaccacatcattcgtccaagggtctccaatcacacacatcttggctttagtcctgcaagaccagcagcacagcagcaatgttcgcacgcgatcgcagcacagtctagctaacacactgttctgcaaagcatagctcggcttcagttgtgccatccaccacagtttccatcatccacctttcacacttccaggcatcgccacacacatgcgacaggcccaaattccatagcacaggtgcaaagattaaccctgtcgattataggccaggtcatttggttggatggcttcctcatgacaagtgctagaggtgcaccaacgcaggggcattgtcaaacagcggacatcgtacgaacacaacaagcccccggtgccaggggaggacacattttcacaacggggttctagaacttgggcgaacttcgactctccttggaacttcattgaaacaagggcccaagaaggaggccgccttgccagccttgggctgcttggaaaaaacctggacctccactggctcgcgtggtcccatggacctggtgtaccgagcaacagttcggaggacacccttcctaatccacggcaaccgggggactccacggagaaccctagggaggcctaggaccatcttcacatgacagcgacaacaggacaactactactaggcgccacaacaacaagtacacagccttccaccaggggcacaacaccagacatgggggacaccactgcaacaaccaccggcaaaagtacaccaagcgggcgaaagcacagaggaagtcaacgaagggcaccaaccggacgggcaacacacagcagcccggggagacagcacacgaacacgcgcacacgagcaccagacccaaaaaagcaaggcacaaaggaaaacggcggcaaaaccgacccgagccaccaaacaccacagagcacacaccaagcacaa

SEQ ID NO: 607187 - DNA, 714 bp, Homo sapiens
gacacatcactcatgtacactcctcggttggtttcggccagctcactgtcacgcgctgttcctagtgtgttttgtcttggtcgtctcgctgtgatagatagtatgaggtgatgagtgatctcgccccggactattggggggcaggtaaacgcacacaccccaggctgtggcgcatacacacgtttttgttcacacaccactgagcggtcgccgtgctcacgtactgtggcgctcctctctgttagctactactgttgcggcttattgtgggctttgttatattagtggggtgtctataacaactgtctcgttgaatggtttctgtaaagatactcgaggtgagtaaaaaacaaaggggagtgagatagatgagtgtttttatgcatttgttcaccacaccatgctctatatatacgctaagtataaacgccagacacctctgtctcagagaggagtggacgccctcgcctcctttgaggagacgcatggtatatcttggctgcatgttgtgatcatgagtatttatcgttggcgtcaccgcgctaacctcttcgttgccacacccgctcccatatattttcttgttgcaggagccacatcatctgggcgcatgcaagacagaaggggagggggggggaaagaggggggggtttttttaattttaaattttttgtgttttgtgaaaaaaaaaatttattttgggtggtttttaca

SEQ ID NO: 607188 - DNA, 158 bp, Homo sapiens
agctttgtgtttgaccaccagcctagtgtgacatctttggctgtgtgtgcccacatcggttggattacaggacacatgctacagctttgtatgggcgctctctgcaatggtgccaccagcgtcctttttgagagcaccccgagtttatcccaatgctg

SEQ ID NO: 607189 - DNA, 1433 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccgaaccagccctcgccggcctcggattccggctctggctacgtaccgggctcggactctgcagcctacagtaacttgccccaacgagaaggtcgccaagggagatcgccagggccgaggtggagaagcgcctagcagcctgcagtcaacctcatccctcagatgacatccatctatgcagtggacaagggaaagatcgacggagagaacagcgcaaggtgcctggcacgacgcactcacacacccacaagctccctgggacgcaagcatcgaacaagcatccacggaacgaacatgaagacaccattaccgaaagtgggccagagaaaatcgcatcgcccgcggaacaaggggaactacgaacctgaaaaggaa

SEQ ID NO: 607190 - DNA, 149 bp, Homo sapiens
aactcagtggggaaaatacgattccaagaccattccgcatctgtgatatcatggatcttttatttccttggggggctgaattgagctaaaaaaaaaggctctttgaaatagttttatttctctccacagttttttttgtttggtttgtg

SEQ ID NO: 607191 - DNA, 647 bp, Homo sapiens
gacccagaggatccctcgaatcgacggttctctgtatataattatttctagtatattccattgtagtctgaaaaggtacttgatataatcttaaattttaaaatttgttgagatttattttgtgggcaacatatgggctatcctggagaatggttccttgtgttgacaagaaaatgtattctgcagtttttgttctatgttctcttgtatagcactgaacttgttaataacattatttaaaattcttttttgggcatttcattgtattgctttttcattcaaacctgttcctagagaattactgtgttccttcagaggcattctgtttccttgctttttcatgtttcttatatccttacactcatatttgtgcatctggtgtaactgtctcttctttcaattttatggattggctttcataggaaaagacttttcctgatagatgtatctattgtatcggttgggtaggatgctttggcttttattttgggtgggggcagtagtttagtttccatatttcttcagctataatcagtgtcagtggtatctgtgagttcctcagtggattggctgtggttgtatggggaaagaggtggtctaatccagatgttcataggatctatctggttgcacgctggaggagaaca

SEQ ID NO: 607192 - DNA, 2134 bp, Homo sapiens
  misc_feature (8)..(8): n is a, c, g, or t
  misc_feature (2134)..(2134): n is a, c, g, or t
gaacaatnagctaggtacgaggctgggtgttgaatcggccgagggcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607193 - DNA, 324 bp, Homo sapiens
atgaaccacagcttctaacacagctgagtagcactgcattatgccacatctacaacactcttcactaactgcccatactgagcacaattacattgtctaagtcatagctctttcctgtataaaagctgtcgaactcttgcccaccccggtgaagccagcttctggacttgtggggataccgacagcacgaagcggctacactgccgcagagccaccctgtgccacctcgtcccccctcctctgcagcccagcggagctgacgggggcgggggcgtgcgcggtgggggctgacatcttataatacggatatacatattgtcacgc

SEQ ID NO: 607194 - DNA, 437 bp, Homo sapiens
tgttgactctatcaggatccccgagtctgatctctcgcgggtcatgggaattccgccggccgtccctcgccggttcggcatcgcctttctggtcatacctaggacgtgttttctgatcatctgcgaacctccgattggcgttcttctttagtgaacccattctcgtccaagtgctttcgctgctgcgtccgtcttgcgccgtctctgacatttacaacccttgcggcgcaatacgaatgcctcccggcccgtccctcttaatcatggcctcagttccgaaaaccaacaaaatagaaccgaggtcctattccattattcctagctgcggtatccaggcggctcgggcctgctttgaacactctaattttttcaaagtaaacgcttcgggccccgcgggacactcagctaagagcatcgagggggcgccgagatcagat

SEQ ID NO: 607195 - DNA, 2322 bp, Homo sapiens
  misc_feature (8)..(8): n is a, c, g, or t
  misc_feature (2322)..(2322): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607196 - DNA, 2371 bp, Homo sapiens
  misc_feature (2371)..(2371): n is a, c, g, or t
ggaccgctccttctagggtgtcgatctggtactacccgactatctccactcctaatgtctagcatgtgcatcaaggtgatgcatgaggttcgtagaggctgtgcatcgtcgggccccatgatctaggacagtgcgctacgtgacacgaggtgggtgcgcggtattcccagtatcctactctgtcgagcttttctggtattggtgcgattatcctcttttgcggtggtgtgggacagagggaactaggtgggagtcgagacggtgctaatgaggaggctagttagccgcatcattacggatctgatgcagagaccgatggatgaacccacgcatgtccgatggaggtggaccccgagcaatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607197 - DNA, 466 bp, Homo sapiens
tctgggtttcatcccaggatgtgtgtgtgtgagtgagtgagagagagagagaggtgtgtgtgtgtgacaggatggagagggtgggaagggtcttacaggccagagagtggccggagtaacatatccaaccttaatttcttggtgggactcagctcatgtcagacctgaaggtacccttaagaaacaagtatggcgtaggtatgtaagagacagagagagtaatgagcaagcaattgagcgcataagctgtctaacgttttatatcttgtatggccatttgacaccctttaagcagtgttttgtaagcattaaatcttctagctttccagctgcatgtttatactggctaaccctgctttcctttgtttgtaaatcacactcattgtgggtgacggggaatcagggttcgattccggagagggagcctgagaaacggctaccacatccaaggaaggcagcacacgcg

SEQ ID NO: 607198 - DNA, 333 bp, Homo sapiens
cagggggagggtaaaattttttacctaagtaatacatggttcattctgttttacaaaaggaaaccattacaaaaagggttaggcccttttgtcactcccaacccataagatcactgtaaaagtttcaggtgcatttttccaggctttttctatacatggatacatttacgtgcatatttatatacccataaaaatatataataattttttttttgagacggagtctggctctgtcgcccaagctggaatgcaatgtgccaaattttggtttattgaaccctatgccttcctggctcaaggtatttttctgccttaatcttccgagttgctggg

SEQ ID NO: 607199 - DNA, 2496 bp, Homo sapiens
  misc_feature (8)..(8): n is a, c, g, or t
  misc_feature (445)..(445): n is a, c, g, or t
  misc_feature (2496)..(2496): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccacgtgcggagcctagacgtgacattggggacgtgtcatcatcgcgcgaagtattcaggtccatgcgaagatgactctagcatgacgtcccccgcttgctaccttggatgtgttgtgcgcacctcgcagagcactccagagcctgattagcggcatcgctatgtgangagagagagtcaaagactcgaagcgatcgcacttcgaagcaagcaaaagttgttgccctctcgttcattaggacgaagggtactggttcctaggtacggcacgtcggacgatacgaaggatgcttggtagactcaaagtggaagccttcctgctacgcattctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607200 - DNA, 2325 bp, Homo sapiens
  misc_feature (2325)..(2325): n is a, c, g, or t
ttgtcagactcctgccggcagctgccctgggggacatgtgtgcccatctggacatcctccagccccgtgcagtccgcgtcttcactgttccacggcctcccagtgcctcccagtcgattggacccatctccctcctgcagtttgaggccatgagaggtgagtggacctgacaagtgccagagtaaccgtgtagacagagcagtgtagacagcgctcagccccagtcccaggtgtggacctcatgctggtgatggctcccctgggtggcctgccagccacagccagtgccatcagggagctgaaggggctgtgacgcgcaggctaactccgagctgccccttcacgttggtcatcaaggacctgtgcgcgtccggctcgtgccgctgctcatgtggaattccgtttggagaagggtgtccctgttcgctagggacaagtaaagagttgtggtacgtcccgcaaacaatggaagaaggagtgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607201 - DNA, 993 bp, Homo sapiens
  misc_feature (103)..(103): n is a, c, g, or t
  misc_feature (436)..(436): n is a, c, g, or t
  misc_feature (541)..(541): n is a, c, g, or t
  misc_feature (710)..(711): n is a, c, g, or t
  misc_feature (725)..(725): n is a, c, g, or t
  misc_feature (780)..(780): n is a, c, g, or t
cccgggctgcaggaattcggcacgagcttcccgctgccctgcgctcggcgggctggcattccggcccggggaaagcggaccagcccttctgcaggtctgcggngccaagtgtcccggcggcgcacctcgtggcgagaatcgggagaaggaggagactacaaggataggcccaggagtaatggagtccaaagagaaacgagcagtaaacagtctcagcatggaaaatgccaaccaagaaaatgaagaaaaggagcaagttgctaataaaggggagcccttggccctccctttggatgctggtgaatactgtgtgcctagaggaaatcgtaggcggttccgcgttaggcagcccatcctgcagtatagatgggatatgatgcataggcttggagaaccacaggcaaggatgagagaagagaatatggaaaggattggngaggaggtgagacagctgatggaaaagctgagggaaaagcacgtgagtcatagtctgcgggcagtcagcactgacccccctcaccatgaccatcatgatgagttntgcctttatgccctgaatctgatggcttccctaaagtcatacggaaacagacccctgctttcgacttacatcgtcatgatgtgcccttgtgtaaaccttaacctgtcactggctacgtgggtctctattaccacttctaactgaatatggcgttttgaaccagtctganngattttgttgcagngaattaacctatgcatgaaagacctcttttaggaagtaataggcactttaaagcnaaaaaaaaaaaactcgggggggccggcccatattgcctatgggagggtttaattacttgcgggtttaaactcgaagggaaaccttggttaccattaaggcttggcataccctttgacatgggaataaaaaaggccgaccgtgccttcaaattgtgacctaatgggagggaattgacggaaattttaaaatcggaaattttgtaaacacttttt

SEQ ID NO: 607202 - DNA, 1903 bp, Homo sapiens
  misc_feature (1903)..(1903): n is a, c, g, or t
acttggagccatagcaagacggtccagccaatgcgtcatgagtacaaacactgtatgtgatctcattcagtagccttaggcggtagacggatactcatgggctcatgcgcacgctgaagcgggatgtggagctatgtgaacagtgcagggtgttgatgaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607203 - DNA, 138 bp, Homo sapiens
gctttgggggagagcactcagatttctccacgctgactctaacaataggtctagagagcaggcatgggacattggtggcttgggctttttacagtaatgaggagttggggttgaggttggggtgaaagttcttgtgca

SEQ ID NO: 607204 - DNA, 336 bp, Homo sapiens
  misc_feature (10)..(10): n is a, c, g, or t
  misc_feature (64)..(64): n is a, c, g, or t
  misc_feature (93)..(94): n is a, c, g, or t
  misc_feature (104)..(104): n is a, c, g, or t
  misc_feature (117)..(117): n is a, c, g, or t
  misc_feature (171)..(171): n is a, c, g, or t
  misc_feature (250)..(250): n is a, c, g, or t
  misc_feature (264)..(264): n is a, c, g, or t
  misc_feature (330)..(330): n is a, c, g, or t
caccttttgnctgtcattcttgacattaccacctccaggtacatgatgagcattttcaagaganccaactttagcttgggccttttctttganntcttgttttnccctctccttttncccccgtccgccccctggcctgtggcgggtgttcttcggggggccacgtttggntgtctcttggcttgggtcttttttcttggtttctttttgtgcctgcccccctttgggctggtttttgttgttgtctgtngttccgtttttggntttgtctttcttcgggtctggcggtggttggttatttggccgaggctgcttgggagtagcaggagnttttgg

SEQ ID NO: 607205 - DNA, 265 bp, Homo sapiens
agcgaacctctcgaactatatccgtctgggcggaacggggcccacgtattatatttcagaccttcagcgtttcacgatcgcaaagtacttctcgtagggtgcatcgcacatagtggagcgtcgcgctttgcgcttgttacaggccggtcgctgaactacagtttctggtgactggaaaaccctctgcgtgagctcacccgcatgttccgtaaaggattggtgaacctagaacgtcgggctttccagactaaggatcttgacggag

SEQ ID NO: 607206 - DNA, 464 bp, Homo sapiens
  misc_feature (43)..(43): n is a, c, g, or t
  misc_feature (79)..(79): n is a, c, g, or t
  misc_feature (104)..(104): n is a, c, g, or t
  misc_feature (188)..(188): n is a, c, g, or t
  misc_feature (230)..(230): n is a, c, g, or t
  misc_feature (235)..(235): n is a, c, g, or t
  misc_feature (418)..(418): n is a, c, g, or t
  misc_feature (422)..(422): n is a, c, g, or t
  misc_feature (441)..(441): n is a, c, g, or t
  misc_feature (445)..(445): n is a, c, g, or t
  misc_feature (453)..(453): n is a, c, g, or t
  misc_feature (461)..(461): n is a, c, g, or t
  misc_feature (464)..(464): n is a, c, g, or t
caagaatcaactcgaagccaaagtaatccggaatcatgttacntgaaatcgaattccggcaacgaatcgcgttgttcangccccgtgtttgaattttgcccaancgttgtctcgcgcgctcgttcggctggaatgctgatcgccgcgaaagccgaacgagtacgtcacccctggttgaatgccgtcgnccgcgatgccgcgtgcgaacagcgaaggcatcgcaacgaagngcttngcgacggcggcagcggtgacacaagttcgaatcgttttatgcatggtacggacccccaaagaatggtttccattctccctgtagggtcttttcgccatcttgatattggtcaagccagcgtaaacgtggggcggttttgcgcaggctcggtcgcacagcccgtcagcagcaggtccagcagantcgncacgcctcggatcgcacgncganacggcacntcgcggcnatn

SEQ ID NO: 607207 - DNA, 250 bp, Homo sapiens
gtctgattcatcagagcaacagtcatattctgagactacactctggcaactgcttcttcatgtagggaattgataatttagaaactagttgcattattcagtatgtctccaaaggatttttttttataagtaaactatccgcctaaatagttaagccctttaggggcaagcaaaaacagcccttattaccccatcaacaacccagtttgacacggtaattcagtgttctatagggcaaacagtgtttttc

SEQ ID NO: 607208 - DNA, 389 bp, Homo sapiens
tagacacatagaggatccctctctgcctccataattccctcagaaaataattctgcacacactgcaccctggcaaggagactcatagcccttcaagagtcccccacatggccagacacagtggctcatgcctgtaatcccagcactctgggaggccaaggcgggcagatcacttgaggtcaggagttcaagaccagcctggccaagatggtgaaaccctgtctctactaaaaatacaaaaattagccaggcatgctgatgggcacctttaatcccagctactcgggaggctgaggcagagaattgcttgaacccgggaagcagaggttgcagtgagctgagattgcaccactgcactccagcctgggtgacagagtaagactccgtctc

SEQ ID NO: 607209 - DNA, 290 bp, Homo sapiens
ggggtttttttttctccccctgcccggggttaaagaatgggggcccgaaaaaaaaaaaaaaactaacccccttgttgggttgaaggttcctttttgcccgttatgttcgggaacccccataccctgaaaaagtttggctttgaggggccattttcattttcatcaagggtgataattgtccaagggctttttccctttgttggctaaataaccccccaggggggggttttttgttgtttggggggtgaattttaggttccaataaaaattttttttttgttttgccccca

SEQ ID NO: 607210 - DNA, 206 bp, Homo sapiens
cggggtccaagcggtccaggttatattgacccgggatgggtcttcactcgctccttcttcctcgccagtggggtgattcacggtagcatgagcggtccttgttagtccaggattgcccagccacatcgatgtgatggacgaaaatggaccctcctgagtcctacccgcttcctgtggtgcttaattgctagtccgtagtaagtaga

SEQ ID NO: 607211 - DNA, 121 bp, Homo sapiens
  misc_feature (70)..(70): n is a, c, g, or t
  misc_feature (80)..(80): n is a, c, g, or t
gatccacctgccttggccttccaaggtgttggaattacaggcgtgagcaaccgcgcctggtctatatgtnatttcaaatnaggtggccttataaatataagcagatgggtttctgggcaaa

SEQ ID NO: 607212 - DNA, 182 bp, Homo sapiens
ttagatggctgtgtcatagcagccgtgtccatgaaagtgggatcaacacaacgaacataagatgtcagtcgattaggcgataatcttcttctgttttttttttggaaacaaattctcactcatggttttggccatgtgggccaggcggttcttaaactcctgacctcaagtgatcctccccg

SEQ ID NO: 607213 - DNA, 1100 bp, Homo sapiens
  misc_feature (48)..(48): n is a, c, g, or t
  misc_feature (61)..(61): n is a, c, g, or t
  misc_feature (247)..(247): n is a, c, g, or t
  misc_feature (275)..(275): n is a, c, g, or t
  misc_feature (635)..(635): n is a, c, g, or t
  misc_feature (688)..(688): n is a, c, g, or t
  misc_feature (864)..(864): n is a, c, g, or t
  misc_feature (966)..(966): n is a, c, g, or t
cccgggaagacgcggccatctggggttgggtgcgcccgcgccacttcntgtctcatcaatngtgctctggctgggtcgtagtgcgcaggagccatctcgtccgcatcggtggcgcagcgagcagggttatagatacatgtacagtaaagcaacgcaccggcagttgccaacgaagtagagcaagggacatcaaaaataaaatagcacccaatcaaccaggagtgcgagagaccgccggctccacccntatttctcatcatccctctctatcaccngtatataggagtgcgcgaggaggatatgaggtatagtggaagaagagcgatgaacgaaagccgagggagtgagacgcgtggtatcgcgcgacatagagaggaccacgccgccaacacagccccacgccccgcgcaccaggcccacgtccgagtgtggaagaccgcgagtacgcgtcgagcgcatatctaaatattaccccgtgagtgttgagcgtgcgattggatatatgtttcgctgctgttgtgcgtgtgtccgtggcggggtgtgtgctttgtgttggtagtggttcggcgcgtgcgcgcgcgacccggcgcatctgactgcacgccagtcagagcggttaacgctgcatgacggtntctagtgaaattatcagggaattgtactagcataggatgatacagtgagaaanagtgtcaaagcatttatattacagtattgtacaaagacagctgtatcgatacaacttcatgtgtttaatcagcaccacggcaacgtcgcgctccaccgagcagatcgcgcagaacagaataagagtgagttgtgagagactgggtaagcgatgaagtggtatagctcgcgaaccantagtagactccgacgcacacagacaccccacttcacgacggacgctccaccgtcacgtgatccttgctccactctaccgctctcacgggcgtcgcgcccgangcacgtcgcggcgtgtcggcagagacgctggagacgggacggaagtacatagcgagacacggctcagagcaggatctctggcaacgtacaggtagcgtctgagcgcgttgtcgtacgaaagtgaacgataagtt

SEQ ID NO: 607214 - DNA, 134 bp, Homo sapiens
cagccacagagaaaaatgaggaagaacaaaaagcggaaaccctgataaacccatcagatctcatgagatttattcactatcacaggaatagaacaggcccctttgattcaattacttccccccctgtggaaaag

SEQ ID NO: 607215 - DNA, 310 bp, Homo sapiens
gattaatgtagaacgagcaggaaaaggggtgatacggagctcaagggcacacactgggaatggactcacacggcagccttgagacgcacagggatacaactgaccaccctccaacataggcatgtgagaaaacgaacacgaggcatgcgttagacagatacatgtgagggatgcagattccagtggttaccttaagaaactggagttaggcataatcccactcagcagacaatcccgatcagtggacagcctatgaaacgcatggggccatcatgcagaccaaagcggcccgtgagttttgtacgatcct

SEQ ID NO: 607216 - DNA, 352 bp, Homo sapiens
agggaggctttttaacccaggaggcaaaggttgcaacgaacttagatcgcgcccctgccctccagcctgggtgataaagtgagattccgtttccaaaaaaaaaaaaaaaaaaagctgtgcgaaaaaatttgtttttctctggggccctttctttcttttctttttaaaccaacccaaaaattttacatcccagtttttaaacaaagtggggccttccaaactttttgtattacaataaccttcaaaagccccttccccttaaagtttgttgtttttgttttaatcatccccccaaataaatgttttagctttgttttaaactgtgagttttcataaaattgtgttcccccca

SEQ ID NO: 607217 - DNA, 209 bp, Homo sapiens
gtctctaggtcgccgggtccaccgccgcacatgcctcggggaagcgcagcgcgctccggcagcagcgcccgcggcctctgccaccgccggccacgcctgggcgcccaccgccctgccggttgtgtgggagcaggcgcggggtacgtggccggtgtgaccgtatgcgaggcctgcccgacgtcgcgggggggtcgagcctcttcggcgtc

SEQ ID NO: 607218 - DNA, 1059 bp, Homo sapiens
  misc_feature (301)..(301): n is a, c, g, or t
tgggtttaaaaaaggggtattttttggggggaaaaaaaaaagggggggccccaaaggccccccccctttaaagggggttaactggaaaatgggaaggggggaaaataagggggggggggaaggactgggggcagagaacccccccaacaggaggggtgtcctctctctctcttctcatcttgtgtgagtgactcttgagtgggcgagccggggtgcccaagggggatcataacctccttgggaggcgcaatgtggtggcgcacataagaggctaacaccacccttgttgtgcttgctaccncaaaatctccgctgcgtcatacaccaagaaaaactgaactctcgacgaaaagatggcctcggtagacgcgaaagtgcacagccacaaagggctacaacggttggagaggagggggatcgccccgcttgtcaaaaaaagctcaagaaggacacacccccgtggggcgcatcatagcggccgcccaaggaggaccacattaagggggagcccccaaagaacgccgttgtttccaaccacttttacgtaggcagcgcacaccacatactcgggggacgacttccaacaaaaaaccggcaggccatcaagtgctccccccctcgagtaacacttctgcaacacgtcgggcgacacgggacgcgacagtgcaagagaacaattccagagtaaagccaaagggggagaatgaccttggcacccaaaagccccctggcaaccaccacaaaaaagagcccggcgaaaattctctcggagagaccaccccgcgggtgaacacaaccgcaccaagctctcccgagaagggccaccacaagattctgggggggagcaccacatagtgcactgaccaggggacgccggacgtccaccgaaaaacagagtgcgacagcgaaaccctgggcaggggtcaaccagtgtgcgctcagcgaagcatagcaaacatgcagcgacggcaccaacggcaccacacagacaagggtgattaacgcagccaacgacaccaggccaccgacacaatagctacctactgggtagacacgcaa

SEQ ID NO: 607219 - DNA, 145 bp, Homo sapiens
taatcaaggtacttttttgtcattgccaaagcaacgaagaatcccctttttcccttcattattgacagcttcagttctctgtacttactgtgtcatcctatcctttcctttcccttgagctctggactgctcttcccaagggaga

SEQ ID NO: 607220 - DNA, 1004 bp, Homo sapiens
cgctcctgtgcctgcctgctcatgctccaacagctacaggagtgtggacgggcgagtgaagaacatgacgtggaggcgtgcaccaggacccaagctgaagacgatccagcagggtcgactccgagcctgtcgcgagcgcgtggacagagagagggacctgccggacgacagcacacaaagttatcctgcgtgtcggcgcgctgcctcggtggacggcagcttgcattcattgtgccttctttactctgaggtttcctgtctgagacacctgcgtctgctctatcgcttggaccgagtatccaggaccgggctgactccggctgtgacgtttgagtggggccatgctgccatcctcactcgtggcggcttgatgagcatgtgctgtggatgaaggctgatctgaatcactccgagtaggtgcgtgcagacgtccccagccgcttgttctcgggcgagattgcgccgcagaagaagaggggtagttgggcgtgcactcggctccctcggtgtggccgagagctatggcgccttgtctcgctgatgttggattgagttgagtctagtctaaccttggatgtccaggcttgccttggtcctcgattctcttttttcttttgttgtctttgcatccaccacgcttcattcatctccaagaaaggagcgcatggtgcagaaacggggtccggcttttccaacctgggagcctgctgctcatcgtggccatgggcgggatcttgtgcccgtctttgggcctgccctggtttggtgctgcatgtccgtctgtcactcaaggccaacgcgctcacttgtcatgagcaaggtgtgggcacctgtgggaaaggcccaagattccaggcagttcaagagcagcgggtggagcggggtggtggttggcctgtggtggctttcctgtttcacgggatctggccggggatcccctgggcggggcttggattcttgctggaggacccctaaggagcagtcttagaggggtttgggcatgc

SEQ ID NO: 607221 - DNA, 650 bp, Homo sapiens
  misc_feature (46)..(46): n is a, c, g, or t
  misc_feature (61)..(63): n is a, c, g, or t
  misc_feature (72)..(72): n is a, c, g, or t
  misc_feature (83)..(83): n is a, c, g, or t
  misc_feature (148)..(148): n is a, c, g, or t
  misc_feature (155)..(155): n is a, c, g, or t
  misc_feature (157)..(158): n is a, c, g, or t
  misc_feature (160)..(161): n is a, c, g, or t
  misc_feature (165)..(166): n is a, c, g, or t
  misc_feature (168)..(168): n is a, c, g, or t
  misc_feature (170)..(170): n is a, c, g, or t
  misc_feature (175)..(175): n is a, c, g, or t
  misc_feature (189)..(190): n is a, c, g, or t
  misc_feature (193)..(193): n is a, c, g, or t
  misc_feature (195)..(195): n is a, c, g, or t
  misc_feature (222)..(222): n is a, c, g, or t
  misc_feature (224)..(224): n is a, c, g, or t
  misc_feature (228)..(228): n is a, c, g, or t
  misc_feature (231)..(231): n is a, c, g, or t
  misc_feature (234)..(234): n is a, c, g, or t
  misc_feature (244)..(244): n is a, c, g, or t
  misc_feature (246)..(246): n is a, c, g, or t
  misc_feature (248)..(248): n is a, c, g, or t
  misc_feature (250)..(250): n is a, c, g, or t
  misc_feature (300)..(300): n is a, c, g, or t
  misc_feature (303)..(303): n is a, c, g, or t
  misc_feature (307)..(308): n is a, c, g, or t
  misc_feature (310)..(310): n is a, c, g, or t
  misc_feature (321)..(322): n is a, c, g, or t
  misc_feature (332)..(332): n is a, c, g, or t
  misc_feature (341)..(341): n is a, c, g, or t
  misc_feature (345)..(345): n is a, c, g, or t
  misc_feature (361)..(361): n is a, c, g, or t
  misc_feature (572)..(572): n is a, c, g, or t
  misc_feature (586)..(586): n is a, c, g, or t
  misc_feature (638)..(638): n is a, c, g, or t
tggggggtgtggtggttagaggagaggtgaaggaggaggggggggngggggggggggaggnnngggttgganagaggggtganaatgtgtgtgatggggtgatggaagggttggttgaggttgggaggtgggatgaagaaggaatagnggatggngnngnngtgnnanangatgntgatgtgtaatttnnggngngtgttaaaatagtggaggaagtgtttnanggtnatntgntgaggattangntngnggggttgtaggtgaaagggatgggagaatgtggagtgttggttatagtantgntganntngtgggggaagnngttgagaganaggaaaganaggnatggtgaatttgaggnaaggattgttgtaggagtgaaggtgtgggtgggggtggagaaggttgtagaggtggagagagagaaggggaaggaggggtggtgtggtggtgggaatgggtgggatgatgttgggtggaatgaggttggtgttgtgggggtgtggagaaggaatgtgatagttttgtggggggaggttggatggagggaggatgaaatggatatgaaagtnggtgtgatgatggntgtgaaagtgaatggggtagatgttgaatggagggaggtgtgttggggtggngagagtgggttg

SEQ ID NO: 607222 - DNA, 784 bp, Homo sapiens
tacgagcacgaggtctcctgcttgaggtaggagggagactggatgaacccgtccagcttcagactccagctttaactatcatgtctgctcctaatgggaggcccaaagctcagggctgggagagcctggaggtccccactatgaatctccagcaggagggtccttctctccactgagaaccgtcactcctcccaccccctccccctgggtggacaaatcaggacacaacagagggcaagaggacaccattagcatttaaaatgtagccccaggatatggagcctggagaaacacatgtactggaccacttaccctctggaggcactacagcgtttccactccggaaggctggagagggaaggtggagataagatgatcatttggagctataaggagtaccaagcccatattcctactgagtgccacacagctgaaacaccatgacaccactcagtgggcacagtgaaacatacagactgtaggtcctcaagagccttcagagatgatccagacacaaaaccccatatagcagacgagggaaaacatggaggcacaagacaggacacggaagagcgaccacaccacggacccaagaacccacgggcacacagacaggagactgaaaacccagggacataggaaaaagacgtcaggggaccaaactcaataggccataaacacaaggacacccatcagcacagggacgcaaaaggcatcggaaacagaagagcaactgaggccccagaaacaaccgccatggaggaccggcacaagaggccaaacc

SEQ ID NO: 607223 - DNA, 1332 bp, Homo sapiens
  misc_feature (285)..(286): n is a, c, g, or t
  misc_feature (291)..(292): n is a, c, g, or t
  misc_feature (298)..(299): n is a, c, g, or t
  misc_feature (319)..(319): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (334)..(334): n is a, c, g, or t
  misc_feature (346)..(346): n is a, c, g, or t
  misc_feature (352)..(352): n is a, c, g, or t
  misc_feature (354)..(354): n is a, c, g, or t
  misc_feature (356)..(356): n is a, c, g, or t
  misc_feature (360)..(361): n is a, c, g, or t
  misc_feature (367)..(367): n is a, c, g, or t
  misc_feature (370)..(370): n is a, c, g, or t
gcaatattgaatgatgataatggagccttagaggtcttgaatcattggttcggctgctttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgtctaaaggctgcgaatgggatcctgatggaactaaggactccaatgtcgaactcttctttgctgcattcctttttcnncactnncaagannggcctgaaggaggactttcntgtanccangnacantttttagggtcnaagtgntnanaatnnactcanccnggttactttttaatggctttcataacactaactcataaggttaccgatcaatgcatttcatacggatatagacctagggctctggagggtgggggattgttaaaacacatgcaaaaaaaaaaaaaaaagaaatttggtatatttaaccatttaaatcttttataaagtttggaatgtccatgtttgattgctgcagttggtgaacccatacataaataaatgaagtaagccatactggatttaattttatgggatgttatttcccctaagacctgaaaatgaacatagtatgctagttattttccagtggtaagcctttaactttcctcacacaattgggaatcatataatataaggtacttggtccctgattaaatattggtgacgggatagaatggcatcacgtggtttattatcgaaaagagtgggaaaagtatatagcttttagcaaagggtgttggcccattctaaaaaaatgagacgaatatatagaaatagtgggggcatttcttccggtagggggagtgtatgtgtggacatttctcccaatctcttcccactcttgttttctccccattattggaataacgtgactgtgaagatgattgaatccttatcataaatttaatgtttaaagaaaactgtagtgacaagtgagactcctccctaattcaagctaggagcaccggaagaagagtgccaaattaatgccttgaaagagaaagcgccagggatgggccatatggatcttttataacctctggggtaaagatgatctgtacatataacagttgttaacggtccggtgtgataatgaaaccctaggtttgagccaacccggtgctagaggcttattcctcctgcaggcaactccggtatacaggatagagagagactggcgaacattgcttttgttgcagacgatttcgaacaacaacaacgacggctttgtggtgttgttc

SEQ ID NO: 607224 - DNA, 664 bp, Homo sapiens
agcggtcgcccaggctggtgcagtggcatgatctcagcttactacaacctctgcttccggggttcgggagattctcatgcctcagcctcctgagtgtctgggattataggcgtgagccactacgcccagctaatttttatatttttagtagggacggggtttcacgacgttggccaggctggtctcgaacttctgaccttaggcggtccgccagcctcggcctcccaaagtgctgggattacagacgtaagccacagtgcccagcccacccctatatttgaaatcgtgtctagattgcatatcatagctagtcccatgtaaactactatgtcagttgtcgttactggctgggtgtagtggcggtgcaggcctgctaatcaggggtgctggcggtcgggaggactcgcttgagactcatgaagttctagaccagcctttgcaaacacatgcgaagacctctgtctctattttttaagcctcgttacatgccatgcacttcgcggaggccaaggtgggcaggactcgctttgagctcaggggttcagagacccagccttgggctatcatgggcgaaagccccatctctacagaataaacaatactaaaaatcggctgggtatcgtggcatgcagcctgtgttcccagcctatccggcgaggggcct

SEQ ID NO: 607225 - DNA, 124 bp, Homo sapiens
tggctaacttatgttgttgtttgtaagtgtcgaaacttgcaggttccttagtcttacttctccgagaggtccaaactccttatccttggtatgtccaatctcgacgtaacggtgagagtaagtt

SEQ ID NO: 607226 - DNA, 457 bp, Homo sapiens
tgccatgcccccatcctgggcctataaaaaccctgagaccctagcaaggctcctccatcagctgagagctgcttccactcaataacacttcgcactgattctccaagcccaggtgtgatccgattcttctggtacacccaggcaagaacccaggatacagacagccctctgtccttttgataactagagggtctcattgacctggttaacacaagctgcctacagacggcaaaactaaaagagcaccctggaacacacgcccactggggcttcagctgtaaacattcacccctagacacggctatggggttggagcctgcctgtctgtatgctcccctagaggtttgggcagcagggcactgaagaatcaagccacacccccatcgcacaccctgcgagggggacaagggaacctttctcttttcagttggtcttaataaacactgagtaaatgaaa

SEQ ID NO: 607227 - DNA, 114 bp, Homo sapiens
gccatcacgcttgcaggcatcagcttggcaggcatcaagcttggcaggcatcaagcttggcaggcatcaagcttggtcaggcatgcaaagcttggtcaggcatgcacgcttggt

SEQ ID NO: 607228 - DNA, 869 bp, Homo sapiens
  misc_feature (8)..(8): n is a, c, g, or t
  misc_feature (747)..(747): n is a, c, g, or t
  misc_feature (757)..(757): n is a, c, g, or t
  misc_feature (808)..(808): n is a, c, g, or t
  misc_feature (854)..(854): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctccnccttggaaangggttgacccgacgaagattaaacttcctcaagggaagcttattttgaaanaaggagattccggggaagcttgcaagtcccaaggattttccggganaaaattctgttgggt

SEQ ID NO: 607229 - DNA, 2088 bp, Homo sapiens
  misc_feature (8)..(8): n is a, c, g, or t
  misc_feature (2088)..(2088): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaaaaaaaaaacaaaaaaaaaaaaaaaaaaaaaaaagaggggggcgcgcgcgcgcccaagaaggttccccccgagggggcgcccagatacccgcgcggcccccgggttttggggaacaagggggggccccccaataggaggaggagccgcgccaattataatagcgacagcgggccggtgggcgccggcggcttatcacacaacggcgcaggcgaccgggggggaaaacagcgcggccaccgccgcggcgaaacccctcggggagagagggacaccctataaacccgcgaggcgggagggaacaaatatggtgggagaccaaaacattgcgctctccagaggggaatttataaacgcctctctatcgaggggagagacacattgtatcgcagtttgtttaaacgcgtctgtgtaaattacgggtgggggtcaaaacataagctgtgagagatatgttagctgagtgaggtgcgaaggaaaaaactgttgagaggtatacaataggggatatattagattatgtaagaaaaaaattattttatcaccccaggggacccgctttggaggagtaagn

SEQ ID NO: 607230 - DNA, 773 bp, Homo sapiens
  misc_feature (275)..(275): n is a, c, g, or t
  misc_feature (308)..(308): n is a, c, g, or t
  misc_feature (326)..(326): n is a, c, g, or t
ctccttcggagcctcgagagcctttttcgacggaaactggacactggaccggcagcgtgaggagactccagccccgctggctgctgcttatctcactcgtgttccctgccactgtctagatccgaggcggacccacaggctcgttagcagtgccacaagatcttacagaggacgaacaaacagtagaagattccataattgaggatgaagatgatgaagccgacgtagaagaagatgaacccacagatttggtagaagataaagaggaagaagangtgtctggtgaacctgaagcttcaccgagtgcngatacaactatactgttngtaaaaggagaagattttccagcaaataacattgtgaagttcctgcgaggctttaccaacaagggtacagaagattctattgatgaatccttagatgcctcattccgttatcctcatgactaccagttttatatccagaatttcacaagctcttcctctgaacactgtagagccaccccagagacaggcaacttttgagaactctgtcaatcctgcagaagccatgggcggaccaccatttgtttggacatcaactgaactacaaagatctgacgggaatgtatccaagatgcagccttcatcaaacagtaccagtattgaagataggatggctatatggataaacaatcttaagtataaggcccttgtggcctcgtgctctgggaaactgtggccttcataactcctaaaatatatacgcctacgacccttccaggtcggcgtcct

SEQ ID NO: 607231 - DNA, 1113 bp, Homo sapiens
  misc_feature (8)..(8): n is a, c, g, or t
  misc_feature (873)..(873): n is a, c, g, or t
  misc_feature (878)..(879): n is a, c, g, or t
  misc_feature (885)..(885): n is a, c, g, or t
  misc_feature (891)..(891): n is a, c, g, or t
  misc_feature (898)..(899): n is a, c, g, or t
  misc_feature (903)..(903): n is a, c, g, or t
  misc_feature (906)..(906): n is a, c, g, or t
  misc_feature (912)..(912): n is a, c, g, or t
  misc_feature (925)..(925): n is a, c, g, or t
  misc_feature (939)..(942): n is a, c, g, or t
  misc_feature (947)..(947): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccaggggtaagcagngggcnnagctcnggctangggggcnnaaanccnggccanataaggcgggccnagtggcggggggcnnnncctancggacaatctcaggcgggggggaaaactaacaccgtggggacggggtggacccgagccgccaaagaaagggggggcccagacacccccgggccacggaggggcgccggcggcgagagaccggaccccccggagagaagaaccgcccacaaagtctcacgcccaaaa

SEQ ID NO: 607232 - DNA, 1882 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaaaaaaaaaaaaaaaaccgggggctctaatgccgggggcgcgggaaaaacgaggagcgttagttgaagggcgccccagtggtccgtatgcgcttgtttcccgttgaaccccaggtctcttttgtgtgtaccacacggggcgataaactctgccgcgggctcccccaatatgtaggggcacgcccggatataaattcccggattagcccggtttacccgtgcttttaatactctccggcaaaacggcgacgacagaaacaacacagacacacactgtcaccaactcacaaccgtaacacc

SEQ ID NO: 607233 - DNA, 108 bp, Homo sapiens
accattgacactccgcttcataactctcacagtgctcttgtcggaggtgtcctgccctcctaccccagcgtgctgggagtgcgacgccagagctatctccctcctccc

SEQ ID NO: 607234 - DNA, 893 bp, Homo sapiens
  misc_feature (652)..(652): n is a, c, g, or t
gcccgaggacagggaagaggccaaaggcacaccaacaaggtgggtggagaggaaactggtactttaagcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggggncttccgacccagttggcggtggatcctaagcgtacgagatggcgaagaattggcccctcagaggggtgtgagaacctcatggaacaggtgagctgaggctcccgggaaggggccagaaacaacctcagacaattaaaagagaacgcgaggaggcccaacttcgcacttgggggctgaaaccccggcgaaaaataacagagaaagaaaacccgaggaagaaacaaaaagggaggagagaaga

SEQ ID NO: 607235 - DNA, 1866 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaacatatgatacataaaacagtttttcgagtcggacacctatgggaccctcctgggaagaacctgttgtaacaacaaaccagctttcggcattgggggcacacaggtgtgcccgccaatgttggagttaagttgcaacgttggtggagtcaatacagcagtttgtcccacaaatggggaagaactacgtcgggtaccaaagcacacaaaatggcgtcagggagttcctcccaggccatattctagtaaccattccgccgggagggacaacgccaggaagcatg

SEQ ID NO: 607236 - DNA, 567 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcatggtgctaccagcagaagaccggctcagaaccaacatgtactacacactggagaccgaatgaacaacattagaggccgtgagcgtc

SEQ ID NO: 607237 - DNA, 1069 bp, Homo sapiens
aattacggcttaggtacgaggctggtgtgcaagctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 607238 - DNA, 517 bp, Homo sapiens
tcaggctttgtcacaaccaaggtcccatttccaaggaccctccgttttaagcctatgttacagcaaggaatcgagctactcacatcagatccatcctgggtgagttctgcatcctggtacttcctcaatgtatttgggcttcggagcatttgctgtctgcttctgcgcaacggtcctgccggtggccgaccacgcatgatgcaggagcagatgacgggagcctcctatgccatgcccgcgagacagcggacgacgctttcaatacagaggagggaagctcaggagctggcggggcaccagtgggcactagatgctgccggcgaggatgctgcatgaccaacgcgctccacttcgaaggcgcgttcaagatggacggacggtcctgtacagtagggcgaccggccagggatggggtgtgtcaggaacttggccttgcaccaaacctggagactacggatcgcgctggcagcgccttggagtatagtggctgatgctcgagctggcaggcatgcaaaaa

SEQ ID NO: 607239 - DNA, 913 bp, Homo sapiens
gatatccagtattaaaactatttacatgtgtggtgctggccaatcttttgacatgctgtttcaataacatatactgacagtgaaaaagactagaataattctcctttcaagagtttcaaaatgttcatgtttacaatatttgtactgcatattgactatgtatacatgcattatagtcagcagatgtacaaaaatggtcacaggagtctttcttacttagctgaaatgtatctacatgtctatggctttatcttttaaactgcctgagagtcacaaattcttaaagtcaaatagaatagaaaacttgaaattatagtacttttggatcaagtatcatatttcaattgttgttacaagtgtgcagaattttgacttcttggattgaaggtcacattacttattgtcacatgaatagaatgtataaccgttaaatatctgtggtttgtacgacgaatggtaataacattagttcaaattttttactagaactgaaaagtataaaatcatgagtttacaatgattgaaaggtcaatgtatttaaacgatttttcatcgaataacataatacagtctatctctccaatctttatgatcatttttctagacccatgtggtgtgtagaactttacaattatctcaatttagctgaaatggagttaccccatttcctttgttgacctaaagatttgtgacctttctaccattagctgtctactccgactgatttctcctgatgacaatgtagttttgaggaatcttataaacaggaaaaaaaaaaaaaaagaaacaattgggggaccccgaaaattaaaacttggtgggggcccctgaaaagctccttcaaaacaggaaagtgtccacaaaaccggcgcgtgacaaagttgtttcaaatcaccccacgcagggaaaaaat

SEQ ID NO: 607240 - DNA, 819 bp, Homo sapiens
  misc_feature (8)..(8): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcgtgggaggctagttcaccgtcaaaaacagaacaaccaaaaccaacagaaccccctaaaccagaaaaaaaacccgcagggaggcgcaggagggcgcaggaaggcggggggcgccaggggaggaagggagggcgggtaagcagagggacgccgcgcgcgagagggcgcaggagcgcgagccgagggctaggggagagagagtcgggtaggggagaggaggggcgagaggaggggggggggagaggggtcggcgggggggggggagggtggggggcgggtggaggagggtgggccgaagccgaagagagaggggagagagagggcgggcggggggagggggggagggggtggggagagggggggcgggaggggagggggggcgacgcggacggcggggagggggggctgcggggcgcgggcgcgaggaagaggcggagggggggagagtccgccgcgaggagaggggcgcggagggggggggggggagcgcgcgaggggaagaccggaggcggggggggggcacgcgcaggagaaag

SEQ ID NO: 607241 - DNA, 1585 bp, Homo sapiens
  misc_feature (258)..(259): n is a, c, g, or t
  misc_feature (269)..(269): n is a, c, g, or t
  misc_feature (1585)..(1585): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctaggagcaaagcgtgtcagtaccacaaaagtagcggggggggggggggtgcggggggggggggn

SEQ ID NO: 607242 - DNA, 547 bp, Homo sapiens
  misc_feature (8)..(8): n is a, c, g, or t
  misc_feature (502)..(502): n is a, c, g, or t
  misc_feature (538)..(538): n is a, c, g, or t
gaacaatnagctaggtacgaggctgggtgttgaatcggccgaggcttctccgctccttctaggatctccgcctggttcggcccgcctgcctccactcctgcctctaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctcctttcatcaacatgtagcagcaagaacaagaatgcctgggggactaagttggaaggcttgcaaggcacagaagaattccttcngtggtaacatgtgacaaccattttttaacaaggttncaattaacc

SEQ ID NO: 607243 - DNA, 1323 bp, Homo sapiens
agtcagtcttatctccttatgtgttgccagacgaaccgcatcactacagatccacagtagggccgggtgcaggtcggatgtcaaggaattggcccctgtcggcttgcctggatcaccgacggcgtgcatagacacgtctgggtgaaccggtgagatattgctgagcccagtaaaagtgaacctcgctttcgattagaagcatcaaagtcacggtggatgcttacgatgttcgccaattgatggagttccagccgagtggctgagattgccatggcaccagtcggaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 607244 - DNA, 471 bp, Homo sapiens
atcttatatatattaggtaaattacaagaaaacattatcaaagcaatactacagaccagctacatcgcacaatttacaaatgagttagtaagtaccataagtttgtaagaatatcaggtgctatcagagtattacatcaaacagttacaaaagagattaggttcccaatcagttcacaaaagctaatttaaagaatgtagcttaactacagtactgaggttgtcacacacttaactttcggtctctagctaatatattcatatctgaggttcactgtaatctactaggatacattccgcccacacccacaccttggtccccacatcaagcagctcctcacagcaggaagacatccgctatcagacatggttttctgaagtagtgcttaggatttcagaggaggaaaaattcagaggttctaatagccttcggtaactgaggtagaatatggggctcccaagaatatcttcc

SEQ ID NO: 607245 - DNA, 170 bp, Homo sapiens
caacacaagtcctgaaccacttcttatgcccagtttcatacataacattgaaaggtcgctcatagacacttggcgctgggggatacattatgaaaatctaacctcccgctctacgcagttacactatctatccccattacatcctttgacagctgccgccgaagctggat

SEQ ID NO: 607246 - DNA, 445 bp, Homo sapiens
  misc_feature (98)..(99): n is a, c, g, or t
  misc_feature (185)..(185): n is a, c, g, or t
gccctccatgagttagcgtccccccgtttccagcggtgccgccctgggtcccatcttcagggaaaggcactgcccacgccaggctgcactttcgcaanncagacggtgcagcagacgggctgccggggcgtgctcccgactgcgggtccaagggcatgcttcccgctcaaccagggcaccagganctgaggtggctggttagctcccggacgggacggacagtagactggacgggggtttggggaccggccctgtaaggctgggtgggtgcctgcctggcttggggagccccagggatagcggtcggacttcaggttcttggccaagggcttgaggggaaccccctgtgcttggcaaagcctgggaacttcggggccaaactgaccccggggcgttggggggccggaagaacgcctttgtgccctggcattgttgccttccacaa

SEQ ID NO: 607247 - DNA, 1543 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctccccaccctgaccgtgctaactgtgtgtacatatatattctacatatatgtatattaaaactgc

SEQ ID NO: 607248 - DNA, 590 bp, Homo sapiens
tgtcatcatgaaataccttataactgaatttgttggtaaagaaagtaaatttgcaacttgcaaaataggatttttctttgtgctaaagaaggtactgtttcaattgaattgaagaataagcttttgtttagattttatataatgagacatcaaattatttttactatgtaatttctttttgtttttggttgttaaacttagcacatgaaaaatatggattgtggtttccaagggattattactgtgattaaactctgctaaatgtgtaccctagatagtatcttcttaaagttggctcttcaggctgggtgcaatggctcatgcttataataatagctctttgggaggccaaagtgggaggattgtttgggcccaggagttcaacaccagcctggacaacatagggagaccctgtctctacaaataatttttttttttaattagccaatgtgatggcatgcacctgtggtcccagctactcaggaggctgaggcagaaggatcacctgaacccgagagctcaaggctgcagtgagctgtgattgcactgttgcgctccagcctgggtaacagagcaagacctgtctcaaa

SEQ ID NO: 607249 - DNA, 1625 bp, Homo sapiens
  misc_feature (258)..(259): n is a, c, g, or t
  misc_feature (269)..(269): n is a, c, g, or t
  misc_feature (1527)..(1528): n is a, c, g, or t
  misc_feature (1530)..(1531): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccttgagagggagggctaggagcgcttnntnncatcataagtctggtcccaaaaaaaaaaaacggtttttggggaagggtaaggcggttttcccctttgaaggatcggcattgttataacaaaaaa

SEQ ID NO: 607250 - DNA, 1380 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaattggctacagcaccggggggccctgccctggctcgggtaaaccggcacaccagaaagggaaact

SEQ ID NO: 607251 - DNA, 432 bp, Homo sapiens
aaactggcagcaacatactcccactaggataagcggtgacaacatctataatggacagaactagactccagtctatacccacctaccaacccacctacactcactgctgtacagattgtctagctaaattcctatgtgacgacatcacagcctgactttaggcctttccagaattctcctggacctgcgggataatgtgaaaaccttatggcagaatttatgtgagcctttatgatctgtcctctaggtataatatagcctaatatttagtcaataggagataaagcagacattcagccaatctttggccatgccctgaatctggctgtctctggctgggttgtgccattacctctgcctcagccctctaaccgtacttggctcctgctgcattcctacccattccttatcttttgcaatcccaggtcagag

SEQ ID NO: 607252 - DNA, 1536 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 607253 - DNA, 1544 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccaaaaaaaaaaaa

SEQ ID NO: 607254 - DNA, 397 bp, Homo sapiens
  misc_feature (397)..(397): n is a, c, g, or t
ggctaaataccggcacgagaccgatagtcaacaagtaccaaaaaaaaaaaaaaaaaaaaaaaaaaaatttgggggcggcccggccgaaaaaattttaagagacacaatctcggtgggggcgcgcgcggggccccaaggaagggtaggttcgaacctgggggcataaacggtgtcacaataagggaaaatccggggccaacaggaaaaaggggcgcgggggttccttcacaaatataaaaaaccgccgggggggaaaacacagagccggtttggagacacaaactcccacgaggggagtcgcagggggagaacaaagacgggagtcttatatcaaaaggggaggaggccaaagaggagcaccaagaatattaaaattaagcgcccggcgcggagaagn

SEQ ID NO: 607255 - DNA, 212 bp, Homo sapiens
aagaaaaaggaaagaaagaaaaaggaaagaaaggaagaaagattttaaacatggtagtaagactaaggacctcaattttttaattttaatttttttcgagacagggtttcactcattttaaccttgacttatggctcgagccatcctccttcctcagcttcctgagtggctagaattataggtcctcgccactattccttgctaatgaaatt

SEQ ID NO: 607256 - DNA, 745 bp, Homo sapiens
  misc_feature (612)..(612): n is a, c, g, or t
  misc_feature (642)..(642): n is a, c, g, or t
aagtagttgtggccacgaagcagtcgatagcaccctgggtttcggcttcgcagcttttatccaatgccgggtggttggggtcggtgtcctgctggcccaacaggtaagtgatgtcgcgtgagacgtagtcttgttccagctgctgggcacctcggccccccacgtaatccggcaggttttgcatgccgtacttccagtcgttgaagcctgggcaattggcgatgtcgaacgtcaccgggcgttgcgggctgaagtacgcataggacgacgggttagccaccacataccgcaggcggatgccctcggaattcagcaatgggtggtcgtggccggtgagggcgaagcgctgcaccacttggccgccaccggaatgcccggcgaccacgatttctttcagtgccgggaacagtttgcggttgcccaagtgcttgatgatctggtccagagcgccataagagctgatctgccctgggcggtggacgctcgccggcatccagtcgttacccttccaacgcactacctcgtcgcccaggtggttgcgtttcacgtcggcttgattgagaaactgcggcgcgatcaccagtgtactgccgcccaccccggcatgctcgncggcgtcgatcccgctttgcaggtaggttngtgcattgcgcaggcggcatgcacgatgatcatgcgcgcgtgaccttgggcagcggctggccccagttttggctcaggcccaggctgagggcgtccgtagcgg

SEQ ID NO: 607257 - DNA, 333 bp, Homo sapiens
cttccttacccctagcaaccttccatttcctgtcagaatgctcacagcagcactgtccacaatagccaaaaagtggaaacaaccccaacgtccaccaatggatgaatcgacaaacaaaatgtgggatatccacacgatgggatattatccaaaaataaaatggaatgaagtacagatacacgccacaatataggtgaaccctgaaagcattagactaagtgaaaaaagctggacataaaaggccacatgttgtatgactccatttgacgaaatgcctagaatgggcaactccatggagacagaaagtacaggagaggaaggttgctaggggta

SEQ ID NO: 607258 - DNA, 303 bp, Homo sapiens
  misc_feature (111)..(111): n is a, c, g, or t
  misc_feature (159)..(159): n is a, c, g, or t
ctagtttagaagtttcaatagcagctagctacggttcaaagtaaaagtgtgggaggcagtccccgttaaaacaagaaagatgaggatgcctctagcagatgacagggtaantgggcaggacagaacatttatgtcgtgttcagagcgatggaacagcangaaaggcttggactattaagaaggcacacccagatgagccggcccagcgcagagtggcacaaagagcaccagctttctggcacaaggatgatggccaagtgggaaatataatgagagaatgctattgaaacttctaaaactagg

SEQ ID NO: 607259 - DNA, 307 bp, Homo sapiens
ccagtctccagtgtttatactctataggcgcactatatgtcctggttctattgctggacctacctgtatcgagacatgagattcaccattttccacagtggtaccatgacgaacagtctatgacgcactatgttaccctgcggattgctgctatctggactatgtgtgagtaggccttgacagacagattgtgctctagaaggaatgtgtgccatctgcactctgacactattacggaccttgatatgtctgcactaacaggtgatgttgtaccactggaggctatatgtggctatgctttagccgg

SEQ ID NO: 607260 - DNA, 528 bp, Homo sapiens
  misc_feature (129)..(129): n is a, c, g, or t
  misc_feature (142)..(142): n is a, c, g, or t
  misc_feature (172)..(173): n is a, c, g, or t
ccgtggtggacctgagccgcatactagaacgagatgcgtgaccagtatgaggtagtggaacgctgctaccgtggccacctccgccactgcggctgctgcttgcgcggctgctgctgaagtggaactgcnggcaccgtacttngtcggtagtctctggcaccaaaccctccannaaatctgctactcttagaacgtccacgactgctacccttgtagtggtgtacataagccatgttttctaaccaagacggcacttctatgtttagcttcaacaagaagatccaacaaatccttagtaatgtttatgtccctctcgtaaaagaatgaggttgccaggccatggtttccattgtatttaatagtctgtttatgctaaatcgggccgaagatgagctttgtccaccactaaaatgcctctgccactttgaatgctgtgctaatggggtggccagagtgcggtgatcaaaccgctccatctttgaacagtggcataggaagacggcaaacatttcctagggtgcaatagat

SEQ ID NO: 607261 - DNA, 497 bp, Homo sapiens
  misc_feature (1)..(1): n is a, c, g, or t
  misc_feature (98)..(98): n is a, c, g, or t
  misc_feature (111)..(111): n is a, c, g, or t
  misc_feature (141)..(142): n is a, c, g, or t
ncttctatatctacctgttgtagctccatagcactcacagtctcctgctacgtgcactcgcactgggtgtgttgccggtgtgctgaagtggaactgcnggcaccgtacttngtcggtagtctctggcaccaaaccctccannaaatctgctactcttagaacgtccacgactgctacccttgtagtggtgtacataagccatgttttctaaccaagacggcacttctatgtttagcttcaacaagaagatccaacaaatccttagtaatgtttatgtccctctcgtaaaagaatgaggttgccaggccatggtttccattgtatttaatagtctgtttatgctaaatcgggccgaagatgagctttgtccaccactaaaatgcctctgccactttgaatgctgtgctaatggggtggccagagtgcggtgatcaaaccgctccatctttgaacagtggcataggaagacggcaaacatttcctagggtgcaatagat

SEQ ID NO: 607262 - DNA, 468 bp, Homo sapiens
atctagcaggatgctagggagccttaacctagggggggcggacaagatccgacatcgtgtcccgggccttgattggttttctgataacgccccacctccttgagcggcttgagattatcaacgaggacatggccaagaggacgtgtgaggagcaccagctctgtgtggtggctgtgctgccccatatccttgatactggagctgcaggcagaaattctgatctggaagtccttctgaagtgggcagacaaatacaaaaagaaaatgtgggggtggctgtggaccagaagctggagcccagtctgaacttgagaccgcgctggggatggcagggttcgggtacccggccagggcccgccatcaatgcacgcaagatgaaatcggctctgctacaaggctccttcagcgagcaaggcatcaacgagtcgctcagggagctctctacgggccgtggctccacggcaccggt

SEQ ID NO: 607263 - DNA, 502 bp, Homo sapiens
  misc_feature (423)..(423): n is a, c, g, or t
  misc_feature (482)..(482): n is a, c, g, or t
ggcgcggatcagcattaaacgtggggtgtttgctgagggagatttgaagcaggcaagagggatctagctacttggctcctgttagcagataagcatcccctacattccgggaactattgcatgccatagcggctatactcatggactactatgattgaggtggctgctggcttcagtgaacactcactatagctgactcttccttcccacagttatgcaatgccaaccaaaaccatagaagtgttgcagttgcaggaccaaggcagcaaaatgctcctggactcagtgcttaccacccatgagcgagtggttcaggtaggcactccaggagaataaaaaatgtatttgcttctcctgagtcttttctctgtccactttttcactttctattatgctcttttcttttctttcttgaataatagngttctccaggttcagttcttgatgccccattgcctctccttccttgaactctttctttncaatctcaactcattcactg

SEQ ID NO: 607264 - DNA, 975 bp, Homo sapiens
gaaacagaaatggcgactgcctagagtggtgtacaacctgtgtcatggcaatgcctcttgtgccgtgtccagtcccacattgccttatcacgtcttttacatttgtctagttttttcgctcttccttcaggacctaatgttccagggtacacccttcatccataaacatgtggctcacaatggaatcagccgtgccatgcttcacccttctccgatcactccagttgtcctttaacattgatcgttgacttatgtagctccattgtcgccatagtcaagtagtctttatgacgatggtcttcccaattagaagtgcagggtcctctagaatgccagatccatgtgtttaagattaccttctgtaccagtacaggtgccattgcattgtacgttacctcatagtcaaatggttgctgcggacgttttttaactattaccttgacatattaaccattagttttccttttgtaccatttgttcttgctatgtattgctttggggtactgcccacggagatttgcgcttcctttgttgtgccccaggttgtgcgtttgtatttgtgcctgtgccctcgtgtttgcactggtaagccctgtgcactcgcgggggtaccaggcgtattttctggccttagtctcgccagtgtcgtctgggttcacgagtggtgcgctaccccatgctgtggccacggctgaatgttcgggactctttgagtgacaggccgccgtttcccccctttggttggcccggaagtggttctcgactatattgcctatgctcgcttggaacacgtcaccggtgtggtcccccagtccggttaccacggtgcgcgttggcgcctatggattccctcccaggttcgcccttgtgtggctcaagctctgtccatgttgccctctgcctgggccccatgggtggtacaggggggcgaccggccccatattttcctttcttacgagcactccgcaccgcggg

SEQ ID NO: 607265 - DNA, 758 bp, Homo sapiens
  misc_feature (80)..(80): n is a, c, g, or t
  misc_feature (94)..(94): n is a, c, g, or t
  misc_feature (117)..(117): n is a, c, g, or t
  misc_feature (138)..(138): n is a, c, g, or t
  misc_feature (142)..(142): n is a, c, g, or t
  misc_feature (394)..(394): n is a, c, g, or t
gggcgcatcatggcggctggccgggcccaggtcccttcctccgaacaagcctggcttgaggatgctcaggtcttcatccnaaagaccctgtgtncagctgtcaaggagcctaatgtncagttgactccattggtaatngatngtgtgaagactgtctggttgtcccagggaaggaaccaaggttctacactgcccctcagctatagcttcgtctcagtacaggacctcaagactcaccagcgtctcccatgctgcagccacctgtcgtggagcagtagtgcataccaggcctgggcccaagaggctggaccaaatgggaaccccctgccccgagagcagctgttacttttagggacactaacagacctatcggcagacttggaacaagagtgcnggaacggaagcctctatgtgagagataacactggcgtcctgagctgtgcagctcatagacctggaccttacttggtcgggccatcttactcctgttccccgcgttggcagttacctccctccatgccacggtggacatttcctcatgtggtacagtggccacttgcgaggcctgtggcgatgcccctgctgccaagtgcttcctttgaccattcagtcctggacccagttcacgcttatccctgatactctaccccagagagtgcttcctgcctgctcaggctcagacacaagctcagaggtgtgcagtgaaacatggctgcgagtctactacgatctgagtgctcttggtgaccagttaaacg

SEQ ID NO: 607266 - DNA, 708 bp, Homo sapiens
  misc_feature (706)..(706): n is a, c, g, or t
gcatggtggcacactgtagtcccagctactagggaggctgaggcaggaggattacttgagcccaggaattcaagcctgggcaacatagtgagtcctcatctcctaaatttaaaaaacaaacaacaaaaacttctacgtgtggtaaagggttaactcagcaagcttgggttgcttaaaccttgcacattccaaagaaaggtctgaccccagtgctgacctttgactggctactgggaaatgagctctgagcccctggataggaatgtttctgtttgcctgaggcctttgaccatgccagatagtttatgctaacaatgtgatttatagtgaatacctgttttcctgtgtctaagaccctgggctgcactgtattaatttgaccttgggtatttggggagctgagactgagtagctgaagtgagtcacataagcactaaatgcttacctgactgacccccagtaaaactctggacatccagacttggatgagcttccttgggtggcaacacttttacgtattgtcacacaccattgctggggggattaagcactgtctgtaaaactccactgtgaaatgacaactggaaacttgcacgtggtctctcctgattctgctctattcaccttttccctttgctgattttaatctctattcttttgttgtaataaaccataatggtgaataagggggggggggggggggggnga

SEQ ID NO: 607267 - DNA, 149 bp, Homo sapiens
atcattaagctcctaggccatacgccactgggtcaattcacagaggaggacaaggcttcttttacaagccttctgggcaaggtgtaattgtgaagatgtcttgaggagaaacccttggaatggctccttgttgtcttcccattgaccca

SEQ ID NO: 607268 - DNA, 139 bp, Homo sapiens
ggccacagggagcgagaccagatggagtcgacgctcaactatgaagatcactgcttcagcggggcacgcaccatactcgccgagaacctgtggcccgggcggctgttcttcgtccagcagattcttcagctctcttacc

SEQ ID NO: 607269 - DNA, 424 bp, Homo sapiens
tgaagtagaacccacactatgctgttctggagagggcctctggagaaggctctgaatgaggcgagggacccttcctacattgttcatcatccgcagataccccttgggtcattattcatactgacaaggaaccgagtcaatttggtgaataggaaaagccttctcatgaaaactacaatagaatactgttaccaaattcttcataagaaagatcatattatgggaatgataatcctgtttactgtggattaggtatagtgccaacagtttgaatggtaagacaacataatatatatgatagtgatgaatccttctgtgagttgtttgttccagaacacactgtctagtagaattgtgggtattttcttcttttgaatcgaacacagttgtgcatatccaattccccattgagtatttctatcaa

SEQ ID NO: 607270 - DNA, 124 bp, Homo sapiens
  misc_feature (17)..(17): n is a, c, g, or t
  misc_feature (49)..(49): n is a, c, g, or t
  misc_feature (100)..(100): n is a, c, g, or t
gcgccgagggtggggcngggcgtagtggccgggcagtcgcgggtgcccnaggccgtgagtgtgcgcttttgagagtcgcggcggaaggagcccggccgcnccgccggactgagctataagaccg

SEQ ID NO: 607271 - DNA, 688 bp, Homo sapiens
cgaggtttcttttgtttttctttaaaaaggaaaacccggtaatagatgtcggggttgagggataggaggaaaatgggggataggtgtatgaacatgagggtgtttcctcgtgtgaatgagggtttaatgtggtaaatgtggggggtgagttgagccccattgtgtggtggtaaatatgtacggagggagtatagggctgtgactagtatgtggagctccgtgtaagtcggagagtgatattggactcaggagaacgtggttcactagcacagagagtcctcccagtaggttcaatagtgggggggtaaggcgaggttagcgaggcttgcttaaaagtcatcaacaaagctattacgggggcagtacgatgttttgaagtccttgacgagcaggattatgatcgcgactgtgagtgcgtccgtagttggagttggctaggcggaatacgtaagtgaggatgtaaccccctgtgggcgattatgagaatgactgccccggtgaacgctatcagggggttgcggcatgaaaatgggctgttactaacgaagggctatgtggcctgattgaccagtctgccatgagcgatataagcctgttagcccaagcacatgggcctgttataattatgcccctaggattccccaggcaagggaacgccaaggcttcggcccggtctcaatacttgacc

SEQ ID NO: 607272 - DNA, 253 bp, Homo sapiens
  misc_feature (44)..(44): n is a, c, g, or t
atcagaggatccccgtggtgtaccgtctcttctatttacataanctacttattattttacttattttagtgggacgcagggtataatcttaacaggagcagaaagaatcagagaggtcttcattctactggaccattgctccatgacactctgcttcccctcagagagtaagaaacacattcaaaatgagagattagattctaagtatgtagtaggtgtctactccaatatcacttttacggtaacaccacag

SEQ ID NO: 607273 - DNA, 108 bp, Homo sapiens
tattactatatgaagactctcagtcgcgcagactgtacagactcaagaggagcatcgtgatcgactacactgcccttccttatcactctgctgtttacagacctgggc

SEQ ID NO: 607274 - DNA, 143 bp, Homo sapiens
cgagcacacacccagtttctaagggatgctaagtgccctcctgactcagtcccctcctgatggccatacctctcaagtactgttgcattggggatcacatttcaacaagaattctggaagggacaaaagcattcaaaccgtag

SEQ ID NO: 607275 - DNA, 90 bp, Homo sapiens
tcgatacgacttttttttccccttgacaattagtgtattttaggaccaagaggatgaaagtttttactctctcccttctgtcgtcttctc

SEQ ID NO: 607276 - DNA, 138 bp, Homo sapiens
  misc_feature (86)..(86): n is a, c, g, or t
cctggacaacttggacgactggtccttacggactcctaccaacacgactaggtcctactgtctactactgctgttacactggaacnggggactcctcatagacgtcgacccgtgcaggcactgcacacgcttggcacc

SEQ ID NO: 607277 - DNA, 251 bp, Homo sapiens
caggtcaggggggactgtctggtcctcctgctcatgacgtctctcagttgtatgcagaagtcagctgagtctcattaccagcacccagtttcacatgtgtagttgagcctacaattcatcctcacacccacacaccctgagcactctgatttgttgcttcatggtagacaatgaggcatctatacatctgcgtagaaacctcgatatcgaggcgcccccaacctacactaaccttaaccgccttataagcc

SEQ ID NO: 607278 - DNA, 146 bp, Homo sapiens
cccaaacccacttccaccttactaccagacaaccttagccaaaccatttaccccatataaagtataggcgatagaaatttaaacctggcgcaatagatattgtaccgcaagggaaagatgaaaattatacccagcatatatagcag

SEQ ID NO: 607279 - DNA, 954 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggttatccatgataactttggtattgtggtaggacttatgaccacagttcattttattactttcacccagtagattgtggatggtgccttcggtttattgttgg

SEQ ID NO: 607280 - DNA, 897 bp, Homo sapiens
  misc_feature (258)..(259): n is a, c, g, or t
  misc_feature (269)..(269): n is a, c, g, or t
tcgccccacttgattttggaaggatctcgcttcctgggagatggtgatggaatctcccatgaatgaacaagcctcccggtctcaagccctgacggtgccatggaattgcccatgggtggaatcatattggaacatgtaaacccatgtaagttgaggtcaatgaaggggtcattgatggcaacaatatccactttaccagagttaaaagcagccctggtgaccaggcgcccaatacgaccaaatccgttgactccgacnntcaccttccncatggtgtctgagcgatgtggctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgccttcttcaccaccaactacttatcaccgctaaccaatgtcatccatgacaacttttatatcctttgacccttcaagtaaactg

SEQ ID NO: 607281 - DNA, 557 bp, Homo sapiens
  misc_feature (1)..(1): n is a, c, g, or t
  misc_feature (43)..(43): n is a, c, g, or t
  misc_feature (118)..(118): n is a, c, g, or t
  misc_feature (154)..(154): n is a, c, g, or t
  misc_feature (217)..(217): n is a, c, g, or t
ntccaaaaatatatattgagcacctgctggggtataggctctntgcctgcccagttgaagataccatgattacaatgttgtgcttgcttggtttcacagtcctgtgggtacatggtgnagtaaaataggtccaattaattttctcagagctgtncacagcaaccacacagaaggagagataactcacccagcttcagaggggtgggacagagaatgnggttagcctcccagatgtccttgtgctagttttagctgttttcaggtgttgataaaagctccaggagctggcaggaggagagcagaggaagctagagcttacaaagcacaaaggccatgacagcatgccagacgggtgaaagaggacaggggaaatgtaggcaagtgtctcttctcagaggatgttatatactatgtttaaaagtgttgatctgctgggcacagtggttcacgcatgtagtgtcagcactttggggtgccaaggtgggaggattgcttgagctcaggagtttgagaccagcctgggcaacatagtgagaccccatctcttaaaaaaaaaa

SEQ ID NO: 607282 - DNA, 935 bp, Homo sapiens
agcggtggtctccatctcagaacttcctgccgtcgcgttggcacctcgctgctccagcctctggggcgcattccaaccttccagcctgggacctgtcggcagaagataacaatacttacttattcttcttgccccagtacataccttgaggcgagcaaacacaacattaaatttcaaccatgagggaaatcgtgcacatccaggctggtcagtgtggcaaccagactcggtgccaaccgttctgggaggtgagtccgtcgatgaacactggcatcgaccccaccggcacctaccacggggacagtgacctgcagtctggaccgcactctctgctgtactacaagtgaagccgacagggtgggcacagtatgtccctcgctgccgatcctggtggcatctagaagcctggagcaccatggtaactctgtatcgtctacacgctcctctaagcgccagatgctaatagaacccagacatacttccgtattatggctcagtctggggcagcgtaactgactgggcccaaagcgcccactaacacaggagggcgccgagcatcggtcgactctctagctcctcggcatgctggctacccgcaacggaggcaacgagacctagtgacatgcctgccagggctaccaactgacccactcactgggcggggcgcacaaggcctcctggcaatgggcactctccttatcagccaagatcccgacaagcaataccctgatcgcatcactgaataccttcagtgtgcgtgccttcacccaaaagtctctgaacaccgtggtcgagcccctacaagccacccataaccgacccaacaaaggcacaaaataccggctgacgaacaaacggccatgaacacaaggccctccagaacatccggccccccgcccctcgagccgaccacaccaacacacgggaacccacca

SEQ ID NO: 607283 - DNA, 158 bp, Homo sapiens
gcgacaatttctacaccgtgggaggcttgttgacgatgcttgctggaggatagaagaagttcccaaagtttgcggcctgccagtgagctgtggacgaccagctgtgaggggtccacagcaaaagtatttctttaatctaagttccacgacattgtgat

SEQ ID NO: 607284 - DNA, 223 bp, Homo sapiens
aacgggtgatgcggttgattggaggctaaaagttcaagggcgataccgccgccagtcaacgccgtggcggacacagggctcttctcaagggaccgcgaccacatggtgaatcgtcccttgccagcgttttacaacgtcttaacttgtatacatcatcaactgtggcatagacagcgtgacgttgtacgattacaccatcatgtatgacactctgtgcaacgtc

SEQ ID NO: 607285 - DNA, 703 bp, Homo sapiens
  misc_feature (9)..(9): n is a, c, g, or t
  misc_feature (75)..(75): n is a, c, g, or t
  misc_feature (117)..(117): n is a, c, g, or t
  misc_feature (145)..(145): n is a, c, g, or t
  misc_feature (148)..(148): n is a, c, g, or t
  misc_feature (152)..(152): n is a, c, g, or t
  misc_feature (155)..(155): n is a, c, g, or t
  misc_feature (159)..(161): n is a, c, g, or t
  misc_feature (168)..(168): n is a, c, g, or t
  misc_feature (183)..(183): n is a, c, g, or t
  misc_feature (185)..(185): n is a, c, g, or t
  misc_feature (187)..(187): n is a, c, g, or t
  misc_feature (217)..(217): n is a, c, g, or t
  misc_feature (219)..(219): n is a, c, g, or t
  misc_feature (222)..(222): n is a, c, g, or t
  misc_feature (230)..(231): n is a, c, g, or t
  misc_feature (235)..(235): n is a, c, g, or t
  misc_feature (240)..(240): n is a, c, g, or t
  misc_feature (244)..(245): n is a, c, g, or t
  misc_feature (252)..(252): n is a, c, g, or t
  misc_feature (257)..(257): n is a, c, g, or t
  misc_feature (271)..(271): n is a, c, g, or t
  misc_feature (274)..(274): n is a, c, g, or t
  misc_feature (285)..(285): n is a, c, g, or t
  misc_feature (295)..(295): n is a, c, g, or t
  misc_feature (317)..(317): n is a, c, g, or t
  misc_feature (324)..(324): n is a, c, g, or t
  misc_feature (329)..(329): n is a, c, g, or t
  misc_feature (351)..(351): n is a, c, g, or t
  misc_feature (369)..(369): n is a, c, g, or t
  misc_feature (384)..(384): n is a, c, g, or t
  misc_feature (389)..(389): n is a, c, g, or t
  misc_feature (393)..(393): n is a, c, g, or t
  misc_feature (402)..(402): n is a, c, g, or t
  misc_feature (475)..(475): n is a, c, g, or t
  misc_feature (554)..(554): n is a, c, g, or t
  misc_feature (604)..(604): n is a, c, g, or t
  misc_feature (622)..(622): n is a, c, g, or t
  misc_feature (641)..(641): n is a, c, g, or t
  misc_feature (688)..(688): n is a, c, g, or t
acatctganggctttcccacattgattacattcatagggtttcactccagtgtaagtcctttcatgatatcaaanggaactagaatacactcatagggtttctctcccgtgtgactnctttcatgacattgaaaagaagtaaaangcntganggntttnnnacactgnttacattgatagggntngngggcagtgtgagtgctttcatgatatggananggngtgggganngtgngggtnttgnnacattgnttgtnttcatagtgtttcnttncagtgtgagtntattcatgtncataaaagggacaagggtaggngaatggnttggnaaaatttttatatttatatggntttttttccatatgagtnattgcgtgtatatgnaaggnaganaaataattnagtggttttgcggcattccttatattcatagtgtttttttccaatgtgtgttcttgcatgtatttgaagaatnttggcagatgtgaatccattcccacaatgcttacattcatagggcttctctcctctgtgcttcctttcatgtatttganaagaagagaatttacagaatgctttttcgcattccttacattcatagggnttctctccagtgtgagtnctttcatgcatctgaaggnttgaggcagatctgaaggctttcccacattgcttacactcatagggnttctctccagtgtga

SEQ ID NO: 607286 - DNA, 94 bp, Homo sapiens
aggggagacccctgcagctgtttgcttttttaggcaaaaagcaagcctgacctggccctggcccccccattatgtttgcagaggggtgaaaagg

SEQ ID NO: 607287 - DNA, 163 bp, Homo sapiens
  misc_feature (124)..(124): n is a, c, g, or t
ctgtgctggtactctagagatcccgtcgacatgcaagtcagttccatctagtaatggtgactgagtatatcacagttgcacttttggcagcgtgtgtcacttttatattcactgtctcatacanctacagtgtactatgatgcactctatttatagtcaaaca

SEQ ID NO: 607288 - DNA, 261 bp, Homo sapiens
caccaaggaaacatttagaacctgcgaccgacatcgatcgcaggctcgaattaccatccctcgagattcaggccaaacagtgaagcaaagcactccaacatctcctcctccgtcatatgctcacctttagtaacgagcagtctcaggaagtcctctcttcgaatggactttttccctttggagtaggtataaccgagcacctcaaagctcttgtggataccactcatggtgttaccacaaggtgactcgtggaaatgtcca

SEQ ID NO: 607289 - DNA, 302 bp, Homo sapiens
  misc_feature (273)..(273): n is a, c, g, or t
cagccgaccgacgcttctcttgggcgaggcgggcgggttcttagtgcagattgagaccagcctagccaacgtggtgaaaccccgtctatactaaagattacaaaaattagctggaagtgctggtgcggccttgtggtcatagctactcgggggggagagagaggggaggatcgcttcaacccaggaggcagaagttgcagtgagccaagatcatgccacacactcctgtgctgggcaacagagtgagaccctttcctgctgctgcccccccancccctcccagccccccacagagagagcgt

SEQ ID NO: 607290 - DNA, 233 bp, Homo sapiens
ggggggcccccccccccttttttttttctccttttgggacccggggggcgtccccccccccgggttttttttttggggggggggggggttcccttttttccccggggccccctttttccctttggcctttttttggggcccttttgccccggtttttttccaaaaccgggggggggggggggggggttttccggggtttttttccccccccggcccccccccggggccccgga

SEQ ID NO: 607291 - DNA, 164 bp, Homo sapiens
tctatgtttagttctgaggaatccccatactgttttccacagtggttgcaccaatttacaatcccaccaacagtgtaatagggttcctttttctccacacactctctagcacttattgtttgtagacttttggatgatggccatcggagcagttccacttaggc

SEQ ID NO: 607292 - DNA, 504 bp, Homo sapiens
catagacgggaagctgataaatgagaggcgattgatgacagcgatggcgctgtatacgaaggtgaacggagaaagtgacaagaacgtctccaggacgccaggcattgtgttaaagaccttagaccccatcctcatcaccatcatagccatgagtgcactgagggtcctcctgggggctgtctgtggggtcgtgctgtactgtgcctgttgagcataatgggatgtcagaaagaaacttgtctagacctggagaactataactttgaacttgtggatagtgtgaagttgaaaaaagacaaactgaatacacagagtacttattcggaggcatgaaggcagacagagattaaaagacagtcaaaggacggaagtggcaggacgggagtgagctggggagctgttgatctttcactatacaggctgggacgtgtgtagataaccactgagccaggcttttctcaggagcttcaatgagtatggccgacagacatggacgaggagctg

SEQ ID NO: 607293 - DNA, 187 bp, Homo sapiens
gacagaaggtggctccgtggctcagactgtcgtgagtatgaagaacacttatgacggtggtgaatcccctgtttgagaaaaggcctaagaattttggcattggacaggacatccagcccaaaagagacctcacccgctttgtgaaatggccccgctatatcagtgttgcagcggcgttggatgcagt

SEQ ID NO: 607294 - DNA, 153 bp, Homo sapiens
tggagtccaatagaatccccaatggaatcccctatgtatcccatattgctgaagcagaataagacaatgattatccaaaacatatcctcccttttccttaagcacaatgtctgaccaaattgcttgtttctttttcttggactactttaattt

SEQ ID NO: 607295 - DNA, 126 bp, Homo sapiens
ccgacgtgacgaacattgtttgttggtgtatcatattgtaattgagcattgctcgagggaataggtatcatgtgattaggagtaaggttaggatgagtgggaagaagaaagagaggcagtaaagtt

SEQ ID NO: 607296 - DNA, 869 bp, Homo sapiens
tcacgggccccccgggcgatttttggccactaccgcgagatttcttgatgtggcctttttcctctgggccacccgccagattttctctggatctcggagattcaaccctcctagcttttggggattaccctcggggggtgggcccgaatatccaccggtgccccggagttgagacgccccctcgccgtagtggggttttcttcgtgtcccgcgttcttctgcctcccacacagccagcctctacccctaatctcgatctggtcttccctgtggcctgggaccacacctggtccaaggtattgggcaccctggcgctatactgccaactgtgatggccccaccccccatttggcccaccccccaggcgtattcttgtgaccccggtgagcctgttcttcttcccacgagttgggagtctccctctctgttgcgttctctggaggccaaggatggcccccggcccctgcttaatgggagttctccagacgaaaggccaacaccccttacaccgctatgagtggtggggacactcaactccacgccccttcgtgcttcacgcccttatccgcctatactggctgtgtcgctgccaccccggccccacgcactccacgactctgggagtttaattgaagggagaagaatcacttgtagatgaacctgtgagcccacgaaagttatatcccgtaccccacccacaggccggaccccccccgtgccccttcctggcctggtttgctgatggcccgactctgtttgctggctacccggaccacctggtgcgagtgtggccggggacccttggcacccgctagaaatttatggccgagcctttacccaaatataaaaaaaaacctggccttttttta

SEQ ID NO: 607297 - DNA, 328 bp, Homo sapiens
tcattatatatatacagtgtggatataactaaaattaacatatgcgttatctatcttatgtagtcatggtattgtggtgaaaacattttacatctactttcttagcatttttcacgaatgtcatatattaagtatagtccccacatgttgtacaataatctctagcaattctacagttagtcagttacccagttgaaagcagcaataaatgtacttagagctcagaggtgcctacgtgtgaatccaaaaatagcagcacgtagcatggaaaaacaaattgtatacagtattctgtggtgccttcaggacagagttacccaatttcccc

SEQ ID NO: 607298 - DNA, 312 bp, Homo sapiens
cacgagggttgctgctgcctgttctggaggcatactgggtggggccagccgagactggaggtggtggatgcccgggccggtcatgacccgcttcttgcagctgtgaattcctttggacaattgatgatatttaccaatgtgcccattttctacaaataaaagatgggtggattattttctcgatggaggacaaaaccttcatctgtaaaagatcgagaaagtggacatgaggaaattcaaggagtgcaataatttagggaaaaatatcacagattagaaaaagtatgggttggaagattaattctgtacacc

SEQ ID NO: 607299 - DNA, 277 bp, Homo sapiens
tccggggctgctggcacctgctgcttgattggtctgatggaggcgaggaaccttccaccctctgtcagcccagggatccggaccatcctcgcaggtgaggaggctgtgctggtgacagggcccagatcacggacagcacggttgtattttatgctttctacacacagcaagctgtcatcctctccaaaaagcacctttgcgatgtgggagacgacagtgctggctaatcggattcctgcagcccgggtgatcccctagttctagagcggccgcaccg

SEQ ID NO: 607300 - DNA, 666 bp, Homo sapiens
  misc_feature (48)..(48): n is a, c, g, or t
  misc_feature (581)..(581): n is a, c, g, or t
  misc_feature (650)..(650): n is a, c, g, or t
ttttcttttccagggatttatttaatggggatgtgttcaaggcaagancgaattcagaaggatatcgacgtcgtgatccagaagtccagagctgaggactgcctgtttgcagctaaacaagcactggccttgagataagcaatgctgaagcacttgcagctcacctattaccataaactgactgagccctccctacacaagccgtaactactgctttgattggacaagagactgatttcagtagttttctcttgataagagaccactggccgtgggcgggttctggacagtttacagaagctatgcacttgattgcctttgtgtccctgcttcaccttatgaagcatagggcctaattataatgtatttaaatgttgtctccaccccaaagtgaacatgggttgcatgtaacaggcatgtttactcagcatgcatgcagcaggatcccttcacaaatattcagagctccccctattccctgttgaatatgtatatgtggccagccagatcaacgtaaatcactattcggcctccccttcctgtaaacctactattcgggtttcagcaggaagctatgcctnccagtctgtcagaatggccacttgcaggctgtaaccctttataaaaaataaaatctcctttctaaattntcaatttcctggccgc

SEQ ID NO: 607301 - DNA, 318 bp, Homo sapiens
  misc_feature (48)..(48): n is a, c, g, or t
ttttcttttccagggatttatttaatggggatgtgttcaaggcaagancgaattcagaaggatatcgacgtcgtgatccagaagtccagagctgaggactgcctgtttgcaggtgagttcttgcttttccagaacctcggacccagcgcccccttcccagttttctgaccgcgacgtctgtggctgggggtggggtggagggttgcacgtccccattctggggttcatttggcaacagctgctgcaacgagcgcgggagccaaaagggggagggggctccagcctctccccttcccctccccaccgccaagtctgagg

SEQ ID NO: 607302 - DNA, 144 bp, Homo sapiens
tcactctagaggatctgtgaatattcagagagtcaacctttcttgcggaacgccgagatgccagccaagagaaaccacattgtatcgcggtcataggtgccgttggaaaaggttggttgtacgacccgctttacggtccaaacc

SEQ ID NO: 607303 - DNA, 446 bp, Homo sapiens
  misc_feature (54)..(54): n is a, c, g, or t
  misc_feature (56)..(56): n is a, c, g, or t
  misc_feature (246)..(246): n is a, c, g, or t
  misc_feature (371)..(371): n is a, c, g, or t
  misc_feature (381)..(381): n is a, c, g, or t
cttgatcctgccatggcctggccttgccatgtccctgtcctggccctggttctncnctgcttctggccctggccttggtcctctcatgtccctggctgtgaccctgcccctggtttttctctggccatgaccctgccccagttctgtcctatccctggccctgtctcagttctgtcctagccctggcctttcacagtactttatgcttagtaagggctccatggtgtctgtgagttgaatgttgtnttcatagtatctgccaaaacagaaagaaaaaaacaaaatattttgataagaagttaaagctttgtatataatatgccttgaattgtaagtgcctgttattagttgtattacatataggtcatggntttgtacacntaactccaaaccattgatactgttaaaagaatatatgaatatatgaaagaatgtataaacgtaaa

SEQ ID NO: 607304 - DNA, 675 bp, Homo sapiens
agtctccaagggccggttcttcagcaccagagcccgaagagcccgcagcaagcgtctcctggtagctgctccaccgtaagcggaattctccatgcccgagcggtctgtggggaaagatcgacagcagtgtaggcggactccccgagctcctctgaggaggaaccggaggtctgcgaggacctggcaggcaatgcagcctctccctgaagccccccagaaggccgatggggaaggagaaggagatgccataccttctcccaggcctctgcccacaagagcatggaggtgccgtgaaagtctgggagccgtgggctcagcacgggctggtcaacctcccatcccgtatagaccaccttcccttcctgcaagcaggccaaacatggccagactcccttgctctttagctgtagttagttgccctcatgcctgggatgcccttcccgcactttgctgctgccgtggcgaacaatcatgttacttgtccttcagaggcccacaactcaagtgtcagccatccttccccagctcccccaggcagaaatagttgtctgtgcttccttggttcatgcttctagctgtgacacttatctcactgttattataatgagtcgggcatgagtctgtttccgcaagctagactgtgtctgaatcatagccgatggccagtgcccacgt

SEQ ID NO: 607305 - DNA, 301 bp, Homo sapiens
gagaaccagcgaaggggttaaaacaggcaatccctgtacccccaaagaataaacgccttcccaaaatggcaacccaaagccccatttcagacctgctaagacttttaagtgaggaatgccagtgaggtttctctcaataagtcccagttctcttaattttcaggaagaaagggaaattccagctcctcagcccccaggattgccctctgggaagtaatggaaccgttggtcacagcccgtgggttcaggtgtgccaaaagcttccaaatgcgtccaaagggaaataaagtgtgttggcgtt

SEQ ID NO: 607306 - DNA, 118 bp, Homo sapiens
tacgggcaatgctaccggcgacatcgatggcgggtgcagtggatcgtggacgcctacaccacgtcaacagctacccgtactcctccccgcaggagctgcagtgaagccacctgctgga

SEQ ID NO: 607307 - DNA, 173 bp, Homo sapiens
atttttggtaacatacatcaagtggcactaattacacagtaactataaggtaactaacatgaaaccacagaactgtaactctgccacagctgcatgaactcgggttgtcctgaccgagcccatccccaaaaaaccgcccaccccagagctacgccaacaaaaaccgttattaa

SEQ ID NO: 607308 - DNA, 217 bp, Homo sapiens
  misc_feature (92)..(92): n is a, c, g, or t
  misc_feature (217)..(217): n is a, c, g, or t
gccatgagtgggcccagaaaaagtaccacaagttctcactgtggtctgtggactccacctgaaactgacagcccagcccccatgcttcaggntgtcactggcttgaaggtggggcttcaccacgaatgtccccctttccacccaggagcctgtcttccttcctgttgccatcaataatgtccattgcacccaggcgtgtttgtgtccaaaggggccn

SEQ ID NO: 607309 - DNA, 114 bp, Homo sapiens
gcgggcgtgctatcttaggggcgtcgatagccgccggacagagctgagagcaggtgcagcagctaggagcaacggcggggtcagcatggtgtgggctgatgcaagcagcagccc

SEQ ID NO: 607310 - DNA, 717 bp, Homo sapiens
  misc_feature (60)..(60): n is a, c, g, or t
ctgtctatatgttatttaaaagaggtgtcaggtttttaagtacagttttgggaccccccnagccctccacctcttactccaaattcggccccgccggccccgcgcccaagtagcctggtccctagacgcccaagcccagggtctgtcacccacagcatggaaagcgttcaggtccactcagcctgtgctgcgatctgaaggaatgataacatacgaggagaaggccctttggtcctaccctgtgaatgagtaaggggcagctgcaaaatgctaagaatgctgagtgcattaagtgaagtgtttctcccaggtgtgcacagggtgtggcttccaaggggaatgtggatgctggaatgagggaggcagccacctaggccggtcaagtcagaggcccagcaaggagaaagcgagccaaggcaaacgccgacagaagagaccgataaatccgcggcgcactcggcagaacgtccaccgcaccgcataatttagcggggcaatgccgccgggagtccacgccaagttaatggaatatttcctgtaaatactcttttcccttcctgtctcatcatctcatttcattcaaaaatctttactaatccgggggagtgaaagtaatgcatcaatttccagagccaatgcccctgcttccgaaatacccttaggaatcactggaagccaccgcggctgcttagggacaggcgcccagcccgtttactc

SEQ ID NO: 607311 - DNA, 462 bp, Homo sapiens
  misc_feature (3)..(3): n is a, c, g, or t
  misc_feature (18)..(18): n is a, c, g, or t
  misc_feature (54)..(54): n is a, c, g, or t
  misc_feature (60)..(60): n is a, c, g, or t
  misc_feature (89)..(89): n is a, c, g, or t
  misc_feature (118)..(118): n is a, c, g, or t
  misc_feature (137)..(137): n is a, c, g, or t
cgnggtggggcaccgtgncccttcctagggcggaaatccacaagtacattgtangggaanagatcaaaacaatgtaaaagcctttccancgggttttttggttttggtttttggtttnttttggagacagggtcctnactcctatcacccccaggcgggagtgcagtggtgtgatcatggctcactgcagccttggcctccgaggctcaagtgatcctccccacctcagcttcctgagtagttgggaccatggatacatgccactgagcctggctaatttttttttttttctggtagagacagggtcctgctatgttgcccaagctggtctcgaactcctaggcacaagtgatccgtctgccttggcctcccgaagtactgggattacaactgtaagccactgtgcccagcctcatctgttgttgttgttgttgttgttatttttgagacagagcgagaatt

SEQ ID NO: 607312 - DNA, 282 bp, Homo sapiens
tctagcttcttcctgttagttacatgaagcctcccacactaatactgagaaacctggctctcaacctctgtcatctatttacttaatttttcaaattcagtgtgcacatatagcagtatctgaattgttaacctgtatacccatggggaacaactttatcaactacagcacagtgtgtatgtacataaaaatagtaatatttttagaactccaacagctctttgaaacaaagtggtctgcaaaattctggaattagggatttctgtgatctgagtttccaag

SEQ ID NO: 607313 - DNA, 138 bp, Homo sapiens
tccccatttcatctgcatctctctctctctctactttctttccatctcgcttcctcttctaccattcaccatccctccacgcattcgatcatttcttctcctctctgcaaacctctcctgtgctgctgcctgggcacc

SEQ ID NO: 607314 - DNA, 194 bp, Homo sapiens
ccccccttttggagggaaagggccccttgggccccccccccttgcccccaaagttcaaagacaatttttgacgcccccttttggggttacaacaaacaaattttttgcaattagggtggaaggaaacaatggggggcaaccccccttaaaaccgggttcccttaattacggaaaaataaccctttaaaaaccca

SEQ ID NO: 607315 - DNA, 620 bp, Homo sapiens
ccgcgttgcccgcgtttttccaccacatgtgcggggtcaaaaaacaaaaagccattttactatgggcaaaaggatataagggattgtcccatatgttggaattgcaccgcaaagtatgtaggcaggagcctcgtatgagttggaaccacaatgctctattagttttttagagcgcttataataatagggcagtgtgttaacatcaagagctgaaaagaatgctgccttgtcccctccagggagtgctccaacccccttgccccggacactcttggggcacacacccccgtaagccgcccacccttgggggacccacaacgtcggcggagacccacctagcaagcccacgattccgaagcccccccgcgcctcacaacactgcgtacagaccccgtgtcggttgtacgctgagaccccacaagcgaatctggcggaatgtctccagagggaaccggcagaaaccacaaagtacgacgacagggggcgttgccgcccagcggaatagatcccagtcgcagaatctgcgggaacaccacagagcgtgcacgttgagtcgaaccgatggccaccccccggccctgcttcactacggggcgagcccacccccgtcccacaaaaca

SEQ ID NO: 607316 - DNA, 500 bp, Homo sapiens
tgggacatacgtttaacgggtatagacttacagttctgcaagacgaagggttctggagcttgcttgccacaacaatgtgaatgctacgaatgcacagttaaaaatggtaaaggtggctcatgcctgtaatcccagcactttgggaagctgaggcgggtggatcacctgaggtcaggagttcgagaccagcctggccaacatggtgaaaccccgtctctactaaaatacaaaagattagctgggcgtggtggtgcatgtctgtagtcccagctgctggtgaggctgaggcaggagaatcgcttgaacccgggaggcggcggttgcagtgagccaacatcgcgccactgcacttcagcctggcaacagagcgagactccatctcaacaaacaacaacaacaaacaaacaaacgaaaacccccacaaacatggcaaagaaagaatgagatttaatgagaaagcaaaagctacaaattgttgatagtaagccaaagtctgtagg

SEQ ID NO: 607317 - DNA, 434 bp, Homo sapiens
ggtgagtgcagcattcatgaagaagtacatccatgtgcgccacaatcatcaggcctgtcctgacacaggagtcggacacctacattagcagaggagtattcacgctgcgcagcagggatagcatgagctcagacaccgccagacatctccagttacagcccgaacactggaactctgattcgactggccacagcccatgcgaggccgcatgagcagactgtggacctccaggatgcgaagcgaagctgtggagttggtccagtatgcttactttaagaaggttctggagaaggagaagaaacgtaagaagcgaagtaaggatgaatcagagacagaagatgaagaggagaaagccaagaggccaggagcagaagaggagagaggagactcggccagccagatgccaaagatggggattcatacgacccctatga

SEQ ID NO: 607318 - DNA, 701 bp, Homo sapiens
ggaacctgtcatgtggcagtcttctagattagctctctcatgccaaaagctttgaactgtgtgtgtgagggctcaggcctttagtcacctccccaaacatgcttgacagtgcatcacgcaacagtggtcgtttaatctctcaagcaggtccatacgtctagcttacacgtgcgtccattattacttcgaacgaagtctcatgttaagaaaaactcctgtcttaatagcgatcaaaccttaattatatataggcattttctcacttttacaatgtgttttcatgcataatgtttcattttaatctcacagcaaacctataagaaaaatattaaccctgtcttacagttcaggacaccaaaatgcacagtaacttgcctctgttcacagagctaatggtaagacatatactaaaactcaaatatctgcattccaaatcaaatgctttttctcctcaaatcatgccagttttgcttttagaaggcaataattcttttagccatattttaccatttttcaaccatagaatatctggaactagttaaaggaatagtagaggacttccctgaaggtcccacattgactaagagtcagtcttctatagggcatggattctgatcctgaatgcttccaagactgcagaggaatttcgccgaatttgctatgcccatgcctcccctaaatatgtactctgctcttcccag

SEQ ID NO: 607319 - DNA, 669 bp, Homo sapiens
acaccaaatggcggatgactgccggtgcatgctgggggggccctggggtgccctgtgtggccctgggattggggaaccgcggtgtgcttcctgcggagtgtttctggcagtggcatcctggggcctggggtctgcggcctgtggactgtgggcctggtggccgatggcctgcggagctctgctggagtgcaatggccgacgtgataaggagttggatgccctgtcaccacagttagggcctgcttgagtcgaaggaccatgaaagatcacagtccccttggagcgagaatctatctcttactcccatgcccaattacaggaactcagaagatcaattgcattttcattacctgtgcgggcctactcttcaagtgatcgaggtatagacagatatatgcccagtgcaacaagcatgaacccgttgcctggccaggcgcacccaggttccaacggcatattgtcagctatacggggcactacaattggcccaccgtcgggtctggcgtgttcaagtgctccaacggagagtggccaacgacaatcgcgtgggagcccatcactcctggccaatcgctctccatcagtcaccccgtgactcaagacggctacatggcgcggaacaacgactcaggcaagcagacaaaatttgtcacttgccacggtgaccat

SEQ ID NO: 607320 - DNA, 118 bp, Homo sapiens
ttaaatatacaaataatgacctttactctccttctttcccccaggcactccctgcactgctcacttatctaattatgtctgcttagaagatttctggtgaattgaatccttggagaca

SEQ ID NO: 607321 - DNA, 101 bp, Homo sapiens
agcataatatagcaaggactaaccccgagcccttctgcataatgaattaactagaaataactttgcaaggagtgccaaagctaagacccccgaaacctgat

SEQ ID NO: 607322 - DNA, 346 bp, Homo sapiens
tgtcacccatggaccagctccagaatgtggtctgtgagaacgcgaagaccagccagaccatggagctcgtccccaacttccagggtatcgtgggcacctctgtctccccatgtgccctatcactctcctgtgcacacccgcaggctgctcgtgggcttgccacgtccagcagtcactccctcccctcggggtttgctcccgaggccctcacattcaccacaacccagcctcaagggtggggatgtcctcagagggtcggcaatgccctggactcagagaggttgcaccctctccctctcagtctctggtcacacctgcctctgttccaagccctgtccaggtgcct

SEQ ID NO: 607323 - DNA, 1054 bp, Homo sapiens
gcagtacccaaagggtttacggtcgccaggctgggtggcgcggcctggcgtggagcagagtggacacaggttcccacgctggcgccgtgcgaccgggtggggctgcgtgacccccgtctcttggccacatgtgaccaacgcatacctgggcacacgagtgtttcacgacactgctgcacgtgagcggcgtgtacaatggggctggcggggacacgcaccgggccatgctgcccagacccctcaacgtccggctggagtgcccctgcagggatggcgtggagcagcctgaccgcgaccttcgccctggacaccaacacacggctcctttcttcacaccctgtgaggtgcccccgattccgggcactcccagtgcatctatgccgcatcgcacgcatgccccacagtgcttggctttccagagtgtcatcgcccagccttggccccgcgaggagcgggcccatcacagctgctccttgcggtcagccttttcctccccctgaacacgccccaggacccttggaaccttgcaactcagggatccttgacattcccagtggcaagccctggccattggccccacgcctcttcaccacggtacctcgtattggccaccaccacatcacccccttgagcagccccacgccgcgggcccaccaggcacaggacgcggtacccccatctgccctggtgggaacgaatcctagctagccccccacgcgacccttgcaccccactttgccgggcaccgcggtgacgcgcagggccttaagcgaacacgtcgcccacactctctcccgtgccaccactctcgcgtctgacccaccggctacacgaccacaacggcctgcaccagtactcaaccgctcctacttggctagttaccccactgaatgcgacacacctcgtgcaacctctcgaatgtcgcccacaagcgctaactgcctcgttctaacttccagcgccctcacctcgactgccatgacgccctcgtcgtcacccccacgcccaccagtgcgtctaaacactgtcgtcgactctggacccgagccgacac

SEQ ID NO: 607324 - DNA, 154 bp, Homo sapiens
tggttctactggtctccaatcctgtatatccaattaccgtatttggcacctgcatctggattctaagttctgcatcgtcactcgtttactcatctgagaacgtgaagtctgtgattgtgttctcctgcagaacgcctctgcgcttggacagttt

SEQ ID NO: 607325 - DNA, 237 bp, Homo sapiens
ttgaggacccgtatggatactcggcgtgtgcaccgagagtcatactgcacacgccgaaagcgtaatcgccgatcttcacgtgcacacgccgaatctccataccataatcgccgatcttcacgtgaagatcggcgattttggtctggacactcgcgcgtgtgcagtatggtagactcggacgtgtgcacagggcaaggtcatggatactcgcgcgtgtgcaaagatctggcgtgtgca

SEQ ID NO: 607326 - DNA, 602 bp, Homo sapiens
  misc_feature (370)..(370): n is a, c, g, or t
  misc_feature (375)..(375): n is a, c, g, or t
tgagatggagtttcactcttgttgcccaggctggagtgcaatggcacgatcttggctcactgcaacctccacctcccaggttcaagcgattctcctacctcagcctccctagtagctaggattataggtgcctaccaccacgctcagctaattttttgtatttttagtagagctgggtttcactatgttggccaggctggtcttgaactcctgaccttaggcgatccacttgcctcagcctcccaaagtgctgggattacaggcatgagctaccatgcctggctgtgttttattttttttttagtgacttcttcatgtattaacaagtttataaaagccaatccatgctctgaaattatgaaaatatttnctttnctcttctattaatatttttcattttaaatggtgggccaatctagaattggctgtgtaggtggaggatatatataatatagagtaggtcggatgagtagattagaggaaatagtaagagtaaataaagggtttgtaagggcagggttaaaatgagggtactatccacacaatcaatgtaataaatcagaatactccaattggaatgtggacaccttggttcataacca

SEQ ID NO: 607327 - DNA, 124 bp, Homo sapiens
caagctttggcaggggtggtggccataagctgatgacttcatcataggtcaggcttttccactcatctagtaggaggtccctgctttcaaaggactgatcataaggatcgtgccacatggttca

SEQ ID NO: 607328 - DNA, 214 bp, Homo sapiens
gtatgcgctccctacttaccagatggggcgacaggcagaggtgctccccacttcccagatggggtggcgtgctgggcagagacgctcctcacatcccagacagggcggctgggcagaggtactcctcacatcccagacggggtggccgggcagaagcgctccccatttcctaggcagggcagcctggtgagatgtgtgctccccattttcccag

SEQ ID NO: 607329 - DNA, 335 bp, Homo sapiens
ccagaggcaccatagagaaggtaatgggataatccagctgcctgggcaccatagtgaaggtaatgggataatccagctgcctgggcaccatagtgaaggtaatgggataatccagctgcctgggcaccatagtgaaggtcatgggataatccagctgcctgggcaccatagtgaaggtaacgggataatccagctgcctggtcaccatagtgaaggtaatgggataatccggctgcctgtgcacacagtgagggctatgggagacggcgtttcaccgcgtcagccaaggtgtctcgatcttcttgactcatgatcctcccacctcagcctccttg

SEQ ID NO: 607330 - DNA, 859 bp, Homo sapiens
  misc_feature (239)..(239): n is a, c, g, or t
  misc_feature (397)..(397): n is a, c, g, or t
caccttttaagggtactgaaaagataaagtaaaggtcctgggcaagtaaaaatgtgaactttatgaagagttacccccaaggaacccaattctggagggagcccttggatgagggtcccaccccgaatatactaaatctgttctgaaaaaggggagattaaaagcaactttcccacaaagggaggatgttgtgtcagctgctggtgatacagggaccctacaaaagattgggactgttntttgatgactgaataattccaacacagtgccaagaagagagagaaaatgcccagccttttaggttttaaggtcggagtatggccaagttatcacgaggattgggatgaagctctcttgaactattgagtataaaggagaaaaggctcgaactggaganttgaaccccgaatgggcttatcggagaagaaaggagcacgcctgatgcccacaattccccccaattgccaaactcaacttttgagaggtggagatttatgtggagtattgagttgagaattatgcacgtgctttcacgcctctataggagtaattatgcccaccacatgataaaaacttggccttgagaggaaaatttatcaccacaactagtttatgaaacttgtttaactaattgtaaaaggagagaagtcacaactgggaaatttccacggaggttatatataaaatttgtttaacttggtcccagcttttgagagattaatcccttatgaatccctggtttttaaataactttcctacagctgtgtaaaatactggtcaaggagaactttttccttttacctcatgttgtaaacttaagtggctccataaaaattgatcccctgtcttgatctgacca

SEQ ID NO: 607331 - DNA, 457 bp, Homo sapiens
gagacttttccccccgccgacgcccccccgatgcgcttacgtcgcctcctgacctgctggctgccctagggggccaactcctccccccagcgcccaggaccatccagaagattttggaccacgctgggtaatcgaggcggacgacgaccggctccaccaggttatccagtgagctgaatgggaaaacaccattgaagacagtccattgccccgggtattggccaagcttgcccagtgtaccctgcatggtggggctgtagcccgtcttcttgctgcccccaggctcttgccagccccctgctgctggttcttgccccctgctgccagccagaggagaagaaaagatgagaagaagggaggagttctgtaagagtccagatgatgacctgggatttggccctttttgattaaattcctgctccccctgccacaattaagccctttttaccacccactc

SEQ ID NO: 607332 - DNA, 110 bp, Homo sapiens
gagttgctacgcatggtcagttcaagggcaaaagcgattcacaggctagagtactaagacagcacaagtactaacagatttcatcaagttagtgattctggttctccaaa

SEQ ID NO: 607333 - DNA, 302 bp, Homo sapiens
gaatcgagctcggtcccccctttacggattacctcaagtagggaatttcccccaaaaccctgacttcccacctcagcctcctgagtagctgggactacaaatgcgcaccaccacaccaagtaaatttttgtatgtttttgtagacggtcttgccgtgttgcccaggctggtctcaaactcctgggctcaataacctgcctgcctcagcttcccaaaatgctaggattacaggcatgagccatcgcgcctggcccttcccatgttttcaatgtgcctctttgtgttgaggtaatcgtgagtgg

SEQ ID NO: 607334 - DNA, 935 bp, Homo sapiens
agctaaaaaaaaaaaaaaaaagaaagaaagaaaaaaagccatccagtgaaacaactttttttaaaatggtagaattattttattattagaaaaatcctttaagaaacccacaaactttttcccagaaaactcttagaactaattaaacaagtttcagcaaggtttacaagaaatgagatcaacatttttaaaatcagctttatttctgtacactagcaataacctaaaaaattactttgagaaattaaattttcccactttgtacactaaattatctcaaagggcaaaaaataccttaggcagtaaattttaacccaacaacgagttgtacagacttgaaccaccagagaaaccaacaacaattatttgcttggaaagaacatttacaggactctaacatacattagattaggccattattgttgtgaactgtggaacgacaatatttaagaatggcatttactacccaaagtgatctacagatttagctgcaatccctattcaaaatcccaatggctttttaaaaatttcccccccgtagaaatttgaccaaatttgaccctaaaactaatctttagaagggcaagggacccagaggtagccaaaaaattcttgacaaaacaaacggaagtccccagtcgtacacgaattatacctttcgtgggttttaaaaaccttacccggaaaagcaccaataattccaaaacgctgggtgaatactgaccataaggaatagtcataaagaattgacttgacatacgttattgcagaggtctacacacataacggcctttcaccttacattggtccagtggacttttaaaccagaatgggtagaacattccaaggggccacagaattggctttttccaacaaatggctgtggcaaactgggaatctgggctgaaacacgactttgaccccacttctacccg

SEQ ID NO: 607335 - DNA, 435 bp, Homo sapiens
cgcactcgaaggccgctaggccacctgcatgcggttcttgtgcggcccacggctactggtcatcgatgaattcgcgtacgcccgacgcaaccccgaccccgaggccaataccgcgctgtttgaggtgatttcacggcgctacctgaagtcctcgaccatcctgacctcgcataccggcatcgccggctggggcgagcgcctcggcgacccgatgctggccgccgcggttttagatcgagtgctacacaccgggattgtggtctccatcgacggtccgtcgtatcggatgcgggctcaccagaaacgtagcgacgcgctgcgccgcgccctacacccggaggccataccatgaccaccgccaactgccgggggaaaccacgccgacaccagtcgccctcccgcggagttacagctggccgccgccatgccgcccag

SEQ ID NO: 607336 - DNA, 4430 bp, Homo sapiens
ctgcctagtatggaggaggggataaaaaggtctgcctgcagaggggaggagctaagggctgcctggtgtggggatggccccttctgctgtgacctgggtggatatctgggcttgggatgcacctgttggattctccctgagctgcttcctattcctctgacactgcagcccttctggcccctgggcactggagtggcacggggcttcctggcagcctttgatgcagcctggatggtgaagcggtgggcagagggcgctgagtccctagaggtgttggctgagcgtgagagcctgtaccagcttctgtcacagacatccccagaaaacatgcatcgcaatgtggcccagtatgggctggacccagccacccgctaccccaacctgaacctccgggcagtgacccccaatcaggtcagacccccgacacacccaccagccttcccaagccaacccccttcccccaggtcaggccctccctgcccagtcgctgccctttggggtcaatcctacccccggcaggcccttacccctggactcaggggctgtgtggccagcctgccttgagacctgagcggggctgccttaggtacgagacctgtatgatgtgctagccaaggagcctgtgcagaggaacaacgacaagacagatacagggatgccagccaccggtgagcaggccttcctcccaaggggtgaccaaaatatgtactacccagcgaggcccaggtggtccctgcaaagcagctgcagcctcaggacaggagcagcgtgccggagcactcattgttggctggtgggttggttgggggcctgctggaggaacggaggggcagcaccgcacaggcagcagttggctgccagtctgaatgtaagcgcgttagtgtttgaaccaccgttacagccatagtggtgctggcaacctcccctgcccccagtttagtctgctgccctctatgtggccagttgcgatttcactttattcactcctctactttattccaaagagattttttttaaaagagaattgggatggagagctgctgatagtcagctttaggctggtgccctagtagaggtgggtccctgactcctcctcccctacagaacccccacatgcagcagctgggctccctatatgcctgggatgggcagagggggccttgggcacagcacagccttctttcccagggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctgtgagtccctggcagacccacctctctctcatgatctcagtgtaggagttagcatatccagttgaatcctagagacagtgtgcttccctgcatctgccgacagtcttgtgagactctaatgcattcagatagtggagagctttgtgaatggcacaggcccccaaagccaggagtagtgtcactgggttgggcactgggtagcagagactacacacctaccttcaagccttcttgtaccccagctgctgcttgctgtccctcccctcctgctgcccttcctcccctcagtggggctaggttcttgtctctagttggcttttctccctgacatcccacagggaaccctcagagctgcaggggctgggagctctggaagcaactgcttgggcactaaaggtggcagagaatgagctgggcatcacaccggtggtgtctgcacaggccgtggtagcagggagtgacccactgggcctcattgcctacctcagccacttccacagtgccttcaagagcatggcccacagcccaggtgacctgaaggaaaggcgggcaggataactgggatggggaggtgtgtgtgtgtgtgtgtgtgtgtgtgacagagggagaaggcggtgtgtgtgtgtgtgtgtgtcagaaagaggaagaaggcgccctctgagggccagcctgggagaggtgtccttctgggttggagagtgactgtctgttctgagagtacagtattggcaccccccatccacactgatgccctggctctccccgcaggccctgtcagccaggcctccccagggacctccagtgctgtattattccttagtaaacttcagaggaccctgcagcgatcccgggccaaggtggagagtttaggcagggctggagctgagcagggaggagtgggcaggggggtacccagtggagatcctggggtgatggtgaggacattcagaaagtggggaggactgggacctcaaaacatcacacttagagctgttaggacttattgcaggaaaatgcagaggatgctggtggcaagaagctgcgcttggaggtgaatgcaggcaggggcgggtcggtctcctaccccacattttatcccctttcctggtactgtcttccctatttctcatcccatgtcttgttccccaccccaggtcctgtaacccccccatccagcctccctgcctagtctcactccccttcccttcagccccttgtgttcatctgtacgcatcccctcccagctggccctgcccctctaccctccctgcctgagcacttacctccttagatggaggccgagaccccaagtactgaggtgccacctgacccagagcctggtgtacccctgacacccccatcccaacaccaggaggtgagagccaggctttgtgtgcaggcagaggcccggggagggcagggcaggggcgtttcatgggagggaaagaactttggagctggccttggctccacctgaccctgtgtcctgggggtccacgcaggccggtgctggggacctgtgtgcactttgtggggaacacctctatgtcctggaacgcctctgtgtcaacggccatttcttccaccggagctgcttccgctgccatacctgtgaggccacactgtggccaggtggctacgagcagcacccaggagatggacatttctactgcctccagcacctgccccagacagaccacaaagcggaaggcagcgatagaggccctgagagtccggtaaagactgaaggcgtgtatgtatattggggcatgggaagaggaagagggtctcgtcaaaccagcgctttgctgggggtaactgaatgtcgtcttctactagcatgtaagctctgtgaaggcagggatgcctgtctgcttacacttcttgttctctcaagtatctaaaacacagccagacactgtttgtaaatggttttaagtgaatgaatgccaaggctcacctttgctccgaaggggtggcctcaccccccgacctcactccaccctgggcaggtcactgaccagaccacatggtggcttttccaggagctccccacaccaagtgagaatagcatgccaccaggcctctcaactcccacagcctcgcaggagggggccggtcctgttccagatcccagccagcccacccgtcggcagatccgcctctccagcccggagcgccagcggttgtcctcccttaaccttacccctgacccggaaatggagcctccacccaagcctccccgcagctgctccgccttggcccgccacgccctggagagcagctttgtgggctggggcctgccagtccagagccctcaagctcttgtggccatggagaaggaggaaaaagagagtcccttctccagtgaagaggaagaagaagatgtgcctttggactcagatgtggaacaggccctgcagacctttgccaagacctcaggcaccatgaataactacccaacatggcgtcggactctgctgcgccgtgcgaaggaggaggagatgaagaggttctgcaaggcccagaccatccaacggcgactaaatgagattgaggctgccttgagggagctagaggccgagggcgtgaagctggagctggccttgaggcgccagagcagttccccagaacagcaaaagaaactatgggtaggacagctgctacagctcgttgacaagaaaaacagcctggtggctgaggaggccgagctcatgatcacggtgcaggaattgaatctggaggagaaacagtggcagctggaccaggagctacgaggctacatgaaccgggaagaaaacctaaagacagctgctgatcggcaggctgaggaccaggtcctgaggaagctggtggatttggtcaaccagagagatgccctcatccgcttccaggaggagcgcaggctcagcgagctggccttggggacaggggcccagggctagacgaaggtgggccgtctgctttcgttcccacaaagaaagcacctacaccccagcacagtgccacccctgttcatctgggctgcctggcagagagccttgctgtttacaattaaaatgtttctgccacaaaaatcaaacaaaacaaaatc

SEQ ID NO: 607337 - DNA, 126 bp, Homo sapiens
tcttggatgagtgggactggcatgaagaaggactagagcatggtacacgctcgtggacagtcatgtggtgatctgtaatttgtgctctgtcttaaaatagtcgaggaactgtttgggatcaccaag

SEQ ID NO: 607338 - DNA, 208 bp, Homo sapiens
ggagcccatcatggcgacgcccttaagcggcgggcggttggaggccacgggggagaaagtcttgcgttacgagacctctattcagttacgttcttgcagcagggacttgtcgaaaggatgcttggaccattgagacaaggtatatagcagcttggccaaattaccttccaactgagaaatgtcatttgagcgattccaggaagctaag

SEQ ID NO: 607339 - DNA, 1103 bp, Homo sapiens
agtgaagaaagcagaagcgggggcagtggggccgagtgagaccggagatgcccacatcattggcaggattgagagctactcatgtaagatggcaggagacgacacacacatgttcaagcagttctgccaggaggtgccatgccccactgtgtctggagtgcactattctccaccaccagacttcagtgacttgatgccccatgcacgactcatgccaccacatgcccaagtgcctgtgtgcagcgacgtgacgtggccccccctcgcgcgcccgccacacgacccccctctttcctcacgcttgacttgcccacctgtctccaacttgacgtcctctctctcgtgtctcttgcatcttacttgaccttctcacgtcccctatgtccccttgccatgccctagttggatggtttctatgcttctgcgtgattgctctcatggctcgttctactgccttgcgggcttcggctcgatcacttgcccaccgctccacacctcctgcccctggtctttcgctctccctctgtggccgtttgctcgcccgggctgcaccgtcggagcgttagccatcgtgctgtcaccttcccttcgccccaaccccatccaccgcccttcgctcgccgccctctcccccgagctctgtgtccctggacgtcgtcaggaactccgttcgctccgctgcgtgccctcggtcaccctcggcttgcacccgctgctccctctccgccacggcgcctcccgttccccccccgcccaccgcccccgctctggggcccctctcttctggggaatcttcccgccgatttctcggcggcgggtcacgctgcacttggcgtgtcgtgggcgccgttccgttgcgccttcccccgattctgctccaccatttaatcccctcaatctctacaaccgtttaaccatacaatcacaacacggccctgcggcacccgtcaccaaacacgcacggaaaaagataccgcgtccacactagctcctgtctctatatcacgccctttggcctccccgcgtcattcacccagtttctctagttctctgtacaacccctccccaacacccctatttaatctctctcattcacccctctt

SEQ ID NO: 607340 - DNA, 495 bp, Homo sapiens
  misc_feature (142)..(142): n is a, c, g, or t
  misc_feature (148)..(148): n is a, c, g, or t
  misc_feature (312)..(312): n is a, c, g, or t
  misc_feature (359)..(359): n is a, c, g, or t
  misc_feature (373)..(373): n is a, c, g, or t
  misc_feature (378)..(378): n is a, c, g, or t
  misc_feature (395)..(395): n is a, c, g, or t
  misc_feature (405)..(405): n is a, c, g, or t
  misc_feature (424)..(424): n is a, c, g, or t
  misc_feature (429)..(429): n is a, c, g, or t
  misc_feature (435)..(436): n is a, c, g, or t
  misc_feature (438)..(439): n is a, c, g, or t
  misc_feature (443)..(443): n is a, c, g, or t
  misc_feature (446)..(448): n is a, c, g, or t
  misc_feature (457)..(457): n is a, c, g, or t
  misc_feature (471)..(471): n is a, c, g, or t
  misc_feature (484)..(485): n is a, c, g, or t
atagagctgctgacctgctgcaacgcaactgtggaagagattgaagcatgaatgaaggctgtgacaagcatttacaaccttctctgcaccaaagtagagcagcaagaatccaagcgcacctggggccctggccttgcaaccntctttnccgtgaatgggcagcctgctggtacagcaactcccagtagcgagagacggcacccagaatcagatcccagcttcggcatttgatcagaccaaacagtgctgtttcccggggaggaaacacttttttaattacccttttgcaggctcccacctttaatctgtttnataccttgcttattaaatgagcgacttaaaatgattgaaaataatgntgttctttagtagnaactnaaatgtgtcttgctgtnatttatattncttttcccaggaaagaagnatttntgaaanntnntgtnaannntcaatatgnagaatggcatttgnaataaaaggtttnntaaaatggtc

SEQ ID NO: 607341 - DNA, 435 bp, Homo sapiens
tcgttcctagagtatcccccgtaacaggcttggagccaagttggggtgtagggggacgtcttcgtttcaggactcttgtcattttcctgggcatggaccgggaccagagcccagatcttattgctcatgttgtttctgcctccccagattggagaaggaaatgcaagagagaacgtgacggaatttggagctatttttcccttctcttctgttttgggtggaatggccttgcctgtctttggctgtgagcttgagtcatcctcagtagagtcccaggtgctggtgcccaggtggagcttagagcttaacaaggaggaaaggcactggggctccagaggcccagacagctgcggtggctcctgctgtcacgctggcctccccttagaagaaagccacctgtccatgtcatgctatcacactgcggtgcacccacca

SEQ ID NO: 607342 - DNA, 300 bp, Homo sapiens
  misc_feature (85)..(85): n is a, c, g, or t
cgatgtgggcacagtaagttatttgaatgagaatgagaattagttccttcaccattttgagaacttaaaaaataaggaacatttnccatccagaatagtgacttaagtgcttttacaaccccaccccgcatttaataattaagcaggtgaggttggctgaagttaaaatgtatttttggcctttttattaagatgatgatgccgctgtgtatttccatgagcgatgaagaagacgcccatgccttattccaggtgctgatttggaaactgttcattaaaactttcatgctgttcctaaaa

SEQ ID NO: 607343 - DNA, 410 bp, Homo sapiens
ccatcgacaactacctcttctcactatttagggactttaaaagtcttggaccaggaaccttcacagaaacagagcatataacctgatatagcagataacataagggcagctgttaatcaggagtggttataaaagaaaaatgtatatttacatgaaatgcacataataaagagagttgaaattgcaatcttaaggatccaaaatgaacagaaaaaagctgctacaaggcataaagctttctgctcgttcgaggtctggaaggctatgaaagaaaaggaagcatagaaaatagctgccaaaaagaggcttgaataaaaaaacaagaagaaaactgaagaagaaaatgctgcaagaaaaggagaagcactacaagcttttgaaaaatggaaagagaaaaagatggaatatct

SEQ ID NO: 607344 - DNA, 1521 bp, Homo sapiens
  misc_feature (1020)..(1020): n is a, c, g, or t
  misc_feature (1075)..(1075): n is a, c, g, or t
cccagacgcaaaggtgtgtcgacccaagacatagtcccgcgctcttgtattaataatccgcgcctgctccccccatttatacttttttatccccgcgtccctatatagtgtgttaacacggatagccccctctcggggtgtgtgcccgaacttttctcggccccaccgtggggggacctcaccctgcttcttgctttcgccaaatcgatgccctgctttgccgggtgcctcctgtccctcatcctggtcgcctggtgtaaaattttgcgccgacggaaacacaagttgatttgtgcgccgtccactaagaagttggccctttaatttccattggggtttcttgtggataacaccccgctcatgacctccgccttcctacatggtgattttgggcccctttgggccacgaccatttggggggggaaacaccaccaccctcctgggggccacaaatgggggctataaaacaacacaggggcctctgacccctaatacccctcggggggccgcttcacacccccccggggggcaaaaggcgaaacccccccacacagggggcctcttaatacccctcggagaccccagaggcaccatctctcccacagggcgcggctcttagcgccccttctgggagagccaccccctctggggagagtctttttatttccctgccgggagggacacaccctgcgacacccttctggagagttcttaacccctcacagggccacacacacaccacagcgcggcccccctctgggggccttaatacgcacactgtctgttctttggaccacagcccccacaaagttgggcccccccgcgagagtctctataccccctggcccactctggggcacccctattatgagcgcgcgccccccccgcgctcggggcccccacacttggagattgttggccgcgtctattatacactctcgcccctcttggcgccctcgcgggagagatggtgtgccgctcgcgcaatagtcgtcggatatacacccatattctgggctnctccagcgtgtgaagaccccccaataggctcaacacgcagagatatatgtctctnttagagatatttccccaagagagagagggaaatagagatagattcggcctctgcgcccacattgttaacacccacagctctctcacataggagagacaccacaccagaggagagagatccattgtgtttgtcgcaatacaccaaagacgtgggatataataaacatgtggggaagaggggaagagaaagacacacacatcgggtttgtctcccatttgtgaaaatggggaaacccatatccaaaataacaagtgactgggttgaacctgagcccacattcacaggttcgccagtggaatagatagctccacattgttcgccagtgaccaatacatccgggtttaaaaaacatccaatgaaatccacgccaactgggaatttctggtgacatagacctcacccgtgcttcatataccctgatataatctgtaaaggggccagattta

SEQ ID NO: 607345 - DNA, 163 bp, Homo sapiens
  misc_feature (6)..(6): n is a, c, g, or t
  misc_feature (10)..(10): n is a, c, g, or t
aaaaancccngttttttttaaagggcccgggagggggttcttttaaattctctggcttgagggccccaaaagccccccgtaggaattttccctttgttgggggggggttgttttccccctttttggaatttttaaaattttaaaaaaaaggggccccttttga

SEQ ID NO: 607346 - DNA, 339 bp, Homo sapiens
ggcacccccccccggagccgggccccaagggagcccccccccgtttccctgaaaggagtttcggggcccctttaaaggttttttggtgtttttccccaagttttaaaacccctttggggtttccccttttccttgggttggggtagcccctgcataaaaattaaattatagggggggggctctttccctcccctcctaaaggaaaggaaaggggtttttttccccttagggggttgggtaggtttttttggtttggggaaaattttttgaagggggggaaaatggcaagtttttttttttttttcccccctccaaataaaaaaattgggccctttttta

SEQ ID NO: 607347 - DNA, 171 bp, Homo sapiens
tgccacctgactcagtcagaaagaccggtgacacccgtcaggtgcgtccattgtggatagatggtcaggatggcaaggtcatctcctcccgcgagctggtcatccagaccacccgctgaggactcatgtaccccagcccaggcctcttccccacccagccctcttcccctg

SEQ ID NO: 607348 - DNA, 344 bp, Homo sapiens
  misc_feature (22)..(22): n is a, c, g, or t
  misc_feature (29)..(29): n is a, c, g, or t
  misc_feature (35)..(35): n is a, c, g, or t
  misc_feature (38)..(38): n is a, c, g, or t
  misc_feature (44)..(44): n is a, c, g, or t
ttgccagctgttgcaaaatacnacccaanatgggnaanaaaaanagtttaattggacttacagttccacatgactggggaggcctcagaatcatggcaggaggtgaaaggcacttcttacatggtggcggcaagagaaaaatgaagaggaaacaaaagcggaaccccttgataaacccatcagatctcttgagacttattcccacaacacgtgggaattctgggaaatacaattcaaattgagatttgggtgggaacacagccaaaccatatcaccaaatacatacctatttaataatccagaaaatacaatcttatgtacttaacagaagtgaaattattatc

SEQ ID NO: 607349 - DNA, 403 bp, Homo sapiens
tgataattggggacacaagaaaactgagtcccagagtggttaaaaaagtttgacataggaccagaatgcagatataataaatcacagctcagctcaaagtgatttttctatgtgctctacattaagtttataagtgtctgctaacaaaacagaattaagtgcagagaaaatatcgccagtagaaattcacagacaaaatctgaagtcaactgacggctagcaatatttaacttcaaattcttttctttgtttttttggagacaacgagtgtggctctggtggcccaaggctgggagtgggagtgggtacagatctacagctcactggcagcctctggcctcctggggttcacagcaattctcctaactttagccctctcgaagtagctggggactacagggca

SEQ ID NO: 607350 - DNA, 230 bp, Homo sapiens
tgcaacacctgtggcctgccttagttgggccaccagccccggttacctcttgtcggtggagggaggtggcctctcggggacataagctggctccccccgtggtggctgtatccgcctcccccactgcctcctggggccaagggaagaaggcctgccagcttccaaggaggccccaaactgctaaagcttggactgagttaattatcgattcttggcttttataatggcca

SEQ ID NO: 607351 - DNA, 84 bp, Homo sapiens
gagagagatgaagggtcttactactgtgcctgtgacacccgtactgggggatacgcgggctcctgggacacccgacagatgttt

SEQ ID NO: 607352 - DNA, 339 bp, Homo sapiens
cgagaggtacacgatagagtatctcctgtaagagcagtaacatggtcacgtctcacagtgagaaagaaatcccgaataaatagcctaaacaagatatcaaataaacagccagagctataacttgtcctcatcacatatctgtatcgcagaaattggaagaagaatgtaagactgtactgtgagcccgttcgtgtgccatgtgcaagtcatggtataagtccaccactattccttaagtatatgtatgggcctcaagtgaatcagccacacagaccccccacattatctacatagaaccgtcattcacacaagcaaacaccctcatgttcataccctctt

SEQ ID NO: 607353 - DNA, 259 bp, Homo sapiens
ggtccctgtcacatgcggcagttcagagagagaggagcgtgggcctgactccgggatgtggcagccctgtaatggcctgtaccgggtccggatcccaaggcgacccgggtccctggatggcctggaagctgtgtggctatgtctcctcctttgtccctgctgtgctccctgtgtggagtcgcacctgtcggaccatgctgaccctgcgacgtggattgtggccggccaacgtggtgggcgtgtcggtggtgactgcacc

SEQ ID NO: 607354 - DNA, 215 bp, Homo sapiens
ggactaaaggcatccttgtcttttgacctgttcgcctcagtagaaaaggctctaaggggagatcactgtagtttagttctgttgacgtgtgcccctcccccttggaaatgtatgctgggattttttttcccctcccctacccatatccctcccgtgtgtggttggcaacttttgttttttggggtttttttttttgaataaaaaagattctacta

SEQ ID NO: 607355 - DNA, 575 bp, Homo sapiens
ggattactcacgaacaaggtccccctcagaaaagagtccctcaaaacagcactaccctcagaatagggcctctgcagagcagaatcctcacagaacagggttccctcagaacagggtccccacagaacatggtcctctcagaacaggatcctgacagaacaggttccccacagaacagagtcttcctcagaacatcattctcaggacagagtcccccctccccagggcaggacctgttcagggcagagtccccatagctgctgtggggagggcagggccctgggacttgtttccaccttggctgctaggctcataggtttttctttcaggtgttccagctccacgaagggcatgtagcaggggtcacaaaaatggagtagactttcggataggcaggggcagcactgggggaagtgagatttctcttcaataggagcaacggtacaggtgttcacatgtggacaacagtgcaggtcgtgcattgactgttcaggggtctcactcttgcttaacgtgcctggaacagttctccctccctctcaggctgctcatgagttcaccacgtgagcgcccaa

SEQ ID NO: 607356 - DNA, 409 bp, Homo sapiens
  misc_feature (9)..(9): n is a, c, g, or t
  misc_feature (20)..(20): n is a, c, g, or t
  misc_feature (253)..(253): n is a, c, g, or t
cacgaatanatgtgtatatntaaacttgtaatgtgtatgtatgtatacatacatcctatacatacacacacatttttctggagttaggggctggagccagacagagacagataaataagccccggtatggtggcctcactcttgtaacccccagcaatttgggaggccaaggcgggaggatgacttgaggcccaggagttcaagaagagccctgggcaacatagtgggacctcacctctacaaaaaagaaagnaaaatcagacaggcatggtggccaatgtgcctatcgtcctagctactcaggaggagtaggtgggaggattgcttgggcccatgagttcaaagttgcagtgagctatgatcacgccactgccctctagcttgggagacagagcaataccctgtctct

SEQ ID NO: 607357 - DNA, 326 bp, Homo sapiens
ccaccggtatccgctacacaaaaactgtatatggttaatgtccatggcagacattattcacgatagccaaaaatagaaataacccagatgtccatcaactgatgaatggatagacaaaatatggtctattcatacaatggaatattattcaaccatagaaaggaataaagtatcattatgcgctccagcctgaatgaaccttgaaaacattaagtgaaagaagccagatacaaaatgccatgttttatgtaactccatgtatatgaaatgtccagagtaggcaaatccatagagacagaaagtagactagtggttgccaggcattg

SEQ ID NO: 607358 - DNA, 112 bp, Homo sapiens
aaaccacaagccttaaaaatgttgaattcccagattgatgattagttagggagcttcctgccctatcccagtaacaagtggggtgtgaggtgatggaactaaggcagccagc

SEQ ID NO: 607359 - DNA, 506 bp, Homo sapiens
attgtgcggccaaaccagcccagggggttggcagcagggttaaacacctgcctgggggtcctccctgagggacccctgcctggagagcaaaaaagggggccttttgttcccgggggattttttgttttaatccccgaaggggctttgctgggtgcgggggggaaaatgtttcccaacaattaatttttcctccaaagggggatagggccttggcccccccttttccaagggccggggggggggtttcccctgggatgggaaaggggggccctttttaaggcccgggaattcaaatggcaacccccccgggggccccccccggcccccaaaattttggggggttaaaaaacagggggccctcggggcggtgttgaaacccccggggggccccgccttttttttaattaaaaaagggggagcccccccattgggtttttcaaaatttttttccttggggggggaatttggtttttaaatccggctaaaaaaaaggaattgggacccca

SEQ ID NO: 607360 - DNA, 418 bp, Homo sapiens
  misc_feature (30)..(30): n is a, c, g, or t
  misc_feature (33)..(33): n is a, c, g, or t
  misc_feature (64)..(64): n is a, c, g, or t
  misc_feature (66)..(66): n is a, c, g, or t
  misc_feature (100)..(100): n is a, c, g, or t
  misc_feature (210)..(210): n is a, c, g, or t
  misc_feature (218)..(218): n is a, c, g, or t
gtacagtcactacagaacagtatagaagtnccncctcgaaaactacaactagaactcccatatnanccacgcagtcctgctactcggcatttacccaaangaaagcgaaatcaggatatggaccgagacacctgcacctccacatttactgcagcactattcacaataaccaagatacagaatcaacctaaatgcccatcaacctaaatnatgacagnttgactagagatgtggtacatatacaccatggaatactatgtggccacaaagatgggaacacagacactggggtctacctgaaggtggaaggtaggagggagagggccagaaagataactattgggtactgggcttaatacctgggtgatgaaataatatgtacaacaaacccccacacacgagtttatctatgtaacaa

SEQ ID NO: 607361 - DNA, 893 bp, Homo sapiens
  misc_feature (307)..(307): n is a, c, g, or t
  misc_feature (311)..(311): n is a, c, g, or t
ggacgaccctggacatcgtcagagccaacacctttgttgcagaagctgaagggtttgtgatccagctcgagtcaacagtctcctgtcattggtggccatgctgggaagaccatcatcccccttgatctctcagtgcacccccataggtggactttcccctaggaccacgtcgtgacacgtcatcgtcactggtgcggatcctaggaggccggcgcggatgtgtggtcaaaggctatagagctctggagacatggtctctgccagcccgtctccatggcgctatgcccgagcgctccgcttttgatcnttcntcctctctgtgtggatcgtcaagtcgaactgcgcaaagcgaaaggctagtaagtgtgaaattgcttccttatcgtatctagagctcgactacgcggaagactggtcaatgctaccatacctctcctccagcacctgctgtctgcttgtgcaggataaggcgtcgatcgtataagcatatctaggccttcgagtgactgctccctacttaatgaagagagaagaatgatctcggattgccatccccgagctgaaggcctccatcaagaagggggcaagatttcgtgaagaccctgaagtgagccgctgtgacgggtggccagtttccttaatttatgaaggcatcatgtcactgcaaagccgttgcagataaactttgtattcttaatttgctttggtgatgattactgtatctgacatcatcatgccttccaaattgtgggtggctctgtgggcgcatcaatagaagccgtccttgattttcatttttcaaggtcccttctgtaaatgctgtgctttcttccctgtgagagccaactttagagtgtctgctacctcttcattaccaatcagaattaccatgc

SEQ ID NO: 607362 - DNA, 344 bp, Homo sapiens
aagtcttcctgaactaatcttggcatctgctcagttgcaggttccctagacactttactgcatcttcttttccctagttagctgtccacttatagggtcactttcctgctcagtagcacctccaccagtgggcatgaaagagggaataaagtgcgtgcatggtggctcacgcctattatcccagaactttgggacggcaagggtggggtggattcacctgaaggtcagggagttcaaagaccacccttggcaaaaactgtgaaaactcgtctctactgaaaatacaaaaattagccgggcatggtgtcgggtgcctgtaatcccagctacttgggaggctgagg

SEQ ID NO: 607363 - DNA, 456 bp, Homo sapiens
ctgcataaaatagttgatgccgggcacctgatgccgaactagtacgggtgcacctggcggggactagtacagctacacgattgccacgatgccgtgcttgtactacaaggtgaacaggtactaccggcataccggacagccgataccttgaactacacgtgctaatattaacgactatcacggtaccacgtagcgactacaagacgacggataccatttactacttaaacttgaacatataggggaggaaccggggacgaaggaagacaaaaaggagaggaaaggaacaggaaaagactcctacggaataaggaccacctacacaaacgtggtacgaaacacgggaatgaccgggaaacgagcaaccttaactggcgcgcagtgcttggtattgaactgatgtacaggggttattagctacgtccaatagtattaaggaacggggaatatataaaa

SEQ ID NO: 607364 - DNA, 548 bp, Homo sapiens
  misc_feature (117)..(117): n is a, c, g, or t
gagcggagtggctcgccgggtcgttgggccctgtcgacctgtaggcgggcgagcgagccagcggacaagactgcgaggtgatggctgatgctagcagagtccggccaggctaggggnagggtgctgctcctggtgctgctgagccgcatgagccctagtccgcggctgccggtcgccggccagtcgtggggccgggaatggctgctaaggtcggagtggcgcgggcgctcggcgctgggcatgccgggtagagtcctgtccccgcccctcgccttgcggcctgatcgccggccgtctgctgcccggggaccggagcggtcgggccgcctttgcccaggacacacgctctggcgtttgttcctttgggcgtgacgccagcttcaacgggtacgcggttttcccgacgggtgctgatctccgagtcgctgttgtcacgcggactgctgtcctccagattcaggccggtgggtctggggagcccggattggtcttggaggagcaacggtctgcgcaggtgactcggtggcctcaagtgtgtaggtacctgg

SEQ ID NO: 607365 - DNA, 179 bp, Homo sapiens
  misc_feature (54)..(55): n is a, c, g, or t
  misc_feature (136)..(136): n is a, c, g, or t
  misc_feature (175)..(175): n is a, c, g, or t
acatgtgactttgctactgaactccttcatctcctggcagaagcctctgcccannccctcaagggctgcaggccagttctcatgctgcccttgggtgggcatctgttaacagaggagaacgtctgggtggcggcangagctttgctctgagtgcctacaaagctaatgcttggtntaga

SEQ ID NO: 607366 - DNA, 353 bp, Homo sapiens
gttgacctactatgtagatgaggacctagtatacacatctgtacacaacaatgtggaagaatacaagtcgtgactgagtacacgagatcttcatgagataaatagtaccatcaaatgtattccctctaatacttaatttcaaaagctactagtctcaaattcactaacctgagtttcataacttttaatgaaacatcaagttaaattgcagggtatgatccactaggggctcataaaattaacttacagggtcctgaccagtagtagattgtaagtagtaagcataagcagtttactaaaagttttgtttcatttgatagatatatgtatgtgtgtactaggtttgtaatgaa

SEQ ID NO: 607367 - DNA, 146 bp, Homo sapiens
gcataagtataatcaggtactagagtagtcaatcatagaagagatagaatcgtggtatctcagtggtgatgtgtgggaagaaggaactggatgtgtaaacttgtttaatcatgtgagtactgtgaattttatgtatccacaatgaa

SEQ ID NO: 607368 - DNA, 755 bp, Homo sapiens
gcccactggagaagccccacaacggcctcctcttcccccagtcacggcggactatcagtacggccgcaacaatcagtcttaagcagaccacttccaatacagccggcagagctacccaaactcgtacagtttgaaccgctatgatgtgtagagctccaaaggacacggaccagactgcttcggtgacatccttccccggtcgccccatcagcaggtatcagaaacttctgacaatcacgtgaatgtagcaacccagctcgagggtgacggtgcataagctctccatcatgataagcccgtggggttcctggttcccccgtgagccgccggaggatgcgttgcctgcagtgcatgacggccgtgagctctgggctatacctaaacagatgaccagttgtctcattgctctttctttcctggatgtctgtcgatctgagtggccgtgttccctgcggagatcttggccacgttgtacctttccatgtgcgaacttattccccatgccatgtgtatctcagagcacttgtgtctgcattccagataacattcaggacctgtgtgaaaagctggggtcactgtgtgctgtagaccatgaactgtccagtgcgtggtgtccaccggcggctgcttgagaacgtcagactggctagtctaatgccctggcgcagatcgcataggaccacagggtcaccagccaaaggaagccggagatcttcaactccccgcacaatgatccatctggtacccctagtcca

SEQ ID NO: 607369 - DNA, 1570 bp, Homo sapiens
gttgcgtttgttcgtgttgctcgtgttgtgttggttttctttgtgggctgtgttttcttgttttgttgtgtggtcatgtgtcgttgggtgcaatggggtgttgttgcgttgtgtgtgtctagttaatttttttgggtgcgttgtgttgcttcgcgggattgtgtagcctattattgtggttgattctacgctcgtgtcttattgtgtgttgtcttctggtgggtgtcttgtttgtgtgtggtatggggtgtgtgggtttcttgtctgcgttgggagagggctcagcgtctcgtttcttgcttttgtgtggcgtttaatgtgttttgttggggtcttttccccgatgggtctactggcttgtggtcgtctgcttttcttgttgacggtgcggcgagaggcgtctcgtggaggtatttatgcttgtctttgttggtctcttgttccttgccgcggggttctttcttttcctgtggagggtgtggtgagccgctcttcgttggtctgaattttattagatgtttatgcgatttggcccttgtgtcttaccccacggcacgtgctccaggggttgcatgatacctccaaatatggagtcgtcctcgtacaaatttgatgatttttggtgctcttattctgtttatgggttacgtcgactataggtggttttcggttccacccacatgagatttaatttttctaaatttctgataagcctgaagcggttcattcctttgtgaactactcacatgtgcattctcccgatgttgtgttctccacagcgtttcttccacccacgggtgcttgtatgtgcttcacgggttgtgagatgggcctgcgtggccttggctgcctcacggcctggatctacttaggaagagctccacggttctttacatgaagtgtgtttttctttggtttcttctgttttccaactaaatatttttttctaaataaatattttcaacaattgatttgaaaaatttgtcaggattatttcaacttttcacatttgttatctgaaattcctatttcctgttaacataggaggtgtgtgcagactttattaatgtgaggaaaagaaatgctcaattgaaggacatttccctgttttctataaagcaatggttgaactcattttctattttgttatttctaaaaggaactgcataccaaaaaaatgcattctttctattaaactgtgagaactacaaaaactactgtttccctttttgtcttttctcctaggaatctcaaagctaaatataatgtttaatttttgttacaatcctaggtacctttatgattatttggttccaacctaatacttttcagtttccctgtttactttaaatatgttttaataccataacattgaagccacttcaatttgtgtttgtaacaatatggaatttaagttaaaatcaattaacaaatcatgactccatatcataaagaatctggaagatgttctttgtaaaatgagtgaaaataccagtatttctggatgtaaagaccaaattgtataatattgcgcaatctctaatgttaactttagtaaaattctaatcaa

SEQ ID NO: 607370 - DNA, 875 bp, Homo sapiens
  misc_feature (94)..(95): n is a, c, g, or t
  misc_feature (99)..(99): n is a, c, g, or t
  misc_feature (246)..(246): n is a, c, g, or t
  misc_feature (298)..(298): n is a, c, g, or t
  misc_feature (300)..(300): n is a, c, g, or t
  misc_feature (324)..(324): n is a, c, g, or t
  misc_feature (453)..(453): n is a, c, g, or t
  misc_feature (455)..(456): n is a, c, g, or t
  misc_feature (458)..(458): n is a, c, g, or t
  misc_feature (515)..(515): n is a, c, g, or t
ggtcgcaactgcgtagaggcttcgcggcctttctcagatactgaggaggcttgaacctgtgggtgggaggtgaagcggaacggtcccggcgganngaantgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggngtcgcagggaggtctcgtggcggcgcgtgttgggtctgcgtttcccctctgngngtcgcttgggcagcatgagcccangggctgtggacaggcctggtgctcacgggttctgtggctccacagacttcccaagaaggacaacccgaggcgaggcttgtggctggccaactgccagcggtggaccccagcggccagggcctgtgggancnngnatccgagtacatctacttctgctccaaacactttgaggaggactgctttgagctggngggaatcaggtgggcctccctgccggccgacgcatggggtaggatgtggggctcccggacggacctgggacaggtgcagggtcatggaatgtccacttgaggcaggctgacgtccaaaggggcgctggtattcctgtacccgagcatctgaaccagtgaaagccagcacccaggatcactggagcctgtgacacaacggggaaaagcagtgagcctttccagaagagtactctttcaaaaggcccagtcttggaccagtaagtcccgcgagtgacaagacattctatctgggtgggtaagcccatgtgggataatgccgggcttccagaaaccctggactgtgacgcagtctggggggaa

SEQ ID NO: 607371 - DNA, 817 bp, Homo sapiens
attaaagagattgtctagacagattttttttttatcagataccacaattgagcacgtaagaattctcaggagggaggaatatcttaaagatttcaacctggaattctctgagaaaaggaaaaagaaaaatcatatgattaatcttgttttcatttgtttttaagccagactttttagcttcaaattaatactgattagataacaaaatcatattttattattataataatagttgtaccttttgctattccatttcaggactcagacgtctactaagtaaacaggaaactgggactgaattcagtcaagaacttagacagcttgttggccttttaagcccaatggtctatcaggaagtagaagagcaggtattaagttacaaaaaaaaaaaattgcatgatatttgctgactatattaaaccttagttttccttaaatgttcctcactttctttctcttaagatttcaagcaaaatacccccaaaacagaaatatctttaaattttttactcaggaggttgaggcaggaggattgcttgagtccaggaattggagactgccctatgatcacacccatgagtagccactgcaccccagcctggtcaaaatagcaaaaccccatctttaaaatataatgttacaaaattgtatctctccgccattcaatctgctggaaaacataatttcaatctcccatttacatctgtttataaatactgccacatcagtttcattcatcatttctcatgaaagccccatctctgatgtttatcttcttttatctataagctatttaaacttttaaaactgtttttcc

SEQ ID NO: 607372 - DNA, 836 bp, Homo sapiens
  misc_feature (94)..(95): n is a, c, g, or t
  misc_feature (99)..(99): n is a, c, g, or t
  misc_feature (246)..(246): n is a, c, g, or t
  misc_feature (298)..(298): n is a, c, g, or t
  misc_feature (300)..(300): n is a, c, g, or t
  misc_feature (324)..(324): n is a, c, g, or t
  misc_feature (453)..(453): n is a, c, g, or t
  misc_feature (455)..(456): n is a, c, g, or t
  misc_feature (458)..(458): n is a, c, g, or t
  misc_feature (515)..(515): n is a, c, g, or t
ggtcgcaactgcgtagaggcttcgcggcctttctcagatactgaggaggcttgaacctgtgggtgggaggtgaagcggaacggtcccggcgganngaantgcagtcgggaaggggaggacgggaagtctagccggcttggacccgccccactctgttacctgccagatgacgctgaggaaactgcttttcttctcgaggcctccgttgcctcgtctgtgcccgggcggtggtgcttacccggcggngtcgcagggaggtctcgtggcggcgcgtgttgggtctgcgtttcccctctgngngtcgcttgggcagcatgagcccangggctgtggacaggcctggtgctcacgggttctgtggctccacagacttcccaagaaggacaacccgaggcgaggcttgtggctggccaactgccagcggtggaccccagcggccagggcctgtgggancnngnatccgagtacatctacttctgctccaaacactttgaggaggactgctttgagctggngggaatcagtggatatcacaggctaaaggagggggcagtccccacgcatatatgagtcttctccaagttgcgccggacaagcaagaccaaaggacacagttacccagctggccccctgaagtcagccggctcagacgatgcaggaagcgctgtgtccgagggccgagggcccacaactccattttctccactccacctgctgatgtcacctgctttcctgtggaacaggtctcagatctgccagtttggcggcctcccagtctgggaggctgaagcctggccttagcagccccttttcagagctactgggcccttgggtgc

SEQ ID NO: 607373 - DNA, 91 bp, Homo sapiens
tgtctgtgcaaggttcacagtcagctgcaaggccagggtgcacactgcagacacctgtgagacctgtggatgccgaggaggaccaaagggg

SEQ ID NO: 607374 - DNA, 526 bp, Homo sapiens
tgctgcttgagtattgttgtctgcctaatacagtctgcagtcgtggttggttcgttggctgaataaacatgggagcggagagctctggagaaatacagccatttactggctgtggaaatctcaagttaactactctaaaatcgcttcgattataaaatttagacaataattattaaaatgtcattgatgagttcctgggtaatgaccaaacacctgtcatttcacacaaatgcgttgggaatgtcagaaagagagctcctgcccttaatttagatgtaaaccattgagtttcagaactaaccacctgataaaatctataaacttttgatcattaactagagcagatgtctgttatgtgatgtcaatgttatgtgagttgacgtgtacagtaagtgaatgcatatcaattaatcctgctaacaaatttgacacttaaggtgatgctgaaaatcctttacacttaaagtagatggaatcttaagtatgggagccttgagtgtccggaaagaaaagctgcatgcgacaa

SEQ ID NO: 607375 - DNA, 211 bp, Homo sapiens
acctcgcttagatgctccgcggacgtgtgggtctaggtggacctgcctgcctgtgttgacggcgctcctgttgatgagggcccagaccatcctgccaaatgtgtctagagcgagcacgtagtgttggggacgacggacccacttctggccacacgtgggaccgagggacacgatggggccctgcggtcccaataggcttgcctgaacggtg

SEQ ID NO: 607376 - DNA, 142 bp, Homo sapiens
aggaggccgaggacggcggcgatgaagaggaggaagaagaggaagaggaggaggaaggaatctccgctctggacggcgaccagatggagctaggagaggagaacgtgtttctcgggggcggtcgactcgggcccgatggagg

SEQ ID NO: 607377 - DNA, 244 bp, Homo sapiens
tgctctaccggatctttatgacgagcttacacaatagcttttatagtaagataactctttacggactccacttatgactcccttaaagccatgtcgaagccccatcgctgggtcaatagtacttggcgcagtacttcttatgaattaggcgggctatggtataactactgcctcaacactcgattctcaaaccccctgacaaaaacacataggccttcccctttccttgtactaaatccctatg

SEQ ID NO: 607378 - DNA, 196 bp, Homo sapiens
gccaggcgggacagagcagggctcatctcaaaaaacaaaacaaacaaaaaaaggaaaaggaatatatgtaccattttcattttaattttaaaaaatctttctaggccaggcacggtggctcacgcctatagtcccagctacacgggaggctgaggcagaagaatcgctggaacccaggaggctgggcgtgcagggg

SEQ ID NO: 607379 - DNA, 121 bp, Homo sapiens
ctactggcttcttcgatgacgtattctgctgcactgatataaccattgcatcctgtcaaagactcggaatgcctcacggatttcttcttcactctttatttcatttattcgaaccaattag

SEQ ID NO: 607380 - DNA, 129 bp, Homo sapiens
gttacaagattccatgagtcggaatctggagaatacagtccagcactgggcctgctctgcccaggagacatttggtgacacagatgcacaagcgctagacgtggggcaaccgctcttaccgagaccgct

SEQ ID NO: 607381 - DNA, 509 bp, Homo sapiens
gagaggatcccccggaagcacacgcaacatattatggcatttatcctcaatgaaaatctgtccagagtcctttgattttgggaatatcctgtaaacaatcaaaccaccagaacatgatgtacaacagtaaaagttctctggcattaaactgaagatatctgtttaataaaaaaagaaaatgtaggaaaggtacttagagctcttactttctaagtacagaacaccctagacaatgtcaaggcatcttaatctccatcaagaacaaaaaaaaaaataattttggtcatggcggtgaaatcgatcattagggataaaaggggggcaaatgggtcaaagggatccaagaaacacggatgtccacgcgggcatatgggcaactaatacgtcaacggggggtcactagagagtcaaaaagatcttccctttcttctggtccttttccagggttctggaagagtccggtggtcctaaaatacgtggtggagcttcccagttggctttctcatcct

SEQ ID NO: 607382 - DNA, 410 bp, Homo sapiens
  misc_feature (191)..(191): n is a, c, g, or t
  misc_feature (301)..(301): n is a, c, g, or t
cggtctcttactataatgccttggagaaagctcgtgtagagaaccaggatcttcaggtacagctgggtcacgcactccagcaggcggcggaccccaatagcaaagggaactcgctgttcgcagaggtggaggatcgaagggtggcaatggaacgccagcatcaacttgatgaaagacaaataccagtcacntgaagaagcaaaatgcgttcaccagagatcagatgaacaagatgaagttacaaatctccacattgctgaggatgaggggctcgcagacttgagtttgaacagcaggagcnggttgtttgccatgatagaacagaagaatggtgaaataaaacaccttttaggggaaattaataaactggagaaatttaagaacttatatgaaagtatggaatcgaggcc

SEQ ID NO: 607383 - DNA, 412 bp, Homo sapiens
ggcacgaggtgtgtgtgtgtgtgtgtgtgtgtgtgtatgtgtgtgtgtgtgtattcaggcacacacttaggaaaacactaaacaaacgaataaatatattttaaaaatccattgttttgatgagtccttgcatgacagggagctctttaactgttgtctgtgtattaaaactggtttgtgataaataatcttcacatggttactcaacccaacagaattcaaatgatttcagatttgaatgtgctatcagggcagcagcaggaaaggcaatgctggagcgatggctcagaggttaagagtgctaactactcttgctgaggactgaggtctggttcccagcacccacaaggtggcttccaattatgtataatgagttctggagagtctgatgtcttcttctgtcttccatggg

SEQ ID NO: 607384 - DNA, 153 bp, Homo sapiens
gagagatgcagacaaagtaaacaatgaaggttgttttataaaggtgatgaccattatagagtcagaatggagtcgttgcaggatttcctttgagttgcttcttccactcttggatcttctcgcctactgcctctctcgtgccatacaatacca

SEQ ID NO: 607385 - DNA, 877 bp, Homo sapiens
aggactttatggactttctactttcaaggatgctcgacatgcagcagaaggagaaatatataccaaatgaatcaaaaaatgatgaattggtcagctggctgattatgactggacaagtgtctgagccagatgaagagctagtggtctattataatggacacttataaattttggagaagcatctttcaagtgttcactcattgggccttggacaagttgctcagacagcttgcatgtcagcctgccagcatcctgtcaacatccttaatgcagatgcttactggccagtgaggttcaacaccacacataagcatgggagctgttcagcagtttaacttagatgtcatacagttgtcgaatggttggccagctctgagcttgtgccaggattccagggggataccctgcagctagcattcattgacctcagacaactcctgtgacctgttaatggtgaggaatggtctacttacctagctgatatgggcagcaaggttcaaagtaccttcgggtgaatcaaacaacagcctttactctttgggagaagatgacaggctactagccaacaaaggaacaatatattggctccagtccaggaaagaaatgatcgagacaaacaggacagtggataggacacacgtcggaaaccagtcggaaagctggtggacggtaaggtcccagcacatgtaagacctccacatggtggctcagtgcagccaactcactgtcaggtgactgaccacagatggccgaacacggaatggggtacgatccacaatacatggaagaaactgggggtcacaaacaggacaaaacaatgggggtaaaaccgcaatcatatcgaacgacttccgaggagagcgcaggcaacagcaca

SEQ ID NO: 607386 - DNA, 727 bp, Homo sapiens
  misc_feature (727)..(727): n is a, c, g, or t
cgcggtggctcacgcctgtaatcccagctctcagggaggctaagaggcgggaggatagcttgagcccaggagttcgagacctgcctgggcaatatagcgagaccccgttctccaggaaaaaaaaaaaaaaacaaacaaaacaaacaaaacaacactgtgtggcggcgcgcgcgcccgcggcggcccctcggaaaagacgcttcttatagacacaccatatcgcggtggggcgcgcgcgcggggcgcccaaggaggggcaaaggggaacaacgtggcgccataacagagcgggtttccctcgagaggagaacacccgcgggccacgaggaccacaaagagggcgagggatattctcccaccacaataaaaaaaaagcgcccggggggggaacacccgcgaaggttttcgcgagaaacaaatccaccaagagaagggagacaccagcgagagggagcaactaaagggggggggctctatatcaacacaaagggggaggtccacaacagaggagagagcgcacccagggatatatcacaaaaatatataggccccccccggcccactgctgggtgggggcggtcacagatcacacacaatcacaagacagtaggaacaactaacaacagcaagcaaagacagcaacgaaacacgaaaacctaaacaaagcgcacaaaaaacccagccgagactgcatagacaggatcaacgacaacgaaagccacgagcn

SEQ ID NO: 607387 - DNA, 105 bp, Homo sapiens
ggtactctaaggatccccatccacgtacattgtgaactttgggggatagtcgctccaacgactgctgtacttcaccgttccagtttttacatactgagtcaatgc

SEQ ID NO: 607388 - DNA, 597 bp, Homo sapiens
  misc_feature (243)..(243): n is a, c, g, or t
gtcaacgcagcagcacctgaagaaggtctatgcaagttttggcctttgtatgtttgtggcggctgcaggggcctatgatccatagtggtcagcctcattgtcattgcaggctggcgctgctgtcgtgccttgcggcgtcccctgatattgatgagtttggctgagtggcgaacaccgtcgatagccgatggaaactgtaactagaaacagactgggcacttgcttgctgtgatttgcgattcncttacaggcagttggcctgtggctcctgccccttggcagttttaggtattggctgtctaaccccagtcatccttcccagctgctttcagtgggtcacggcaagtgatctttatcctgcttcaccctcagtgcactctatgccaggcagccgtagctagccatctttctgggaggatatcttgatgtcagccctgagcttgtgcgctttctgtcttcgcctgtgggaatcgttgttcttctgtgcatccattctcggctttttccagcgcaaacgctgtattgtggcggactgggtgggtcactgttgttgaggcttacgatcccttttttctcgtatttaacttctaaactttc

SEQ ID NO: 607389 - DNA, 232 bp, Homo sapiens
gtgtggccagatctatgcacatgaattagtgactccctaacatccggttcaggtgatttcctaaaaaataaagggtcgcaaccacttccagattcagatgcgagaccgacacagacaccacgacgagcaccaccagcacacggaatcgcgtcaccaccagtgtcatcggatgcaggggtagctgggatctctcgtgccgcagagtaaacataacgttcaaaaggggtggccg

SEQ ID NO: 607390 - DNA, 104 bp, Homo sapiens
  misc_feature (59)..(59): n is a, c, g, or t
ttcccgtcctacatcgtgttggtatagaatggggtctcctcctccggcggggtcgaagnaggtggtgttgaggttgcggtctgttagtagaacactatgtagga

SEQ ID NO: 607391 - DNA, 337 bp, Homo sapiens
tctcttcacgattccccgcgtttctgccactgtttccccgccttgcagccgactttgaatctggtgctggatccatggtaatccgcactgttgaattatagtacaatacgcatcgctgacagcgctcgcggcgggtgttgacgcgatttgatttctgcccagtgctctgaatttcatagtgaagaatttcaatgaatgcgcgggttaactgcgcgagtaactatgactctcttaagcgttactcaattcctcttcatctcacttcgtgacgctctatcaaattgattaactagattcccactgtccctttcctactattccgcgaaaccacagccta

SEQ ID NO: 607392 - DNA, 125 bp, Homo sapiens
tggccggcacgttgcatggtggcctctatatataatctgaagttatatatcctgtaaatttaaggtgccattattaatgcattgtgataatctcatttacggtccggccactacgtgtccggcca

SEQ ID NO: 607393 - DNA, 344 bp, Homo sapiens
acctcatgagcgagttccctacagcatcatacacgctgctgcccgtgcgcatgcgggacggagggctcagcggggtgctcctgtgcgtcctccatctgggcatcgcccatggcaccaacgcccaggaccagttcctgttgaagcagattgtttccaatgtgctcattttctcctgcaccaacattgctgggtgtctgcacccactatgcggctgaggtctcccagagacaggctttccaggagacccgagagtgcatccaggcgcggctccactcgcagtgggagaaccagcagcaggaacggctcctgctgtctgtccttccccgtcatgttgccatggagat

SEQ ID NO: 607394 - DNA, 216 bp, Homo sapiens
ttgtgctgcggtcgctctgacggactcccactggacgaccccaggctgacggactgacgcgctgggaggcagccctgcgggcccttgagggcctggtctacaggagccccacagccactcgggaggtgagcgtggagctggccaccagggctctctggcgcagccctgcaaatcccaccacacaggtcttctcctccagatgcaggggtaccgagc

SEQ ID NO: 607395 - DNA, 87 bp, Homo sapiens
ttattatcctaattggacatttaaaaatacacattttgaaaaatttggaaaatcccttttttaaaattaaaatttttaaaatcttca

SEQ ID NO: 607396 - DNA, 359 bp, Homo sapiens
gtgaattttgtactgcagggagatagcacctcctccttgcagtacaaattcaccaagagcctagagagatgaagagagatgccaggaagaagagagacgccaggaaacagaagcccacagctggcagagctggggcctagctgtggtcactctggagcctgccccgtggtgtttttatgagtggtggaaagaacagtgacaatatggagcccacaaaggaagctcaagcagtaacatagcaagagggaagacaattcaaagggaagaggcccatggtcttctttctttttctttgtgatttctactgtcagggaggctccttatttataaagaacatgactgtgtttatctcccaaaaa

SEQ ID NO: 607397 - DNA, 199 bp, Homo sapiens
caacatattcacaattatgagaaagaagtcaaacagctcaggaaagccaatgatattttaaaaaaggtgcatgtgtactataccatgacagatcatgctaagaatagtacactgtaattcaagatttggatgcgaatgctatcactgtatcttctgcctcgttaacatgcctagtgtattagactacttcgggtctact

SEQ ID NO: 607398 - DNA, 414 bp, Homo sapiens
  misc_feature (17)..(17): n is a, c, g, or t
  misc_feature (64)..(64): n is a, c, g, or t
  misc_feature (152)..(152): n is a, c, g, or t
  misc_feature (161)..(161): n is a, c, g, or t
  misc_feature (200)..(200): n is a, c, g, or t
tcacctttgaaggtganaaaaagctgttccctataccgtgacccactacccctgccccggtatnagtgttagagatttcagggtgtatgtgtgtgtgttttgtttgtttgtttttgagatggagtttcactcttgtttccccaggctggagncagtggcanagtctcagctcactgcaacctctgcctcccaggttcaanaattctcctgcttcagcctccccagtagctggcattacaggtgcccaccaccacacccagctaattttcctatggtttagaaagtaacccttaaaatataatagccaggtgtggtggagcatgcctgtaatcccagtattttgggaggtagaggccaggagtttgagaccagcctgggtgacacagtgagaccctgtctctaccccccttaatt

SEQ ID NO: 607399 - DNA, 293 bp, Homo sapiens
actctagaggaccttatttctgcaccacagccactactgactgcagcagcacaggtacagagccacaggacccaagaatgagcttacaaagtggctttccaggcctgggaagctcctctcactcttcagtcccttctactgtcctggctactaaatattttatgttacatacagcctgaaaaggacttactggctatgcaacgggtccctttaaagattttctgcttgaaagtctccccttgggaaatctggcatgagcacaaaattatggtaatttttcacctgagaagatt

SEQ ID NO: 607400 - DNA, 627 bp, Homo sapiens
  misc_feature (28)..(28): n is a, c, g, or t
  misc_feature (67)..(67): n is a, c, g, or t
  misc_feature (73)..(73): n is a, c, g, or t
  misc_feature (76)..(76): n is a, c, g, or t
  misc_feature (83)..(83): n is a, c, g, or t
  misc_feature (98)..(98): n is a, c, g, or t
  misc_feature (100)..(100): n is a, c, g, or t
  misc_feature (114)..(114): n is a, c, g, or t
  misc_feature (118)..(118): n is a, c, g, or t
  misc_feature (122)..(122): n is a, c, g, or t
  misc_feature (126)..(126): n is a, c, g, or t
  misc_feature (148)..(148): n is a, c, g, or t
  misc_feature (153)..(153): n is a, c, g, or t
  misc_feature (155)..(155): n is a, c, g, or t
  misc_feature (196)..(196): n is a, c, g, or t
  misc_feature (199)..(199): n is a, c, g, or t
  misc_feature (202)..(202): n is a, c, g, or t
  misc_feature (233)..(233): n is a, c, g, or t
  misc_feature (241)..(241): n is a, c, g, or t
  misc_feature (270)..(270): n is a, c, g, or t
  misc_feature (293)..(293): n is a, c, g, or t
  misc_feature (304)..(304): n is a, c, g, or t
  misc_feature (312)..(312): n is a, c, g, or t
  misc_feature (586)..(586): n is a, c, g, or t
ccttcattttctgtccagttgacggcantttctgcttttggatttttaaagacctgtgctatgtacngtggtnctncatcaantgcccatcgttcacngngtgggggtgaaaangtcngtgnggcngcttctcgggtaaatattttgnccccncnctgtgtgtccctgtttcctttgccccaaggggaccacaccnganggnggggcccatacttgggaggggtgggggggtnggaaggcngggcgattggttctttttctaaatgggcncgggttccacatgctatggcgcntttgtttgggncgagggcngtgggtcgtttggccccttttctattttctcagcatctggggactttgtggctccatcggcgtctgccatagggctcttttctcctcgagaactgaatatacccattctaatcgctccaccttttccacgattcttcaccagggttatcacacgtactttgtcacttccatatttctggcaatatttaaaagctacctttgaggtctgatctttactgccatcatcaactactatcacttcataagtaaacgcaggatctcgtttctgtctctnctctagatagctcagagcttcatccatcatcacaggcaacc

SEQ ID NO: 607401 - DNA, 549 bp, Homo sapiens
gaggaccacgcaggcctccctctgcatgaggtcttgctggaacaagccaaggttgtctggcaattccgggtgacagaagattaggataagtggccagtgacttctgataagacgattggaggcagaagtgccgtgtatttgaaaatgggcaagaataaccaaagtgcactgttatatggaactctgagctctgaggcgcctcaggacggggagtctacccgaagtgggtactgtgcaatgatatccaggataccaaggggtgcttttgagaggaagatgtcttacgattggtcccagttcaatactctgtatctccgtgtacgtggggatggtcggccttggatggtgaatatcaaggaggacacagatttcttccagaggacgaatcagatgtatagttacttcatgttcacccgcggggaaccctactgacaggaggtcaagattcctttttccaaatattacttctctaatcgaggaagaatccgggatgttcagatgagctccggttgaaagatccatcataggatacaccttgctgtgtccgat

SEQ ID NO: 607402 - DNA, 422 bp, Homo sapiens
  misc_feature (42)..(42): n is a, c, g, or t
ctgcactccagcctgggcgacagagtgatactctgtctccanaaaatatatatatataattttatttattcatctgtgtatgtacccacctaggtggttctcacaatgcaggagaggagtacaagttaaaagccgggcacaggccaggcatggtaactcaacgcctataatcccagcgctttgggaggccaaggcaggtggctcacgaggtcagaagatcaagaccatcctagccaacatggtgaaaccccatctctacgaaaaatacaaaaattagctgggcatggtactgcatgcctgtaatcccagctacttgggaggctgaggcaggagaatcgcttgaaccagggagtcggaggttgcagtgaactgagattgcgccactgcactctagcctggtgacagagcgagactccgtctca

SEQ ID NO: 607403 - DNA, 629 bp, Homo sapiens
tagactcgagctgagtacccccctagcgagctaccgggtactggggctgaagggactcacgtgaggatgatcaagtcctccttgatgtacatgagctgctccacccctgcggactcagctcactgaagtctttccgaagaatctcgagcgccttctgcaggaactgctgcatggtgtagccctttctcatcttgactgtccgccggttgcccagatgccttcccagtagctgaaggtgatctcgatctcctcactcttgatcttctccttgcttggattcccactcctgccgcagttctttcccgaagccgattctcctcctcctcatggtctcgatcaggcaagaagcttgtgtcaacgtctgggtccttccccagttttcctcttcttcgtggtgatctcttccctttccaatctcctcctcatacattggccgcctcctcttcctcctcgcctccctcttcttcctcctccagggtgaaggccaggctggagatccttccgcttgcgtcccttcttacgctccttctctcgaagcttctccagctccatctgcagctccttggactgctccttcttgcgcagctgcttctcacgctccttcaccagagcctcccggtaggggacat

SEQ ID NO: 607404 - DNA, 108 bp, Homo sapiens
  misc_feature (52)..(52): n is a, c, g, or t
aatcagctcggtaccccagttctaatcatgttggaatcaaaaacactcctanagattacttaaataaaaaaaaaaaagtggaaaaagcacacctccatgttttgcttt

SEQ ID NO: 607405 - DNA, 305 bp, Homo sapiens
atgacttatgtgttaagaagaatggtggctcagagatgaagaagggaggctatgacaaacagaaatttttaagacagggtaaatgaagttcattgttattgagaagtcacagtaatttatattaataggaaaaacattcttgaaatttaaagaaaaaatgtgaaactaaataaaatgttgcaaaaattgagtttcaatgtcttgaccctgtgtagtttaatactttctagtaaagtcaaatacaggaagtccttgctttgcatggccccaattagtgtgattttgaataaatttttttttcactt

SEQ ID NO: 607406 - DNA, 312 bp, Homo sapiens
cccccgaatttttaattaaaaccaaggttttccagggtttgccccctttgggggccgggaattgggaaatttccaccccctttggggaaaattttttaaagccttgggaaaatttttttattccccgggggggggcccgggccgccctttattttaaaaaaaaggttaaagggtttcccccccccccccccccttttttaagggggttttttgttttttttttggggggttcagaaagttttacgggtttgggggcaaggttttttgccttttggggctaaaaaaaaaaaaacccccctttttttggtttga

SEQ ID NO: 607407 - DNA, 103 bp, Homo sapiens
tactttggtgaatgctgacggcaaacattcatctccaagagagacaagagtgggaaagttgctgagacaagaaagcctagggaaactttagggctagatacaa

SEQ ID NO: 607408 - DNA, 864 bp, Homo sapiens
cctatgaaggtaatgtactatctcctactccaataggatgcttacgcttgcctcgaaatgtatgtgtacaaaaaggagactatacataaggtatcatcttgcgcgggactagaccttgacgtctatgtagtgaacgttcgttcaatcctccacgccgtactccggcgcatgcctccgagtggcagggcatcatacgttcacattcaaagatacgcaattcttataatgttgaccagtatatcatttggggaactcgttctagacccttcaaagatgtacctaacgatctatggacgctcgaggtctcaacacaagtcagtccttagtccttcaatgtcaatcctgctttgtatggttgcgtagccgtagctttgtggaaagccacgctcaccaaatccaggttgattgccaaactcgcactctttccagattaaggttgctggtactcgagacaagtttacaagggcgatttatcgtgcgcatagcctaggggggagttataatggcaccacataataggcaatatgggaacgaggcatttgtggacgtgtgcggaaaagggacttacttgggatggtcaaatacccatcaacccccgtggagaaatcactttttgcgccatctctcagacgggcttgaagtacctgaaataatcaggatcgttgttggaagatggtttccaaagagatccagttaaataactgcgcagtttcactcttgtttcatctagttccccacttgaccatgggtcagcaattaggtattacatttgtattaaacttggactattcccccaacacatggtttcttatctacgccccgcaataatgcactatataaattgaccgcctagcaagtatgcga

SEQ ID NO: 607409 - DNA, 871 bp, Homo sapiens
cggtcgcggaccccaagtgagggtgtttccagcgccttcccttgtgtctggtggcgcctccttggtttcccgccgcccccccagcgttgggggcccctaccccaggacccggaaggtcccttgtcctctgacgacgcgccagcttgtcctttgggtcctcggctgacgctccccatcgcttgtggtccccgcgggggcggccccaaaacgcgccccttgtgggggctcctcctcccggggcggtcttattgcccaacgtgccggcctcaatcgcatgagcccgcaatggttttgtcatctccgcaggagcctggagacaacctgctccccatgtcaggggcaccccggtcacccctccagctcggtgcccgcccccgcggcgcccccttccgccctcagttgtgacccgccggtgcgtttttttccccccagggagcccccctccgtcttccttggaggcacataggatgggccaccgccccccttttggaggtcttatctaccgaacggccacccaaccctttcccgcccttgagtgggtctgcgggagccaccttcttctgcccccgcctgtgttctgctcctcaatccccccgtttctgtctttcttcatgaccaacgggcccactctcccacgagttctgagatgtttcagggccaagttcttctttggtagtacgcgatccaggaatatctcccccgtcccgcccctgcgcggtgcccccccccgtcaccccccctcggtccgttggtcgtcgacggccccaccgctttcttttgctggcgaacgacccggccgcaccctgggtcgcgtagagccagctggcccccggccccccctaaaattcttgccaagcctctcccacaagac

SEQ ID NO: 607410 - DNA, 224 bp, Homo sapiens
  misc_feature (40)..(40): n is a, c, g, or t
  misc_feature (83)..(83): n is a, c, g, or t
  misc_feature (105)..(105): n is a, c, g, or t
  misc_feature (126)..(126): n is a, c, g, or t
  misc_feature (180)..(180): n is a, c, g, or t
  misc_feature (182)..(182): n is a, c, g, or t
gcggtcagaggctgaggccagagaggtagcagcggaactnacagggaggccaggggcagagctgaccctggagagggatcctnatgtcctagacacatggttttnttctgccctgttccccttttntgccctgggctggccccaagagaccccagaccttgctcgtttctaccccctgtnanttttggaaacgggcagcgaccttctgctgttctgggtgggcc

SEQ ID NO: 607411 - DNA, 646 bp, Homo sapiens
  misc_feature (481)..(481): n is a, c, g, or t
ggaatacagctaaccaaggaggtgaaaaatctctacaaagagaactacaaaacactgctgaaggaaatcatagatcacagaaacaaacggaaaagcatcccctgctcacagactagaagaatcaatattgttaaaatggccacactgtccaaagcaatatacagattcaatgttattcctatgaaactaccaagtcagttttcacagaattagaaaaactattttaaaattcatatggaaccaaaaaagagcccaagtacccaaagcaatcttcagcaaaaagaacaaagctggaggcatcacactacctgacttcaaactatactataaggctatagtagccaaaagagcatagtattgattttttaaaaatagacatatacaccgatggaacagaacagagaaccccaaattaaagctgcacacctacaaccatttggtctttgacaaagctgacaaaaacaagcagtgggaaaagcanctcctatttgataaatggtgctgcatatggctagtcatatgcagaagaataaaactagatccctacttttaccacataaaaagtaactcaagaagattaaagatttaatgatagatctcaactataaaaatatagaagacctagtaccctctcatattgcatggt

SEQ ID NO: 607412 - DNA, 325 bp, Homo sapiens
atgatatatcacgcgctgaacgctatcatgtgcctcatcaactactggtcctcgctaatcaagagcacgagtccagccacagatgcaatgctatcaatgaagtaacaaaaacgaaaagtgctccattaaactggcaccagttcaatgcttgaggctgggaatgcaggatgtgccaccttaaactcctcacaaagcagattataaaatatgccgcataacgagtttaataataaaagaaaaagtatacagaactaagagagggagaggcatagtgataaggcctcccaagtagctaggaaccacaggcgtgcaccaccatgcctgc

SEQ ID NO: 607413 - DNA, 134 bp, Homo sapiens
ttaaaaaaaaaaaacaaaagaaagaaaagaaatgtcacaaggagccgtaagagtagagctcttttaagggccctggaatcaagtctaacactgattcctttgggggtctcagatcaagttctggcggggtattt

SEQ ID NO: 607414 - DNA, 468 bp, Homo sapiens
  misc_feature (6)..(7): n is a, c, g, or t
  misc_feature (9)..(9): n is a, c, g, or t
  misc_feature (11)..(11): n is a, c, g, or t
cgcacnntntnccgtgctactcgcgctgtgagcattccaagctagagccgagtacacgggccggccatcatgtcacgctacgggcggtatggaggagaaaccaaggtatatgttggtaacctgggaactggtgctggtaaaggagagttagaaagggcattcagttactatgggcccttaagaactgtgtggattgccagaaatcctccaggattcgcctttgtggaatttgaagaccctagagatgcagaggatgcagttcgaggattggagtgggaaaggtgatttgtggttctcgagtgagggttgaactatcaacaggcatgcctccggagatctcgttttgataggccacctgcccgtccgtccctttgatcctaatgatagatgctatgagtgtggtgaaaagggacattatgcttatgactgtcatcgctatagccgacgaagaagaagcaggtcacgatc

SEQ ID NO: 607415 - DNA, 114 bp, Homo sapiens
ttcatgtcgagtgctttcatccctccaagctatctgtccagcgcagtccaccgcctgctcaggcgtgcggctggctgatgtaggagcaactgggggaacgtggggcctgcgctc

SEQ ID NO: 607416 - DNA, 508 bp, Homo sapiens
gtgtggagacgggggtctcagaagaaaaaaaacaacaagaaaaacaagagacagtgatacggtctggtgtgtttggtggtcccagaaatttcatgtttaaatcctaaccctcaaggtgatgatattaagaggtagggccttggaggggtaattagatcatgagaggaaagccctagtgaaggggattcatgcccttataatataggggcgaggggtgctcattcacccttaaaccatggtgaggacacagcaagaagggaccatctataaatcggggaacatgccctcacgcaggcagatatccaatctggcagtgccttgatctgggacttcccagcctccaaaagggtgagaaataatttctgacatatcggtggtatataagctaccaagtcaatagtagttggttatagcagcccaaaaggactaagacggagggggcaagggaaaaaaagattatcggttaaatttctaaaagtaaatcttctgtgaagaaaatgagttataa

SEQ ID NO: 607417 - DNA, 400 bp, Homo sapiens
  misc_feature (354)..(356): n is a, c, g, or t
  misc_feature (388)..(388): n is a, c, g, or t
  misc_feature (390)..(390): n is a, c, g, or t
tgtgggcatggtgtttcccctctctggggtaagaagtacgcccctctcgctgggcaaaagaggaagtggcacccctccccctcacccacagatgctgagatggtagcatagaaatgatggccgggcgcgtgtgcacgcctgtaatcccagcactttgggaggccgaggcgggcggatcatgaggtcaggagatcaagaccaccctggctaacacggtgaaaccccatctctactaaaaataaaaaaaaaaaattagccgggtttggtgcgtatgcctgtaatcccagctactcgggaggctgaggcaggagaattgcttaaacctgggaggtggaggctgcagtgagccaagannngccactgcactccagcctgagtgacagagcanantccgtcaaaa

SEQ ID NO: 607418 - DNA, 359 bp, Homo sapiens
  misc_feature (12)..(12): n is a, c, g, or t
  misc_feature (80)..(80): n is a, c, g, or t
  misc_feature (155)..(155): n is a, c, g, or t
agtagaagtctnggagtgagtccttcacaatgtttgccaaaaacttaagccctttttgaagcctccttgaagcactctgnatttatgaaggaggcactgtttgctaagaccccaccatgtttattgctttcagcacagtaaaatgaaaatgttgnaaatttgtatacatgcttgccaatatttgtgctttagaaattacaataatatttcttgtattggccagaatagaactccgtatcttttaatataatactatttttggctcctggagttaagtcatttgaatatcctgtgcgacatcatagagtcaggtttaccatgacagtttaaaatctgctacacactaatggaaataactt

SEQ ID NO: 607419 - DNA, 394 bp, Homo sapiens
acagcgatatctatagcaaggactcaccccgtataccttctgcataatgaattcattatacataacgtgtcaggatagccaaagctaatatcctccaaagcagacaagctacctcagaacagctcagagagcacatccgtctacgtagcacaatagtgcgaagatagataggttgaggcgactaacctaccgagcctggttattgctggttgctgtcgtgtataatcttagttcaactttaaatttgcccacagaaccctctaaatccccttgtaaatttaattgttagtccaaagaggaacagctctttggacactaggaaaaaaccttgtagagagagtaaaaaatttaacacccatagtaggcctaaaagcagccaccaattaagaaaacg

SEQ ID NO: 607420 - DNA, 425 bp, Homo sapiens
  misc_feature (18)..(18): n is a, c, g, or t
  misc_feature (31)..(31): n is a, c, g, or t
gccttggcctccccaaancactgggattaanaggtgtgagccattgcgcccggtcataaaatcttgtttttttgtttgtttgtttattagagatggaatctctctctcttgacccaggctagagggctgtggtgcgatctcagcccactgcaacctctatctcctgagctcaagcgatcctccttagcttcccaaatagctggaactaacaggcatgtgccatcacgtccagctaatttttgtatttttagtagagaaggttttaccatgttggacagggtggtctcgaactcctggcctaaagtggtccacctagctcagcctaccaaagtgctgtgattacaggcgtgagccaccatgcccagcctctaaattctgttttctattcaaagtaaaaatgcacatgtgtttgagtcaaaaaaaaa

SEQ ID NO: 607421 - DNA, 484 bp, Homo sapiens
  misc_feature (17)..(18): n is a, c, g, or t
  misc_feature (330)..(330): n is a, c, g, or t
  misc_feature (395)..(395): n is a, c, g, or t
  misc_feature (438)..(438): n is a, c, g, or t
  misc_feature (447)..(447): n is a, c, g, or t
  misc_feature (479)..(479): n is a, c, g, or t
tcttttccaatggcttnngtgactcccgtgaaagagtctgttgactccaaagaggtcatgacccacacagtttgagaaccactggtctagtctctttctcataggtactataaatatatgcatacatttttttttctgtaattgaaaagctatttctattcagagctggcaagatgaatctatgaatagaggttcttgctaggcaaacctgataatgtgagactcatccttggagggatataagtgtggaaggagacaaccaactccacaaaactggctttgtatctctacacatgcactgtggcctgagtgaccccctcaacatatatntacacacacacacacacacacacacacacacacacacacacacacacacacgactgctagtggantcaaagtgcatgtatgcttgtacacggacattgggttttatgngacccaacntcttcttctctgtaaagatttgtagctgtttntgagt

SEQ ID NO: 607422 - DNA, 1229 bp, Homo sapiens
  misc_feature (991)..(991): n is a, c, g, or t
cacctgccactacgggtaacacgccggagcacacaggagagcctgacagcaggcggaacagaccttaagagggagctgcaccccccagccacctcccatgaggctcctggcaccaagcggtcaccttctgctccagacagccagactcctctgcgctcttcttctacatcctcatacaaacgggcaccagactagctcagccccacagcctaagcccctaaagcgtacaagcgagctgcagggaacgaagggtgcatcgcacccgaacagggggccatggtgcagaggtctgaagacctgatatgacttcgtttctatctgtggctggcgagaaggaggatggcgcaacgcacgatggagattggggacagtggcttgctggagcttcgcgatggactcacgatcccagctgcctggggcttccagacactggaagcttcacagaagatgccgcagccatctccaccgttggagctacttcacagaaaccacatctcacacagaggcaagcacctgacacctaatgccacctgctgagctcctgggtagtcactggcagagcctcacagtcttcctagcacatggccctgggccatcttaacatcattccgcactgactaagacagtcctgatgggcacctgtccatggcccagagctggatgatcgacctaccgatgcacctgaaattctacaagatgaaccctggttgctacacccaatatggaccacaatacctgggaagacctggaccacgtatgcaccaccgtagccacaaacacattggcacactgtgctcaacgcgagtacgcgctaccctcaatatacgtatgtttggaaccacaccaaagaccagaagaaggaaaacacccagggattggcgacatgtgatatcagactgaggccgcacaccgaaaaacgaacagcccatacaataacggcgcgcaacgcacacgaccagcagatcgctcccgagacacaagcacgtctcgngacgaccaacacatcagcaccagacagacgcaaaccacccaacaactgaggacagacacacagaaacaaagaagcacaacccagcgcagcaagacaacacgcaaaccgacaaaacacacgacgacataccatcacgagacacgcgagcagcccgccaaagtagagcgacacacggcgcgacaccagacacaaaagaacacgagcaccacacagccgcaaccaaacaccacgacacccg

SEQ ID NO: 607423 - DNA, 366 bp, Homo sapiens
agcccttcagcctctcaatcagcgcatggtctttgcttctttcatccaaggatcctcgtataccacaggaagaagaggcttgaaaaccgaaagagtgtggtcttcacctcagcacaagccacgacttaggcataaattcttctcagataccatggatgtggatgacttccttcatgcctatcaggaggcctcttaaatggggtttagggtcttgccagaacactttagggtagtaagcagattcctcctccctgggcatctctagagggggttggccaggctttcattcagggggccttcgagcttccaccttccaaattttgggggggtaagggaacctttttttatacgaaacacaactttttt

SEQ ID NO: 607424 - DNA, 431 bp, Homo sapiens
  misc_feature (4)..(5): n is a, c, g, or t
  misc_feature (44)..(44): n is a, c, g, or t
  misc_feature (70)..(70): n is a, c, g, or t
  misc_feature (94)..(94): n is a, c, g, or t
  misc_feature (178)..(178): n is a, c, g, or t
  misc_feature (252)..(252): n is a, c, g, or t
  misc_feature (313)..(313): n is a, c, g, or t
ggcnncaaaacagcaaagggattcgaaagtaaagttttcaaccnaattatttttcaataaggtaaaattntgaaagtgtcttaaattgtatgtnaattaggggcacaaaaatagaatatttaaactttgtttttcccaggtactttaaaaaaggggcagtagggggcaggcatagtgntcatgcctgtagtcccagtgctttaggaggccaaggctgaaggatcacttgagcccaggagttcaaggctagcntgtgcaacatagtgaaacgctgtttctagaaaaaattttaaaaattagccaggcatggtgnttcatgcttgtgaagctgaggcagaagaattgcttgagcccaggagttcaaggatacagtgagctgtgatcgcgccactgcactctaacctgggcaacagagagtgaccctgtctcca

SEQ ID NO: 607425 - DNA, 792 bp, Homo sapiens
tggaaatggagtctcactctgtcacccaggctgtattgcaggggcgcaatctcggttcattggaacctccgcctctcgggttcaaggtgattcttctgggtctcagcctcccgagtagctggggattacagggcacgggccaccgcgccgggctaattttggtatttttagtaaagacgggatttcaccatttgggccaggctgggtctcaaactcctgaccttgtgatccgcctgcctcggcctcccaaaggggtggggatcaaccagggctatgagccaccgcacccagccccctttggtgattcagggggtgttccacagtttggacggagggaagatctaccttccaaatggcagtgggtgggccccatgaagaacatgctgggttaatgcaggaccagggtgaaggtgaagctgttcatatcaccccaggtctttgacggggaagcaaaaatgttcaaggcattccaggtcaaaccttcccggtttagaaaaccaactcggtggattcttcaacgacatttacctattaggctcatttttaccaagaagaccttattaaccgacaccttttaccagagagaaatccctaaatctagctaatttacctttaatcatactatcctagttcaggtctatttcagttgctggtgttcacactccctggtgtactttccttatggcgggtcaatctcccatgtctgggggatgatgtgtgtactcgggaccatttttcccagacctgtatgttcctcataatgcggtcaattgctaatttcccttccacagg

SEQ ID NO: 607426 - DNA, 1261 bp, Homo sapiens
ggcaaaacaccaaatgtgcggatgactgccggtgcagcgggggggcccggggtgccctggtggccctgggatgtgggaacctgctggtggcttcctgcggaggtttctggcagatggcatcctggggccgtcggtcgcggcctgtggacaggggccgggtgccgtaggcccgtcgtgatgctcagctggtagtgcaaatggcctgctggataagtgagttggattgccctgttcaccaagtatgggcctgcttgtgtcaatgtgacatgacgatcaagtccctggaggagatctatctcattcatccactgcacataagagggacactcagaaggatcagtctgagtattccttaccgtgtggagtgaccttcttcttacaagggaactgacgggtatttagagaggactatattgcgcgacgttgctacgatacggcagggattacctgttgacccgggtccaagaaggccaccccagtgggtttcacacgggcacttagcgatatcgcataatacaggaggagcatcttaaccaagttgggcccaaccggattcggagatactttgggggcttgcgttaaaggttggcatacgccaaacgtgcaagggttggagcacaatcactgacgcaatacacgttatgtgaggtggctcactacaattactcctatgagacgcaatacagacttcttcgcaaatccatggtccgcccgagttgtcgagccaagaaagatagcgtcacattgagtgatgtcgaaatcggaaacggaattccggggcgacacgaccgcgcccaagagggtaggctccactcagtatggaccgaaaggggcttggaagcgagggtgacgctgccttttggacgtgggacatttctttgggagggcgtcgggctaaacagtcgcatttccactttacccgccttttgtacgagccccaatagggggaccacagcatgggcagcaacctacgggtagccttcgcggaacaacgcgctatagtaatgggccgtttcagaggaaacaggcctatcggcgtccactaggaacttggggacctagggactcgtccgggcagtaggaagtttggataacccagcacttcaacgccaacatgggggtccctataggcgagtgtggcgcaaaccgacgttcggggggcaaacggttcgagcccaagagggccaagccactttttggaagtagcccgatcacctatcaaagaaccctttcacaagcggttaccccttgaacaccccag

SEQ ID NO: 607427 - DNA, 876 bp, Homo sapiens
ggacgcgtgggtccggacgcgtgggtcgacccacgcgtgcgattgaactcgagttggaagaggcgagtccggtctcaaaatggaggtaaaacctgacgcccggttcgcccccgagcctcgatctccggccgtcgccagtctgcctgccggggtggaggagggccagtgatccacaaggaaccagagcagttgagaaaactgtgtataggtggtctgagctttgaaacgtacagatggatagtttacgagcaacgattgtggagaaaatggggcacactcacagatggtgctgggtaatgagagagcccccgaaacaaaacggttgccagggtgctgttggtgtatagtgacattatgtcttgtgttgaagagcgtggatgcaggcaatgtgtgcatcgaactacaacaaggttgatgggcgtgtagtggaaccaaagagagctgttatctagagaggattctgtaaatgcctgtgtgcccatctaacagtgaagaaaagtttagtcggtggtattacagaaagatacagaagaatataagtttgagagcactactttgagaaaggtatggcaagcattgaagccatagaaggttatggagagacaggcagcagtgtgatgaaagagaggattggcgtgttgtaacttgttgatgatcatgatacaggtgataaaattgtggtacagtagcatgtatggtaacttcacttgtgaaaggtagaactaggttaacttgtgttgaactcaaatttggtaactggtacctttctggaggcgtgatatgggcatgactaggggaataagcgaagttgcatagtgtttgcctaggtaacaggatcggagtgagaaattaataaaatgtttgaacaaaaaaggg

SEQ ID NO: 607428 - DNA, 408 bp, Homo sapiens
  misc_feature (196)..(196): n is a, c, g, or t
ccgcggtgcatgtgggggcgggctcctttggcaaccccgggcgaacgggcacccagaggctgtgctgagctgtcgcacaggcagcagcatgagccggacccttgcatagggcgtgcccctgtcgagtgccgactactacgagaggctgggccaacttcagcacgggctgtgggacaggtaagggcactggggcggnggtggggagtcgggccgcgccgggggtctttcgcgtgccctggcccaatttcctttccggttccccgtgcgagggttcccggggcccaagcccgcgcgcaacggcccccagagcttccagaggggcctggaggacagagtgtactagagccaccccctgtattgggggtgggagcgctgagagaggagagagacggcccgcgcgtcaatggg

SEQ ID NO: 607429 - DNA, 296 bp, Homo sapiens
cgccagcgcaccgtattgggccaatcgcaccgtgtggggccaacgcaccggtgttgggccatcgcaccgtgttgggctgtcgcaccgttcctctattgacatcgctcatgaacacagggtccacacacactgccccaccagtgacgccgaccaccagtgggacgagccaagccgcgagctcattcagcacagccaaaacctctacatccttacattcacacacttcctccacacaccatcctgaagtcaccccaactgctaccaccaaaatcaccatcaaccccacggtgcgttgg

SEQ ID NO: 607430 - DNA, 160 bp, Homo sapiens
tcttatgttcagagggactgacaatttacaaaggtcagagatggtacgaggacagagtatggctaagtgtggtgtgcaagcccatctatgtgggagcacatgttgacggagggaacatggacgtggaagccagcgtgcggaaagagaagtctggaggccc

SEQ ID NO: 607431 - DNA, 339 bp, Homo sapiens
gcttgggtgatctagaggatccgtttgcggtgcttcctttgcggtgctgcaactgcggtgttacccgagataatttgcaaaaatatctctttgttacgtgtgttcacattgctctagtaatcaaatttagaaacaaaagacatcattctatttatagcattctgtttttaatagtggttatttgcacttacaaaatatagtagttcttggttgggtgcagtggctcacacctgtagtcccagcactttgggattctgaggccggcagatcaccttaggtcaggagttcgagaacagcgtgggcaacatggggaaatcccatctctactaaaataccaaa

SEQ ID NO: 607432 - DNA, 932 bp, Homo sapiens
  misc_feature (63)..(63): n is a, c, g, or t
  misc_feature (92)..(92): n is a, c, g, or t
  misc_feature (105)..(105): n is a, c, g, or t
  misc_feature (213)..(213): n is a, c, g, or t
  misc_feature (215)..(215): n is a, c, g, or t
  misc_feature (256)..(256): n is a, c, g, or t
  misc_feature (371)..(371): n is a, c, g, or t
  misc_feature (410)..(410): n is a, c, g, or t
  misc_feature (414)..(414): n is a, c, g, or t
  misc_feature (419)..(419): n is a, c, g, or t
  misc_feature (428)..(428): n is a, c, g, or t
  misc_feature (432)..(432): n is a, c, g, or t
  misc_feature (435)..(435): n is a, c, g, or t
  misc_feature (606)..(606): n is a, c, g, or t
  misc_feature (634)..(634): n is a, c, g, or t
  misc_feature (705)..(705): n is a, c, g, or t
  misc_feature (755)..(755): n is a, c, g, or t
  misc_feature (781)..(781): n is a, c, g, or t
  misc_feature (786)..(786): n is a, c, g, or t
  misc_feature (846)..(847): n is a, c, g, or t
  misc_feature (850)..(852): n is a, c, g, or t
  misc_feature (858)..(858): n is a, c, g, or t
  misc_feature (918)..(918): n is a, c, g, or t
ccaggacccaccctctggagacaggctcagcagcctgcgccgcctgggcctagtctacttccnctacctcttcctgttctcgggcctggagnacacgctgagctncttcacacaccagcgcttccagttcagtagcctacagcaggggaagatgtttttcctcatcggcctcaccatggccaccatccaggtgcctatgcccggcggatccancntggcggggaagttgctgccgtgaagcgggccctcctgctgntggtgcccgccttcctcctcatcggctggggacgttctctgcccgtgctgggcctggggctgctgctctactcctttgccgccgccgttgtggtgccctgcctgtcctccgtggncgctggctatggctcaccagggcagaagggcacggtcangggnacacngcgcagccnaggngcnctggccagggccgcggggcccccggtggccgccccaggcgagggcgcgggaaggcgccggggcaggctgggggccaagcaccagcccccgccccccaagcgccagcccccccggggactgggtgacgccaccgtctctccgcagtggactggctggccggggcccaggccngcttcaccacgtggtccgggctcttttngctccccttcttcctcctgcagaagctgagttacccggcacagacgctcaaggctgagtagctgagccacngtgcccaggctgtgggcaccaggcagagtgggagcctaggtcaggccccngcccacggcccgacccccaccccccnccagnccagggagaccctgggggggggggccggcccctaagcaggaagctcaggcagctccacannacnnncccccnccggcagggactccgggctgcagcactccaaggctgtcagggcttctgtttgtttttaanaactaagcaaccag

SEQ ID NO: 607433 - DNA, 279 bp, Homo sapiens
ccaagttctaggacggaagaactggaaggggacataagagtgtgtccaggaatggggagaagtgggcatcatgctcccttgtgttgcccagcccacctgcagtctcactgcctctattagaggtgatgggctgtctgggctagtctggggacttgtcgggctagtctggggacgtgtcgggctagtctggggacttgtcgggctagtcgtgggactgtctgtgctagtctgtgggacgtgtcgggctagtcgtgggactgtctgggctagtctggtgac

SEQ ID NO: 607434 - DNA, 1394 bp, Homo sapiens
  misc_feature (46)..(46): n is a, c, g, or t
ttgttggcccccagttgggccctattttattaggtgggacacaccnattatgatggacacaccagcgtgtgtgtgaccgcaacacaataacgccacagggctgtggtgaatcccgcgtgtctctcggagaatttttttccgcccgggggagatattatgttcgtgttgtggacaccaacacggggcgttctacctgtgttataggccgcgccgcttgtatacatacgtcacgacacatgtggggcccaaaaactccgttttgtggggtggttgtccctcctccttgtaatgcccggggggggaaacatcccctcccccgccatcaataccaacgcgtttgggaaggggttgtctgttttccatgaacacaggaaagatctcttgttgttccaccacgaggaaggggctttggaggggaaaattttccctctgtttaccacgaatgtcttttggggccaaccaacgggaagaattccgatttattgaccctggttgattccaaggctttcttggcccacaagaaggggggagcttcccccctccccaaaatagttggggcggtgagaccttgtgacagttgcccctccccgggggccccccccactgggaacaaattccccccactgccccacagagccccctctcccactccccccaagtggatggaaatgaagagagtgggggagaacacaggagtaaatgcccctgggagggagaagagaaatagaaaaggtgcccccctacaaggtggtttggaagattttgttccccccctcggggggattgaggggaatgtgtcctctgtgtccctcggtttgccccctcgggttaaaagaccacagaaaaggttctcgggagctctttcccaaagagagaaaataggcacttttctctggtggagttaacactcggagtcctccaccacccctgagtctcccccaagagattgaaagaatggagaaatgagttttgtggggtatagcacacatccacggagagaaagggtgctggaagagaggggtgaaatgccgcgtcaaagagcccacaaggtggagagcttttccacgacaacccactttccacacgtaacttttcacgaaacgctggggaatgctggtggcccaggcctccccaaggaggaactcacatgtataatggagattataccggggccttggggcactgagcgagatgaggcacgcctatggggaggctcaagggccactggtgctggagacctgaggggccttttaatgctgaggctttaatcaatatcactcacgcacgcacaacctggaggaaaaattgtcaaaccccaagggtgaagaaaaaccatttatgtactgaacccgggactagaagggaaaataaatgatcttatatgttgtgtggga

SEQ ID NO: 607435 - DNA, 808 bp, Homo sapiens
  misc_feature (63)..(63): n is a, c, g, or t
  misc_feature (92)..(92): n is a, c, g, or t
  misc_feature (105)..(105): n is a, c, g, or t
  misc_feature (213)..(213): n is a, c, g, or t
  misc_feature (215)..(215): n is a, c, g, or t
  misc_feature (256)..(256): n is a, c, g, or t
  misc_feature (371)..(371): n is a, c, g, or t
  misc_feature (410)..(410): n is a, c, g, or t
  misc_feature (414)..(414): n is a, c, g, or t
  misc_feature (419)..(419): n is a, c, g, or t
  misc_feature (428)..(428): n is a, c, g, or t
  misc_feature (432)..(432): n is a, c, g, or t
  misc_feature (435)..(435): n is a, c, g, or t
  misc_feature (482)..(482): n is a, c, g, or t
  misc_feature (510)..(510): n is a, c, g, or t
  misc_feature (581)..(581): n is a, c, g, or t
  misc_feature (631)..(631): n is a, c, g, or t
  misc_feature (657)..(657): n is a, c, g, or t
  misc_feature (662)..(662): n is a, c, g, or t
  misc_feature (722)..(723): n is a, c, g, or t
  misc_feature (726)..(728): n is a, c, g, or t
  misc_feature (734)..(734): n is a, c, g, or t
  misc_feature (794)..(794): n is a, c, g, or t
ccaggacccaccctctggagacaggctcagcagcctgcgccgcctgggcctagtctacttccnctacctcttcctgttctcgggcctggagnacacgctgagctncttcacacaccagcgcttccagttcagtagcctacagcaggggaagatgtttttcctcatcggcctcaccatggccaccatccaggtgcctatgcccggcggatccancntggcggggaagttgctgccgtgaagcgggccctcctgctgntggtgcccgccttcctcctcatcggctggggacgttctctgcccgtgctgggcctggggctgctgctctactcctttgccgccgccgttgtggtgccctgcctgtcctccgtggncgctggctatggctcaccagggcagaagggcacggtcangggnacacngcgcagccnaggngcnctggccagggccgcggggcccggactggctggccggggcccaggccngcttcaccacgtggtccgggctcttttngctccccttcttcctcctgcagaagctgagttacccggcacagacgctcaaggctgagtagctgagccacngtgcccaggctgtgggcaccaggcagagtgggagcctaggtcaggccccngcccacggcccgacccccaccccccnccagnccagggagaccctgggggggggggccggcccctaagcaggaagctcaggcagctccacannacnnncccccnccggcagggactccgggctgcagcactccaaggctgtcagggcttctgtttgtttttaanaactaagcaaccag

SEQ ID NO: 607436 - DNA, 469 bp, Homo sapiens
gtccatggatagtaagtgctgtcactaatatgcacggcctgaacacacgttcaaccttaagaccacgggggtgttatgtcaaagcccccaagggagaacgtaggctgtacagacgatttacagagttgccagtgttactgtaatgggactgccttcgtaattcattgcctctgcttcaacaatgtgcaactcatccttggcaccagcccgtaaactgaccgtcgttaaaaataactggtgctcattggcatcattatccaccttaaagtgataatctttgtcggcctttagttcacaaccgaaaagatagttctggggcctcagggggctcatgtccatgtccatcgaatcttccatcgggtggcggcacgcacttaggtaggagagaaggcggacggagataaaagaacgctgctccagagaacaaccgcgcaggacggaagattcgatggccatggagtaaatggca

SEQ ID NO: 607437 - DNA, 113 bp, Homo sapiens
ggtcccgccatgcactcttttcttcagcctctcaagtagctggatacaggcgcccatcaccacacccagctaattttgtattattagtaaacgatgagtttgtgccgtgttgg

SEQ ID NO: 607438 - DNA, 332 bp, Homo sapiens
tgagatcccctgtgagctcttgtaggaggcctttcaggttgatcttggggattccttcggggaccaaagacttgatgagggcatggctggcgttccacatggcttgggacaggtctcgatagagacggttatgttttcgtcaacgaatccttccacctggtacagcacctttccagcataatgctggatcctgaagcagctgtgaggcagagacgtgtcattgaggaaccgagagcacttgctcaatcctgctttcaaacatgctggtgggatggcacataccttggttcacagcttttcccaaggcagtgctcacagttgctgggataccg

SEQ ID NO: 607439 - DNA, 436 bp, Homo sapiens
  misc_feature (15)..(15): n is a, c, g, or t
  misc_feature (32)..(32): n is a, c, g, or t
  misc_feature (45)..(45): n is a, c, g, or t
  misc_feature (250)..(250): n is a, c, g, or t
tccggaaaagttttnccaaaccggtccttgcncttaaatcacccncgttaattattgacgatgacatccttagcaaaaacgaaataccggatagccagtatctttcagtttaaatacgccaccccaggccaggttttgcacgggagcaacaaaaaatgtcgccacactgaataccagacacaggctgtcgaaggtattccagcgcgctttttcattctctttttttcgcctgattgctattacgccgagnggaaaaataaataagccgaccaggtagctgtaccacgggaaaatcgtcaggatttcggtcgactcttccatattggtggagtgcaatgccagcaatgtattgaaattaggcgcgccgtaggcctgaggaaaagggaaattacaagccgccaccagcggactgacaccgaccaggactttttgtacg

SEQ ID NO: 607440 - DNA, 176 bp, Homo sapiens
  misc_feature (134)..(134): n is a, c, g, or t
  misc_feature (145)..(145): n is a, c, g, or t
aagtccgtgatgaattcaagtataatattaagtatgcatggacctctagataatcggccttaggcgtatggctgctgcttagggatagcatagaatcagtaatagttgaaaaatgtgcaacacttcaaatgtanaggttgagaangtggctacgcaagaaacaaagtttggttctg

SEQ ID NO: 607441 - DNA, 230 bp, Homo sapiens
gaagtgtggccccaccgtggctggcggaggaggccgctctgccgctggccctccaccggtcactgacgcctcaaggtcaggtggctgagcaggaggaggctgctgccctgcggcaagccctacaccctctctctgctggatcagcccccgttggaggcagacagacgcccccagatggggggactgatggcacggcccagctggtggtgcacctcggccttcgagccagg

SEQ ID NO: 607442 - DNA, 100 bp, Homo sapiens
ttttgtctctttctcttgtctgattgctttggtcaggattcctccggtaatagtgttaaggtggaggtgtaaaaagtaactgttcctgttcttgtcttgt

SEQ ID NO: 607443 - DNA, 510 bp, Homo sapiens
gttgtggcgcgggcgaggtggaggcccaggactctgaccctgaccctgaccttcagcaaggagccccggcagcgccggcactacgaactgccgtgggttgaacaaatatcggccagtaaagctgaatgaaattgtcgggaatgaagagaccgtgagcaggctagaggtctttgcaagggaaggaaatgtgcccaatcatcatcattgctgggaccctcctaggaaccggctaagaccgacaagcattactgtgcttgagcccagggcacctgactagggcaccagcactacaaagataggcatgtttaggaacatcaatgcatatcgagaatgacagggagcagttgagcgatatgtgacggaataagaagttagaaagtgatttgcatcaaacgaaagaagatcagctcatatcccaatatggccgaacgatacaggatcagtcaatatactgggactgaaagccatgacaggccactgacacgaccgagagaccccagcagatagcct

SEQ ID NO: 607444 - DNA, 321 bp, Homo sapiens
  misc_feature (288)..(288): n is a, c, g, or t
ttcagagtgttattaagaacaacttgtctaaatataattttgaaatagttggaattttaactctgcttagagattttaaaatattatatcatgttaatttcagttcaaatattatgaaaatatttctttttaaaatcactcttgttatattttccttaaaaggtaaatgccaattctgacttaaaatgcacagatagatggatacagatgtactaacatctgccttttgaaaatagaagaatgggttaaatgaaggggcaatatttggatgcatgtatacagataaantgtgaaaattatagtccaattaaatatattaaa

SEQ ID NO: 607445 - DNA, 101 bp, Homo sapiens
cccgtttgtctacactattctgcagtttctgtcagcactcatatggaaagggaataagggcatgtgagagcgaccaaggcaaggaagattagacggtagag

SEQ ID NO: 607446 - DNA, 1118 bp, Homo sapiens
acataaatgccacggcattccgaagattttgattaacgattaccattgacaggattactgtgtgtataattttttccacaactgaacactgtgattatggggtttgtaagtcttagcagaactctatactggtacgaacacaatagacctgaattctgtgtaaccttttcggcaacggttaccctcctgcatactccaacacttacatcactttggccataccactccccttggtcacacacggtaggtacacgaaacggttactacgacggaacttctacttggctgacatgctggcaaactttgcgacgctcgacgcaccaccacacttcagtctctggccaattttgacgtctgaccacttggtaacttccaccaagctacactgcctgcccggtattgctatcgagagacctctaacagacgacctctgaaccccttgactttggcgccctgatcagaccaacctactaacaacgctttcactgaacacaccaccacctgattcaacaacgttgatacttctcactccctgacgcgaccaccctccgaacactccatgcaacactggcgacaccactcactgtactgacagcggccacgcactacaacaccttgtcgtcttctactggaatcgacccctctgtacaccacacgctttccaacacggtggacttaccattacttccacactcacggacagcaaccacctctggaaccccacacacgtttttaccactcacatgacacacatcatagcttaccacgcattcagtggttcaaacccaaacttttatggcaaccaccctctcggatgcccttctcataccatcatgagtgcggtaaaacttccttcaccgctattatcccacctgtcggcatgcacaccccacacttgtcacgcgaataaacacaggcaaagatccacacacatggcccgcacgcattgagttctcttactggaaaactggacctccccttacatttcctgtgcttatcaccacttgcggcacatcaattcacaaccattcttcacaggaacattacaacatgatcaccattgaatgtatcatgcgagtcagctttgctttcgtttgtgcgtgtgcacgaactcatta

SEQ ID NO: 607447 - DNA, 106 bp, Homo sapiens
  misc_feature (41)..(41): n is a, c, g, or t
  misc_feature (93)..(93): n is a, c, g, or t
  misc_feature (95)..(95): n is a, c, g, or t
tgttcatctctccctcatttctggagcagggcctgagaccntgccacatctcctatgctcctgccatccacgcctcttttgcacatcaacggntnattgatgccac

SEQ ID NO: 607448 - DNA, 1000 bp, Homo sapiens
ggcggatgggcatccttgcggaaaaaatccatagagcgcagagggccttggctgtggtgttggtactaacagagcttccctctctcctagatggcggactgtggcggactcccgcagatctcccagccggccaagctcgctgaggccttcaaggtacttcgtgcagggcatgggatacatgccctcggctagcatgacccgggctgatgcggtcccgcacagcgcgtcctggattccagtcgatcacattctcgtggagtgggcgacccgcgaggccgcgttcccacagcccagcgagggcacccgaaggccgtcccacaccagacgagggcacccgctaggcgtatcgcatcgaccagcgagggggcccaccatggacatcacgcgccacaactcgggtgctgctgggaacagcgccggggccaagtccaatggaggtctcctgcgaggcggtctgcccagacatgccgtcctccgtatatctgactctcgtgttagtggtcgcaataccatccgaaggaacccctttacgacccccaggcctgcgatactgctgcctaggtcggtataaatccgaaagctaatggggcagggaggtgagctctggttgcgagacacaatgagtcttatcacatgggtgacactctccgaaggcccgcatagggggaggaccaaaaggacggaaagacgcggaggtccgcagtcggaactaaatgcaggaaaagccagggcgggtgccactctcctccccctgcctcagagacaccaaatgcacaaaagagcagcgtagcaggacgacactccacaaagcaagcctaggcgcccgagcatcgtgggaccagcgggatgcaggtccaaaagccaggccgcaccatccgcgccactcttacctgcagaacccgatcacgcgaggacaacaaccagcacatagcgcgcggggaaaagaagagccccgtaccggagaagacggagagggcccggaacacgactgccccccagg

SEQ ID NO: 607449 - DNA, 367 bp, Homo sapiens
agttcttacataacagccttttattttattttgttttatttatttatttatttatttttgagacagagtttcgctcttgttgcccaggctggagtgcaatggcgtgatcacggttcactgcaacctccgcctcccggttcaagcgattctcctgcctcagcctcccgagtagctgggattacaggcgcccagcaccgacgcctggctaattttgtattcttagtagagatagggtttcttcatgttggtcaggctggtctcgaactcctgacctcaggtgatccgcctgccttggcctcccaaagtgctgggattacaggcatgagccactgcacccagcctacataacagcttaatcaactgtttc

SEQ ID NO: 607450 - DNA, 129 bp, Homo sapiens
gcagttgattctcttgacgacgacagcatagctcttctcaccaccaccgtgagcttctcctttactgcattcagttctaggtcagacagagctaatccatgtacatgccgtgtcacggagactgataga

SEQ ID NO: 607451 - DNA, 473 bp, Homo sapiens
aggccctttttttattgacggggataccaaaccatccacttgaaaatcctgtggtctcccatcagctgaaattaaggagggactgtgtaacttggagatcatgtatacaactcaacacgggtggatacaaaaaagggaggcacgaacagctcacaaagaaggttataacaccggtcaaggtggactcaagggggaacctctgagtatgccaccgctgaacacttaaaagaggaaagaaggacagatgctcttcatttattccgaaaggaagttcatttgaaagtgcataaatgggcatcataagtcaaacgtataagttggaccttcaacctaagaaacaaaatttttttttgctatacaagaatacaccaaactgttaatgctcgcccatgaatcccaaagatttggctcatattgtacaatacgaatgggcgtgcctctttcctttcttcagacaaacaccaattcggctg

SEQ ID NO: 607452 - DNA, 1166 bp, Homo sapiens
cgacgtcgcggcggtggagggcgcaggcgtggtgggcgcctggcgagtggactgttcgagcgcgttccgctgggacccgggccctgcgctccggccccgcgattggatgctgctctccgctggctgagcctgtcagcgagtcctcgacgcgacccgtggtccctgaagtcggagcaagagccacctaggcaacgccatgagcgcacatatttcgcaatctggcgctcagataggtgtctgttaccactgtacgcgggatctctacgatgtctgtatgcgagcgaacgtgatagtgcaaaacgagatgctggaacagactcgatgcgtgaacctgctgtagccagaaggagtcgtccttcgagggggacacagtgaaaacagcttgctgcgtgccagctacgtggtggagacccgccaaaaggcgccccctgcggggaaacgacgaagtccaagctttccattggacaagggtcagggggaacgaaacgaaacctgggaaagtcgtcacaccgagcaatacagaacctgatgaacgcgctctgcgcataacatctattagggagaccactagggtataggtgagcgtagtttaccgttgcattattatggggccatgcccagttggctcgtcataagatacccggacaccatacagaagagaacaacaaagtagagatgagatcaatagtttgcgatagaggacgagaaattcacaaagaacgagcacacgcagaaaaggcccaggaacagtttcctttgacctataattcctggacacccgaataatggcccttatgagacacagatatcaagagctgtcccaaaggcaatgtaatgcgaattttatgcaaattagtcgccggtcgaggaatctatgaagagtgtaaacattcgcaaggaatgccgaaaattgtcgcgaatttaaaaagtgcgaggtacagttcaagttgtaaagagatagcataatctagttagaacgtgacactggcgtgtgaaataaaaacgacctacattaggttattccaagaatagaacaaggaaagtctcagcaatgagagactgacaagaggaagcttgtcctagagtacttgatacgtagacagagagtatgagaaacagacacgtcatacgaatgtggcaatataaaatgcgttggcctacagcat

SEQ ID NO: 607453 - DNA, 234 bp, Homo sapiens
gcgtcgacgcctacagtccctattgtagctattcataccaattgttgtagctccatcctgccaagctttggaattccctctctactaaaaatacaaaaattagctgggcgtggtggcatgtgcctgtagtcccagctacttagcaggctggagtgcaatggcaccacctcggctcactgcaacctccacctctggagtttaagcaattctcctgcctcagccccctagtcgacg

SEQ ID NO: 607454 - DNA, 147 bp, Homo sapiens
ggcggtgagcccccgcgccctgtccttccccagtcccaattcttctcatgactggttgcttatctttcagatcttaattcaaatctcacctcttcagaaaggccggtcctggccaccctaagatcatctcccacctggaggccatca

SEQ ID NO: 607455 - DNA, 297 bp, Homo sapiens
caatatgggtcgatcggagtagtatggaggcaagaacaacgacaatgtgggtcaccaattcatttaagaaataaaatgtttcctctggctatctccatgcacagctgcccagatactatggccacaatgtacaccacgcaagttagggctatattgtttggacacagatatctattacgaaacatcctacttattttatcattttgaacgcataggcttggcatgagtggctcacacctctgtcatctcagcatcgtttgggatggctgagtgtggagtggatcatccctgagctca

SEQ ID NO: 607456 - DNA, 310 bp, Homo sapiens
tccggtcgtgatcccaaatggggggggaaaaaaaaagaaagattcaagatgaagaataattttttttttggcattttcccatttaatttaatctggggataagagagtaaataacgaatttctctctcttatctctttatacactaagagctggatgggtcagcatggtggtatcctggacctttccccagaatctttctggtcttgtggaccttaatacacatggactggaattaaaccagggataaaatactatggaaagatatggacctcttaataaatctcagaacagtctggaaaactaaaactg

SEQ ID NO: 607457 - DNA, 641 bp, Homo sapiens
  misc_feature (213)..(213): n is a, c, g, or t
  misc_feature (245)..(245): n is a, c, g, or t
  misc_feature (252)..(252): n is a, c, g, or t
  misc_feature (291)..(292): n is a, c, g, or t
  misc_feature (305)..(306): n is a, c, g, or t
  misc_feature (308)..(308): n is a, c, g, or t
  misc_feature (310)..(310): n is a, c, g, or t
  misc_feature (312)..(314): n is a, c, g, or t
  misc_feature (317)..(317): n is a, c, g, or t
  misc_feature (320)..(321): n is a, c, g, or t
tagcctgggtgacagtgccagatcctttctccaaaaaaaaaaattttttttaatgcatgaactttcttatttggcgattccacttgtaggactttgtcctgctgacatatttgcttggtggtagggatgtacatgcaaagctatcttgcctacaaacaacaaactgttgtaacataaagtatttttcgttcactcattgtggaaacaacatgntcctgtgtgcctcttatttataaccaaatagnccatgtnttgaactggggaatatttactctgcttcaacattaaacnnctttttggccacnngngntnnntangcnnataatcccagcactttgggagaccaaggcaggaggactgcttgagcctaggagttcaagcccagcctgggcaacatagcaagatcccgtctctacaagaaattaaaataaaaagttagccaggtttggtggtgcacacccatggttccagctactcaggaggctgaggtgggagaattgcttgagcccaggaggtcaaggctgcagtgggttatgactgtgccactgcactccaacctgggcaatgcagtgagaccctgcccccacctccaaaccaagaaataggtttgttgacctcagcactattgacatttggggcag

SEQ ID NO: 607458 - DNA, 401 bp, Homo sapiens
gtgcaaccttccacgtgtgaagtgacagccttgtgtgtgatcttttctgtcttccccaagtttgcattttcgacattaaagtttactttttagttaaaagtttaaaaaatatatataaatacactgtagataacatttgtatgccagctacacctttttctacttctgtttggctttttttccccacaccaatggtaatttatcttcacagattgttcttcatttctagaaattgttacttcatggtaattacttgagcaaaagcttgaaaatccctgacaagtacttttcatctcatagtatattagttttcactcagtcattttatgaataatatagttatccacttaaacatttcaatattttaaccatcttgaaaattaaagattaaaaatcccctt

SEQ ID NO: 607459 - DNA, 849 bp, Homo sapiens
ctgactgtctatctgtgtgtatgtatctatgtgggtaggcatgtgtaaatgacagggatgatgtgccagactcatatgtacatacatgactgcctgttaatatatgtttataaaatatatggcatatatataactgcgctggagtatatgtccatatagtatatgatgtgtgtattaagttgaaccatgtaaaattgctacgtagtaggataaaacgagtgtgactatctgcagtattacctactggtaagccctgtagctaatggtgtgtctagatctaaatgtgcgtggtgtattcgactatgtgtgtatcgtctgtgtgtacagcgttgtatatatttaaccatggtttggagtacgatacatgagctgctcttaagtctaaacgacccatggtcgcactgcatctggatgaccatctgtgtgtgtgactgtctcgatggtacacatcggtgagtggagaacctggtttggagggagctgttaggaaaggcaggcgaaaggagagtgagtgtgaccagaccgagagcctctcaggccggatctggacacgccagggctttatccgcccgctccacattgcagctatcgcagttcttccactggaaatgccagctgtcatgtccccataccgtatactgtacattcgccaaggacagccccaggaccctcgccagagaagctctcccctgattgaaccaccggttccaccgggtatatgagtgcacgccagctccgttgggggcaaacctttggagggctagcgcacctttgacttgagacttgtgaatacgagggagttaaacttggacctaagacagttcccaggaaccttcgatgaatgggaag

SEQ ID NO: 607460 - DNA, 195 bp, Homo sapiens
gctggagagggtgccaaggaatttggggatatctttgtaacgcaaggattctaatgggggctgtctatgaagtcttgcagtagttaagcctaggtaatttgctgagcctaatgggtgtcagggtcagtctaagtgacagcaaagagaggctgggacgaggggtgcaggggaatagtgaagaaagcatctttacga

SEQ ID NO: 607461 - DNA, 143 bp, Homo sapiens
ctatgtggtatgcgcacacatccttaaagaaggcaacttaaaacaaaaggaaaaaccaaatcattttgagtttgcactcaacagtggtctgaacctctgctctccaatctactctgaagaatcccaacggtgaccggcgactt

SEQ ID NO: 607462 - DNA, 555 bp, Homo sapiens
  misc_feature (13)..(13): n is a, c, g, or t
  misc_feature (73)..(73): n is a, c, g, or t
  misc_feature (94)..(94): n is a, c, g, or t
  misc_feature (110)..(110): n is a, c, g, or t
  misc_feature (170)..(170): n is a, c, g, or t
  misc_feature (174)..(175): n is a, c, g, or t
  misc_feature (179)..(179): n is a, c, g, or t
  misc_feature (214)..(214): n is a, c, g, or t
  misc_feature (221)..(222): n is a, c, g, or t
  misc_feature (257)..(257): n is a, c, g, or t
  misc_feature (279)..(279): n is a, c, g, or t
  misc_feature (281)..(281): n is a, c, g, or t
  misc_feature (285)..(285): n is a, c, g, or t
  misc_feature (297)..(297): n is a, c, g, or t
  misc_feature (322)..(322): n is a, c, g, or t
  misc_feature (341)..(341): n is a, c, g, or t
  misc_feature (360)..(360): n is a, c, g, or t
  misc_feature (505)..(506): n is a, c, g, or t
gagagaacggganacagggggaagggcaggacaaaggaggaacaacggggaagggaccacagaggaagaaaangacaggagaaaaggacaaagnggaggggaggagaaangaaaacagaatcacatgacctagacgcaggcacggggggcgcgggacagggcgcggcganggcnnggcnggggaagagaggaaggggagcaggcaggggcacangcgggcnnccggggcgccagagacggcggccgagagccagacngggcgggggcgaagagcgagangnacgngccagggaaatngggaaaagccacgcgggcggggggnggcgccgccgggggggcgnggggggggcggccgaagcnggaacggcaggcgggggggggggggggggggggacagcaccagagccccgcaggcgcaccccaagggcccagccggcagggcccaggggagaaggaaaaggcgcggcaccgcgggcaacggcggcacagggaagagagcgccggnncgggcggccccgcggggccgccggcccacagacggcagcgccccgaccg

SEQ ID NO: 607463 - DNA, 808 bp, Homo sapiens
  misc_feature (477)..(477): n is a, c, g, or t
ggcctggtgtgaatcggccgaggctgtgtcctggcctttgggcatcatccagcgccatcggcctggcgcttcagccaacgcgggatgtggatgggccccttcttcttcgcagacagcgttctggccgctgcccgggctctagtgcgctggcctggacggcccagtctggagggttctggggcgtgagtgccctggtggtggtgttgctgctgctgccctggggtcctggcctctcactctgctcccctctcgtcctgcatgcctgcatgtggcctgtagtgcatgccatggctgcccagcctggaatggcatggtcttgaagccccacttccacaatggactgtgcatgcgtgctgctgtggccacgtggttcaaccatgcctggccctgtaatgatcctgcagactgtaatggccctggcaatgccaatggctgctgcctgcatctgccccgcgcccctgctgtctgtggtcccantcctgtgcccaatctgttgctgcttgccccactggttctgtgtaccacacgaatggtgcgcgcctggcctgctggcttcagcctggaggagctcagggtggccggcattcacaagaatggtgtgccctggaccatcggcatttctgtggatccgaggaggcggaacaagtccactggagtcccttgcaggtccaactgtgcagcgtgctgaagggagtacctgctccaaaactcatcctcttccccaggaagccctcggccccaagaaggagacagttctgctgaagaactgaaactggcaccactgacggacggcatgccgtctgaacgc

SEQ ID NO: 607464 - DNA, 537 bp, Homo sapiens
gatgaaatagatcatttgaatagtcttagaaccatcacagcagttgaattcataatttaaaagttccccaaaaagaaatctctcagatcagatggttttactggagaattttaccaaacatttaaaggagcaacaccaattttacacaatttcttccagaacacagaagaggaaggaacactttcccacttattttgtgaaactggctctatcctgacaccaaattaaagactagttttaaaatcctactacagaccagtgtctctcctgaacatagaggcaaaaatcctccactaaatacaagcaaatataatccaacaatgtataaaaataattatacaccaagaacaagtgagactcataccaaatacgtgagattgactgagcactgaaaaatcagatgatgcaacccatcagattaacaggctaaagaagaggaaaatgatataactttatcaatctatgcagaaaatatatttgagattggctgagcattgaaaaatcagatggtgcgatccatcagattaacaggttaaa

SEQ ID NO: 607465 - DNA, 266 bp, Homo sapiens
  misc_feature (45)..(45): n is a, c, g, or t
ggaaggggctttgtgtgccccccaggaggaagaggccttgagttntgggatcagacaccccttcaggtgtatccccacacaaatgcaagttcaccaaggtcccctttcagtccccttccctaccccctgaccggccattgccgcacacccccccagagcacgcccccccccatgggagtgtgttcaggagtcgcgggcagggtggacatttgtcccagagggggcagaatttccaatagaggattgagccctgctaaaaaaaaaaa

SEQ ID NO: 607466 - DNA, 226 bp, Homo sapiens
tggcgctttttcttcaggtaagctattttccttatggtcgtgcgtgattaccagggtatggtaaatgtgcaaagcagataggtctgcacggaggaggctggactgtgaccattaactgttcagatttagagatcaaatatggcacccacaaagagaaaataaaaattaatcaaaaaatgagagcaagagaaatgctataccaagatatattttcctatttcatgga

SEQ ID NO: 607467 - DNA, 331 bp, Homo sapiens
agctcttttttctgaggctattttatagttattttttaaacataaagatacagaagtcttcttgacttctgattttcaaaaccatttccctcagtatttttcaggcatttgacctcctgaatggggcttgggccctggggcttcagttatccttttatgtcctgccaggggggggtaaatggctgggggttttttggggtaaataagtcccaaggaatgttttattggggaaaaacttaaaaaccaaaggaattagttcaaattccggaaaaaaaattaaagtttttaagcctccctgtgaaataaatggggtcctgattgcctgggaaaa

SEQ ID NO: 607468 - DNA, 129 bp, Homo sapiens
atctagaggatccaggccggtcagaaatggaacagtactactgcgctcccgggcggcgcggttgttctgagccagctacactgctcccacccctgcagaaccagcagttcttctccaacccccccaagg

SEQ ID NO: 607469 - DNA, 944 bp, Homo sapiens
tgatctctaaggcccctcattcccccatccacctggtacatagatcctcctcccgcagtgtcggagccacacgctcacttctgtgcccacattaggagaggaggagctcacggctgctctgaggcttcattttcagagccttttctagttgtgcttcttaaaaccatgtccaagtctctttgtgacttcctaccggcgacagaggcgagaaaggatagtgggtaagagcacagcgctccagagtccaggtggccgtggcccaggccctgtgcgcttcactagctgtgtgcctttgagtgactccttgaccctctctgtgccttggtttgctcctgggtaaaatgtagataataataatagtacccacctcagagaggcatggggagcttgaagggccccaagcagggccgtggctcaccgaagcacgatggcatctgttaccactatcagtcacacttataacccctggggatggtcagaacagggccactgccttcctggcagtgaagccctgcacacatttaaaaatagctctaggccgggcacggatggtcatgcctgtaatcccagcagtttgggaggccgaggcaggaggatcgcttgagctcaggcattcaagagcagcctgagcaacatagtgagactctgtctctattttacttttaaacggtttttaagctagaaataaagtaaaataggcagtgcggtggttcacacctgtaatccagcactggaggtgaagtgggcgattggtcaggccagggttagaccaaccgggaacatgggaaacccattttaataatcaaatagtggtgtgggggctgcttagccgacggggggcggggggaacccggtcgggggggggtggcgacacccgtcccgggggggggacactttttgaagtcgggaaacggttgggggggagggtttgctttggctaaaac

SEQ ID NO: 607470 - DNA, 614 bp, Homo sapiens
gggaaactgtaccaagattggaaactttacaaagttttcaacggccttaacctctcgggggtgttttggcccttccttggggaaaattctaacggttccaaccaaaggaacatacaccggggtcgcaagtagcaattgttggccgcgaaaaggaggccctttccaacgatataactgcccagaggtgacaacactctggcaggaacgatcgggcgtccgggacccctggcgacaccatgctcgctcggacctcgggaggtctcacgtgtaaaggtataccatcgcttcaaaggcggggcaccagtgcctggagactggaggcagataggaatcgagcaacgtatcaccagccagctcccaccactccacggccttcatcctgccttgacagacgctgtcctccagttccccaagtgccctccaggtcctcaccggtccctcccaggccctgcctactctggagcagcgtgcccgtcgggaggcaagatcagctcggcgctgcatttactgccgggccgtgtgccgccgggcacgagagacgtgtggtgcctcttgtccagatgggagagaccgatgcgaacgtggccaagtttatacaccagactcagtgacta

SEQ ID NO: 607471 - DNA, 999 bp, Homo sapiens
  misc_feature (24)..(24): n is a, c, g, or t
  misc_feature (178)..(179): n is a, c, g, or t
  misc_feature (199)..(199): n is a, c, g, or t
  misc_feature (206)..(206): n is a, c, g, or t
  misc_feature (227)..(227): n is a, c, g, or t
  misc_feature (256)..(256): n is a, c, g, or t
  misc_feature (346)..(346): n is a, c, g, or t
  misc_feature (368)..(368): n is a, c, g, or t
  misc_feature (402)..(402): n is a, c, g, or t
  misc_feature (420)..(420): n is a, c, g, or t
  misc_feature (432)..(432): n is a, c, g, or t
  misc_feature (439)..(439): n is a, c, g, or t
  misc_feature (441)..(441): n is a, c, g, or t
  misc_feature (463)..(463): n is a, c, g, or t
  misc_feature (465)..(465): n is a, c, g, or t
  misc_feature (474)..(474): n is a, c, g, or t
  misc_feature (488)..(488): n is a, c, g, or t
  misc_feature (507)..(507): n is a, c, g, or t
  misc_feature (511)..(513): n is a, c, g, or t
  misc_feature (541)..(541): n is a, c, g, or t
  misc_feature (564)..(564): n is a, c, g, or t
  misc_feature (566)..(566): n is a, c, g, or t
  misc_feature (572)..(573): n is a, c, g, or t
  misc_feature (575)..(575): n is a, c, g, or t
  misc_feature (577)..(577): n is a, c, g, or t
  misc_feature (592)..(592): n is a, c, g, or t
  misc_feature (599)..(599): n is a, c, g, or t
taacatgatatagcactcattaancaagaatataaagtcatctacttagaatacacattatcttaaagatgcatactggaatgataagtttgaagatgtaactaacaacaattcttttcaaaatcatatcaatatattactctcatggaactagcacattctaagaagggtcattttnnccccccagtactgggaaggnatgcatntaaccatgtggtcagccaganaggctgttttatatatggtgtgtgtgacncataaaaagcctgtcctttctctaaaattgtacattacacaattgtagctacacctgaaaagaagtgagtttcaatgaccatcatcaccnaaaaacatgaataagttatgtntatataggaccagaggaaagatatatcgtactgnactaagcctacctctgtncagaggccagcngtctcancngatcttcagggagcctagactntntacccatcnattatccgggaaanatcagaagaaaaaaaaaanggannnagtcaggtattgagaataaatacctctnagggagtttttttcaaacctaancnacacannangnatattccctgacacnaaaagtncactgactcttcaaatcctagacttgtccaacattattttccctagttggataaggctgaattaaaggcacttcgttaaaggaagtagccttggcagaagaaaaaccgttgttctgtagaagtgtcattcaatatttaaaatctcctctgaaccaaaacaagagcctgaaagtaaaacaccttttattttttaactctgctgtcattgctactaaggattcatggtaaattatcccacagcccttcttggcttgagaggaggtacagtacaagtagcccacagggtctcaataacagaagtattctcaaggacccttgaggatacaaaggaatactgggctgttttaaaatgagaaaactgagaagaatcagttaggtttctagccctcttcctataata

SEQ ID NO: 607472 - DNA, 465 bp, Homo sapiens
  misc_feature (15)..(15): n is a, c, g, or t
  misc_feature (30)..(30): n is a, c, g, or t
  misc_feature (87)..(87): n is a, c, g, or t
  misc_feature (134)..(134): n is a, c, g, or t
  misc_feature (146)..(146): n is a, c, g, or t
tccacctgcctcggnctcccaacgtgttgngatgacaggcgtgagccatcacacctggccatgtaatactttttaaaatgtggattnttacagttacttagtcttcataataagataacattttattttgctgncatgtagtaggntggagatattctattctgctccatgaagtaatacagggatccacttgtcatggttgtacaatttcacacttcagtctgtggggaggagaaggaggaaattcaggacagtttgccattgaggaggtgagcaggaagttctgctatttcttttactcacattgcatcattggtgagaacttagtgacacggctatgcctacctataagggaggctgggaaatggagcctatgtgactgattgtatgctcaggaagaacatgagaatagatgttttgtgagacaactagtagtatggtttttcggcgtgtgcagggtaccga

SEQ ID NO: 607473 - DNA, 804 bp, Homo sapiens
ttcccttacaagggttatatatggaattatggtaccctccctcagacttgggaagatccccatgaaaaagttaagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccggggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaattttaaattacaacacacaaaaaaa

SEQ ID NO: 607474 - DNA, 381 bp, Homo sapiens
cctcctcctcctcctcctttcccgggggtcctgggaaaccaggtcagtgatgtagttttccagtttggcaacttcctagccttagaatccctaaggggggtgtgggaaacacattttcccgttgcaagcatgcaactccaaaaaatttgtgatgcccctgaaattaaatgggaaagatccagcttttttagcattttggttgaacctgctttcattgtccctgggaaattgtggaaaaaaaggggactgtgtgatttgattttgtgggcaaggacttgcatcttgtgtttttatccccaagcctttctggtgtttccaactcctaccccattgcatggggtgtttcggacatccaataaaaatttttttagtggttttgga

SEQ ID NO: 607475 - DNA, 1193 bp, Homo sapiens
tgaaacggagtctcactctgtcgccagggctggagtgcagtggcgcaattctctcagcctcacgtgcaattcttccacctctccgtgggtttcaaggtgatttcttcctgtgccctcagccctcccaagtatagcgtggtgatttacagggccgcccgccacttaacgcccagcctaatttttgtgtgatatatttataagagataagaagaccgggtttgtgtgacccatgtgtgtgtggccacgtgcgtggtctcctcagaatttccgtgaccctcgtgtgatttcaccccgccctctcagaccttccacaaagtgtgcgtggcaattatacaggggcgtgtgacgcctttaccagcgcctgtgggccacacccatttgtgtagaatattctgtttatataccacatataatatattatattgttcacagaaacattttactctcaacaccgtgaaacattctcttcaaaacatgtgttattgttactgaaaggcgttataattctcaggttttttcccaagggggcaaagacctcctttttaaccacccaaatgtgacacagtggattgtcgccagcccaacaaacatttttttaggacccgcgtaacaccgcatttaaaccaccagagccatttaacacgattacacacatctagtgggacacctctcagcgggcaccaccacggaaagcacacatttcgtgcagagactaagtggtctctaccgtctatcttaggacccaaacacttactgtggcacctttaggcaaacatgttgggaacacggggggaccaccgcacaacaaccgcaacacgtggggcccccgtgggcaagcattaggtctttatacctgtgggggtcgcctttcttgaagttaccccccaacgtattgccatgcaacgacaaagagatcaaggcaaaacacacacgccccccgagaacatagacagcgccttgcgaacgcggtcattggtccccaagaaagggccctttgcttggactacttgagggggtaccttgtaagaagtatcaattcacgcccaaaacgtctccaggtgttttgcttcacccaagtgaagcgggcatcacgagggcgaactctcacgaaaacccgtaacttctatcacagttgggtgctcacagttgtatccccttccagttcacaagggcggtcccacagtcttcacaaa

SEQ ID NO: 607476 - DNA, 455 bp, Homo sapiens
  misc_feature (190)..(190): n is a, c, g, or t
gctctagaatttttaatgtagctttatataaggcttgggccaaatgagagaacttgggacgaaagtttgaagggaaatagctttaaatagagaaatgcaactttagatagcttatgactgtttgtatctgcctaaatacttcctaaaagtcgaaattaaatttgattaatcactcccttctccctcctcnttatcccttccctaataccctctttccccattttaaatgcagagcaagtgtggcacttccttggcaagtgattgaaacatctgaaattctgctgtcaagattcccatctctaaggactccaagactctttttccccaagtgctagagacaagggggtctatgagcatttactgacttcctgttaaaacttcattttttcaaactttttgagctatgcaatatataaataaacagtaagaattttaaattacaacacacaaaaaaa

SEQ ID NO: 607477 - DNA, 286 bp, Homo sapiens
  misc_feature (193)..(193): n is a, c, g, or t
  misc_feature (195)..(196): n is a, c, g, or t
  misc_feature (211)..(211): n is a, c, g, or t
taattaacagagcatttatcgggtagcaggtggatgtgggactcttatagtccttagaggtgcagcattcaattgaagcaaacatcagtacgacgaattcatatacggaaatacacacgtgatcacaatgcataatgcttgtgggtatatacacagagattgaagacatccccaaaaaacacattttaagtantnnccaacctaaactctnatgtacatctagatcaggaagctgtacctttaatttttaataaggatcccctaggttgaaatgtgcccatttcaa

SEQ ID NO: 607478 - DNA, 122 bp, Homo sapiens
agagttgaaagtactcactatgtaatcacggaataaatgagctcccaagaaagtgtcatcagagaagagcagtgggcaacgattgggttaggggacaaaccgctattgacgagatgtaattt

SEQ ID NO: 607479 - DNA, 509 bp, Homo sapiens
caagctccgcctccggggttcacgccattctcaggcctcagcttcccaaagtgcggggataacaggcatgagccattgaacccagccagttacagaatttctattcccggggagaaacatttacaaggtagataatagcattaatatatagctctttgggtcttaaaactggcggtactcagtccagggtacgggaaactaaaataagttctttacttccccacttcctttagggggtcatgtccagtgaagtcaggttaattggctagtgtaggatgccatttgggattctcccacatgtggatggttggtgtgtatgtatgttgggagtgaggatgtgtgaaacattactatggtacggggagtcagagctgtacagagcggttacaaaaggtcacttcctcatcacccctacagtgcccttctcactctctttttccacggtctcccagtcacactcaagtgcaagtaatcctggcggtattcttccaaatgagcagatacgtaca

SEQ ID NO: 607480 - DNA, 950 bp, Homo sapiens
  misc_feature (782)..(782): n is a, c, g, or t
ggatgggaggatggacatactggtgtctgagtgctccgcgcggtgctgcagcagttcagccgcaagttcttcccgggttactgagcgagaggatcctaataagcccatgggggtgatccattatcagacccagcggagtctgggctctgttgcccctcagcaattcgttcggggaacggcaggcaggccaacacccattataaaaatgttgaaaacgcggccggagcgcgggtggagctccatgccctggttaattccccagcaatttccggggaagggccggaggacagaacagaagcatttaaaattcttcctgaacgtggctggaaaattggacccgtgttggacacaacaccttggtgggactgataaaagaagaagcgttcatccccaaaattttgtgggaggtcatgttttaaccaaaggaaggggaagaacgagatatagcatagcaaagataataatagaacaaaaatatttgttgtgtggggcggcatggtggagggcacggagtaaaagagaggttttcataagacaacaaactttctgtggtagaggagcggacgcggagggcgccatagtatgaggtgaagtagtggaacaaagttggtgaagaaaaaggggtgagtaacccgaaagagaaagaagcgccgggagaaacgacaagcaatgccggtgccgatgggataatcctcacaccacaagaaagaaaccgccgcgggaggacaacaaccaggcgtgttggagcaacaaccacagagaagaggtattcagaaggaccnaacaggcgaggtccaaacaccagcgggggctccagagcagacacgagcatcaaaataacgcccgggcactcggtgaaggacacagagacgactgaagcagaccaaagcagagcacgaacgcatcgacaagagcagcagaacgacacagaacgcgacaaacaccagcat

SEQ ID NO: 607481 - DNA, 494 bp, Homo sapiens
gcgaattcactagtgattgtgagctgagatcgcacctgtaatcccaacactttgggaggccaaggcaggcggatcacttgaggtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgctgtgagctgagatcgcaccactgcactccagcgtggcgacatagcgagactctgttgcaaaaaaacagtgttttagcttcaagaacatattgtggtgataactaaaacaccgtattgaagaacccaggtggttcatgtaatctgaaatatagcagtgagttatgatagtggctaataaaatttatattccacagaaaataaaaaccttaattataggctaaagaaattaatttgattcaatcatagtaattaaagaaaa

SEQ ID NO: 607482 - DNA, 200 bp, Homo sapiens
ccgcaggaacgcagacagggaacgggcagtcaagcctccctaacctgtagactcccatggggaacaacgggtggctctcggcttggggggacctcctagaggtgccactgttcttctgagcaatctgagctcgaaactggtcaagatctggctcctgacactgcgctatgcccacactggggatacgcgagctcgaaatt

SEQ ID NO: 607483 - DNA, 310 bp, Homo sapiens
cagtaatgggaggagagaaaggagaattgcttgaacctgggaggcagaggaagtactgagccaagacatgcgcctatgcactccagcctgcgcctgggtccccgcacatagagctgcctctggaggttctgggaaatgggccgcagatgcatgaagtagcagaagccacctcgggtacatacccgtgcacagactgaccgttgaaccagcggatactgagattcagtcacggcccgctctcaatcctccatacctccggaacttgacatagacgttgcccacgaggtgttcccaaagcttgcatgggata

SEQ ID NO: 607484 - DNA, 275 bp, Homo sapiens
  misc_feature (55)..(55): n is a, c, g, or t
  misc_feature (132)..(132): n is a, c, g, or t
  misc_feature (245)..(245): n is a, c, g, or t
ccacaccctgcctagttcactaattcctatagttcactgtatcacccagcctggnctcaaactcctgagctcaagcaatccttccacctcagcccccattcactctttagtgcagtcatagctcactgcagnctcaaattcctaggctcaagtgatcctcccactttaacctctaagtggtgggattacaggtgtgcaccaccagacttggctaatttttttattttggtagagaccgggtcttnctgttgcccacgctgttcttgaactcctgg

SEQ ID NO: 607485 - DNA, 1179 bp, Homo sapiens
  misc_feature (569)..(569): n is a, c, g, or t
tgtgtactcgattcgcttgttctcttcgtgggtcccaagagtcctgaacttctagaggtccttcaaccctgcccctgttccatccactgacctctccgttagtccctcccaccgggaaactgttcttgttgggatttatgagctccgagcacctgttagcaaaagagtggggtacctcagatgactgcccacgaggaaaaatggaaggaggcctggcatagcccgcagcatttgctaggactagtttctgcctcaatgaatggagtcagaagttctaatctggtaagaaaaggatggcgggcttatttccaggccctgatgcacaacttcccttctcactaataccaggaggaacctaattctgaaacgtgtcaccgaggcaagattcgtaataccagattctgcctcaagagagccgcaggtaatcaaggtgtaatcattgcggggtttagagagcagggtcatatgaaatacacagcccagaatatggagcattcaggacccaagtactgacttcatggaggccacagcaactcgtgttcccttcctagatccaactggaggacaangtccaggtccagtgcggtgtactctgagcacttactcacgaggctatacaccctacgcacgcagtcagccacctgtcagtcttggctccgtacgtacgtcgtcacgttcctgccgtccatccatgtgtacctagctactggtactcactcttgacacaagggcggagcctgccagcctgagcatgcgagtgattgtcccggccagcattagtgccactccccagtgaggacccttacctagctgagacgcatgcctgccttgcagtcagaagtgccgaaagacagcacacaccagtggttggacggctcagactgtgtactccaggcccctggcaacacgttctctgcctgcttgcatatatcatcgcctcacggcatcccagtgcagacgcctcaccctaggagttggccattccactgacctcttctcagagcctctgctgcacagaggtcccatcactccccgctgcaggcaaatcttacaaggaagggaggatggcttcctacgtggtagcccctctgtcatttaatgcatggacagatactcaggctagatatgagtatatgtgggggctctcagcaggagcctggggggctcccaatctgtgtc

SEQ ID NO: 607486 - DNA, 189 bp, Homo sapiens
tctcctcgtgcttgtagatgccggcggtgcatggcacgtgtttcttaggccgcaggtccaggggctatgtacttctatgcccttgtagaataacctgaggtatactttctgagtctggttactaactgtgagaacacgggcaatggattaccggacgactcggatcttagagagcttggaggccacgac

SEQ ID NO: 607487 - DNA, 670 bp, Homo sapiens
  misc_feature (295)..(295): n is a, c, g, or t
  misc_feature (353)..(353): n is a, c, g, or t
  misc_feature (370)..(370): n is a, c, g, or t
  misc_feature (379)..(379): n is a, c, g, or t
  misc_feature (385)..(385): n is a, c, g, or t
  misc_feature (395)..(396): n is a, c, g, or t
  misc_feature (402)..(403): n is a, c, g, or t
  misc_feature (410)..(410): n is a, c, g, or t
  misc_feature (413)..(414): n is a, c, g, or t
  misc_feature (416)..(416): n is a, c, g, or t
  misc_feature (421)..(421): n is a, c, g, or t
  misc_feature (425)..(425): n is a, c, g, or t
  misc_feature (432)..(432): n is a, c, g, or t
  misc_feature (434)..(434): n is a, c, g, or t
  misc_feature (438)..(438): n is a, c, g, or t
  misc_feature (442)..(442): n is a, c, g, or t
  misc_feature (448)..(448): n is a, c, g, or t
  misc_feature (451)..(451): n is a, c, g, or t
  misc_feature (463)..(463): n is a, c, g, or t
  misc_feature (471)..(471): n is a, c, g, or t
  misc_feature (476)..(477): n is a, c, g, or t
  misc_feature (484)..(484): n is a, c, g, or t
  misc_feature (486)..(486): n is a, c, g, or t
  misc_feature (492)..(492): n is a, c, g, or t
  misc_feature (509)..(510): n is a, c, g, or t
  misc_feature (513)..(513): n is a, c, g, or t
  misc_feature (518)..(518): n is a, c, g, or t
  misc_feature (527)..(527): n is a, c, g, or t
ggaacgagcaaacacgagaggtgtcctatggtcagacaccctattagacccccgtcccctggtcagccagccagctactagccacagctcatagactaaagccctttctgaaaatcaggatacagggaaaaaccaccactcttcagctacctctttgttccccaaaccctctgctcactgggaagtgggcaaagccttcagatgagaccatctgaggtctatataacccaaggtttgtttcacagctctcatagattatggctgtcctatcccctgccctgtctggaaacattangagctcaagactgaacatgaagctccaattgtgagctccaggaaggtggaagaaacanctgcaggcacaggttgntcaaaccanaatganacggaggggnngaattnnaactggncanngntgccntganggaagancncctntcangaacanaancttgggcttccnaattaacngaaannggccggntntaaccncttttcccactaaaaanntgntgggnaaaactggntcccaaacctggggttgggagggggccaaaattaattccagccggatggccccccgcaaagtggctccaatggagtaacagccctggtcttttaaaaccctggtttttacctcctgggggaaataggccgaaaaggccttcct

SEQ ID NO: 607488 - DNA, 984 bp, Homo sapiens
tcggttgtaggtggcctcgccgcccggtccggtgtcgcaggcgctcatccgcgccgggagcccttggctgcgtcgcccggggagccgcgtaaggacgctgcgaattgacgccttttataataaagacacttatcttgcccaaagagctggcgctggagtgtagtggcgcaattcttggagtcagccagcaaacctccggtctcccatgttcaagcgattctcccgcctcaggctcctgagtagcaattacaggtaaaagttgtgggcagaaagcacgggcagcctgggactcctgtcgccatagcgaacaccagactaccgtcgaggacttctagcgcgcttttaccagcccagcagcagccgctccatgcaaatacatatggggactccagtacctggaacatgtgaattccataaaaatggaagcatctaagaggcagtgaacactggcgcccacatggagaaccaggtgcatcagcgcattgcggaccctgaggaaagcaggtctgtggttcccagaggcgtctgctgaaaactgcaggaggcccacgacccaagtccactggaactatctgcctggaggacatgccgtggatggcacgaactttgccaggagaggtgcaaggtgggctccgtgaagaacatggtcagagctgagtgcccagcagtgcaggacgaggaccgcgccacggaggcctgggccaggagccaggaaccgaacaagctcaggcaagacgtcactgtcgtacaagagaattgagcgcctggatatagaactgccggtaaaaatcagctgtggcagcagtgccccctggaaataaacgcggtggcctgatagacccacaaaatgaaggtccacaaccccaccagcgtcgggaccaacaaaggaatagcaaacaccacaaaccaaacaaaacgcaaaacctgtagcaacaccacacaaacaacggcagtgacaaagtccatcaaaccccagtaaaaaac

SEQ ID NO: 607489 - DNA, 118 bp, Homo sapiens
tcgcgaatagtgaaatcctgaggatggttgtatgtaaatggcttcatcctgctaggaccctgatgagccgcagacacatgttctcctggggaaattccttggggccctccacactgtc

SEQ ID NO: 607490 - DNA, 329 bp, Homo sapiens
ctccataatgtgtgcccaggaactcaaggctgctgtgaacagagattccaccactgcactccagcctaggtgacagagtgagaccctgtcttaaaaaaaaaaaaaaaaaaaggccttccggggttcaggtccaccagggtttaagggttacccacccaaaaaaaaaaccccgggaaaacccggggaaacttttttgggggttttcgggggggggtttttttcccccttttgggccccaatttggggggggcccccctttttgggggggcccccgccccaaatttgaaaacaggggcaagggttttcccggggggaaaaaaccgccccct

SEQ ID NO: 607491 - DNA, 189 bp, Homo sapiens
acagctgcgatacacacaccacacagaatacattacacacacacacagccacacactacacacaccacacgccacatacacaccatacacacaccacacagatacatcacacacacaccacacacagatacaccgaaagcacacagataccacacacacccccacagaaagcacacatacacacacaca

SEQ ID NO: 607492 - DNA, 102 bp, Homo sapiens
  misc_feature (9)..(9): n is a, c, g, or t
  misc_feature (67)..(67): n is a, c, g, or t
  misc_feature (69)..(69): n is a, c, g, or t
ctcgtgccntcgggcaagatggctatcaagagtatcgcttcccgcctccggggttcccgtcgttttntnagcggcttcgtggctggggctgtagtgggcgct

SEQ ID NO: 607493 - DNA, 791 bp, Homo sapiens
agcgggtatgctgagaacctggagcaggaatgcggggaagctgactttgtgttcgctattctctcaaacatgtggtaatgttcactgtaatcgaagccacaattatgtgtgtttctttggttatccttcattcaagtatagtcatccacatcacttcctgaaaacaacatgcatgctctccgtggacaggttgttcagttcaagctctcagacattggagaagggatcagagaagataactgttaaagaatggtatgtacacagaaggacgatacagtgtctcagtttgatagcatctcgtgaagttcaaagtgatcaaagcttctgtgaccatcactagtcgtggatgatggacgtcattaaacaaactctattataatctagacgatattgcctatgtggcggaagccagttagtatgacatagacaacggaagctcttacaacagattcagaacgaagatgtcgtggaaactcctgcagtgtctcatgatgaacatacacgaccaagagataagatgggccgaaaaacactgtgcaactcctgcagcttcgcccgtctggcaatggaaaacaatcattaagctgagtgaagtggttggctcaggaaaagatggcgagaatacttaaagaagatatcctcaactatttggaaaagcagacaggagctatattgcctccttcaccgaaagtcgaaattatgccacgctccaacaaagccaaaagacatgactgttcctatactagtatcgaaaactccggtattcacaaggcaaagacaaacagaaccat

SEQ ID NO: 607494 - DNA, 634 bp, Homo sapiens
tgtaaaagcttatatgggatgctcgttttctctcctcccatgggttcatagagggctcacctcactcactcttgctaacaagctgccctcattttagagagagctggagtggggtctctaaccctccagcaacagcttaggagccagacttgaagccctgacagccaacactttccatatagaccctgttgtccatcctatcttaggaagacaatgcactcaagaggaaggtaacatctaccttcggaccccagaggctccaaggagcctctctctctcttcaagacaggcttcacctccaccttcatacagtggtactgggagatgaacaagggtagggcgaaccagaatttaatttacccctggagttccagtcgggtggtgcttggtagtggactcatttttggtcccattggatatttgcagccacctgctgggaaaggtgaactgttgctcctttttcacaaataaggacagatagtttgcagaggtcagaggacgatttgcggaaggaatggttgcaagttagtttttaacctaaagcctatgtttctaagaatttgccggggacttggcaaatccttttcctttgggggcttcaatactttttgaagttaagagtctgccagtggga

SEQ ID NO: 607495 - DNA, 307 bp, Homo sapiens
aaaagattaaccaaattaaaagagattaagatggcctagaattatccttaaaaggtgccagcgttcataaagaggcatgcggggagccagaatctgagggctgctgatgaaaacccgaacggtctaattctgtactctacagtaaagcagctattctcgaaaaggacctcaaagagaaatctggaaaatcgattgctggcattaacagaggttaaaacacaccacataaccaaatcatgcagtcacgtgggcttttcatctacagggattctcaatatgattctcaccacgggtctgccttcatctg

SEQ ID NO: 607496 - DNA, 193 bp, Homo sapiens
agtaaatccagtgcctcagatgacactataatataaatagttaaattaagaatgcttatgttagggatgtacggtacaactgctattattcatcctatgagggaaactgaggagaatgctaagattttgcgtagctgggttcggctgagtccacctcaactgcctgctatgatgggtaagattgagagagaga

SEQ ID NO: 607497 - DNA, 892 bp, Homo sapiens
gcctttgaagggtgtggcttcggaccgagaggtgaggctgctgtgtcttccccctggcttgtatcagctgtgcttcttttagtgtccaaattctctttatcacctaaaacagagaggaaatacttgcagtgaatgaagattcctctgcattcttagtcactgcattattcaagcgtggtagttggcttatgaatgaggatgacagattggaagagatgaagaatgaacgctgatgaccaggatccagtggtttctatgcccctcttatgcatgtcatgtatcctgtgtttaatgatgctagaaacgagtagattctgtctgcagtccagacactgagagccgctttcatctaaggctgaagataagcaaaatccaggtctcacacatagcacgatcattatgaaaggttgtagagtaaagaaaagcgtggaagttaacgttcactggagtcccttcgttcgtgatggcagctgatgcatgtagaacgagtatactgattgaacgaccatgagcccagtaattccagagagcttgaacgaacaggcatggaggcacttcaaaccaaattctcagtaagatcccatgatgagatcacatgacatgagtgaggtttctgcagacaagtcaaggatatagctaggtccactaacacagcaacttctggataccggtgaataaatgtcgttgcggtgaacatatcagttacccagaacccgacgggcacttgaaaccaccaagagcacaagaagttggtgaagtactccgaaagtttcaggggatattcgaaaacgtatttcacaagatggcaagggcataatgtgttacgaagtgccagcgaattattcataaaccattaatcttcaaacttcaaaatgtggctgagtgtaatgga

SEQ ID NO: 607498 - DNA, 171 bp, Homo sapiens
ccatgatgagttacaagacgtcaagccccccgagctgtatcctctgggactatacagctctgggactacaatatcacccaaatgctctacctctccacaccgactctacgtagagtagttccaaagatgcaatacacaatcctctattctctacctgtattaaatatatac

SEQ ID NO: 607499 - DNA, 400 bp, Homo sapiens
ggtgtctgtattttttttttccttttttggaaatggagtcttgccctgtctcaaaaaaaccccaaataattaaaaaaatatacaatttatagctgagtgttgtggttcatgcttataaccccagcacttgggaattccaaggcaggtggatcacctgaggtcaggattttgagaccagcctgaccacctgtggagaacccacttttctactcaaactacaaaattagctgggcaaggtggcacttgctcggtaatcccagccacccgggaggctgaggcaggaggtatcgtcttgaacccgggagttggagtgtgcggtgagctgaatatgcccctatgcatcccagtctgggcaacaagatttgcaattctgtctcaaaagaaaaaaaaaggaaatgtg

SEQ ID NO: 607500 - DNA, 408 bp, Homo sapiens
tagaggatcccggaagaacgtgctggccaaatttttgtattatagatattgcatgttgtcttcgaaagagtaatacagttcatgctcagtgtagtgtgtaagtgctcttttctatgtctcaggtcttggggtgttctgatgcataaaaatagtatctcaaataggtgggggtttttttgttcgtggttttatgtgtgtgaggtgttttggggtttgtggtgttgttttttttgggacagtgtcttacttccttgtcagacaggctggatgtcagttatgcaatcacagcccactgcaggctcaaattcctgggctcaagcagtcctctgccttcagcctcccaagtagcttggtctacaattgcacatcaccacacccagctagttttttaatttttcttttgtatag

SEQ ID NO: 607501 - DNA, 106 bp, Homo sapiens
aacaagcgccagtgccctctcacatggacagtggtagaccgaagaggactatagtgctagtcctggcacagatgcacatacgcacctagggcagtgagatagtaag

SEQ ID NO: 607502 - DNA, 145 bp, Homo sapiens
gctaccaaagtgctgggatttatggctaggctatggcacacgcgcacaggtgcctggacctagcccacatcttttaaatatcccctgttccttgaggtcaggaactaccaatggagaaaataggtcctgtacttgagcaggcaga

SEQ ID NO: 607503 - DNA, 148 bp, Homo sapiens
tagtgactgatgatataatgcagacaagtttagaacgaatgctaagccttaaagacctagaaatcagaacagtggcacaaaaaacatacaggaaacactcacgcacaaagacaaggcacggttgagaaaccgaaactgtttagaactt

SEQ ID NO: 607504 - DNA, 191 bp, Homo sapiens
gtacctctccctagtttatggagagaagctcactgaatatcattgtgctagtgcatgagcttcatgtagtctttgcaggcatcctcatgcaattgctcttttcaggccaagggagggcttccattgacacctgccttaagcttttatgtgaatgtatttgaattgtcccctctttttttatttcttctact

SEQ ID NO: 607505 - DNA, 182 bp, Homo sapiens
tgtgaggtttctgtgccccaagtttgtggcaaggtgggcactactgctggccaacagaacagcagctggcaaagggaggtctgcccacagagagatgaggacatttgcttctccttcatgccaaagaatgagctgacctcctgttgctgcaaattaaatattggactgattggccaaggctc

SEQ ID NO: 607506 - DNA, 131 bp, Homo sapiens
  misc_feature (105)..(105): n is a, c, g, or t
tggggtgctctaagatcccatgctgtctacagtgaagaatattagcctatactgagcggctctgttcacctaagaagcataaaagtgagatataaagctcatatnattcaaagtacttaacttgtccaggg

SEQ ID NO: 607507 - DNA, 99 bp, Homo sapiens
ggcagggttcagaaaggattacagggaagccagatgctgtgactctactagagttcctcagtgctatgcgctgtctattccatactatcaactattgta

SEQ ID NO: 607508 - DNA, 1761 bp, Homo sapiens
  misc_feature (750)..(750): n is a, c, g, or t
  misc_feature (1156)..(1156): n is a, c, g, or t
  misc_feature (1376)..(1376): n is a, c, g, or t
  misc_feature (1501)..(1501): n is a, c, g, or t
tttggccccggggggtgttttattttcttttattcatacaaataatttccatatataattctcccgggggcaaaccggagaaaatttgggaagctccgagaggggggggggtgtcccttctcaagaagacccactagggccgggggtgatctcggcgcgcagagatgtcgcccagggtctcacagggcgcaccttgtgtgtggcctcggtgctcccacttcttgtgagcgggtgtggctctcttattctctcacacactatctcacacagacgcgtggggtctctctcagaaaggagagagaagcggggagttagagaaatctcctctcagcaggagatctcttgagggagaaatatatatcagctctcacagagtattttctcccggtgtcgcacacaggggcgcgtccctctgtagtgtgagcgcgcgagacaaggggggagtgtatcacatatctctctcactggtgggggtatctctcccagtgtatttttcctctctcagaggctgttgggggccctattaatatgtcgagaaagagggctgggcggagaagaatattttcgtccccccacaagtgtggtgttttggggggtgttggtgtgtgtgttgtggcccccaaataatgttgtctcctattatacaaagacaacaaaagtcttccgccgggagcaacaaaggtcttcctcatgcggtgttcccccgagaagagccccccgcaagaagagaaatactccgcggtgggggangtgggcgtccatccccccacaagtattgcttgcggcccgagaaaaagaggccgcccgcaaatctttctcccccgcacctgcttttattaaacttattatcccgccgagggagaagacaaacacccgcctttttgttgatgcggccaccaagaaagaacccccgcaatgttttcatacaccccccgcggaagaataatgattaacgagggggtcgtaataatggagggggggcgcagaaattactgaaggacgaaccactctttttggttggaaacaccacccgcctggtggggaggcgccaccaaaaagtactaggacaatacttatcattgatgatcatcacaccgccggcagcgacgaggggggccgacaacacaacaagcatgagtgagtgttaacaacacancactatgttctttttgatttaatcaccacgcaccaagagggcgccattattcatactattatatattacgtgcccaggagggggagacatctattaataaaccccccccgcgtattgaatatatagaccaccacttgatcgctggggcaggaaatataaagtggtagggagagttatcatcagcccgttcgtttgggaggacaaagactactataacacnccttgttgcttggcgggaccacacagaggggggagagatgagaggcacagcccctataaggagggggcttgtaataagaaagaacgaacccccccccccgctggtaagagaaagtaatacccccnctgagaggacaagaagggacgggtcgatctaacccacctctttagataagcaggcaaacccacccgtgcggttcttaatctaaaaaggtagaggcacgcgaagacaaacaaacgcgcccgggcggtgcatatttattgtttgtttgttgcgcgccaccaacaacaatatatactctggtcgggggcagaccagcaagtacttaattacacgaggggagcataaggaggcggggcacagcaacaaaacagtcctttatacg

SEQ ID NO: 607509 - DNA, 1314 bp, Homo sapiens
tccaagatggcggcgctagagctgaccctcctgctggtgacggaagtaccgcctcctcccgtactgacgcccctacaggggaccctgcatcagctccagaccgccgcggccatgtactgggccaggcaacaaacgcgccgccggcgacgggggctcagggcccccggaaaagaagcatgagatcgatgaggcgaagaccagcacgaactcttatcgagcccattcgtcttggaggcatctcttccacggaggagctggacctgaaggtactacagttcaagaaccagaaactggcagagcggctggaaacaaacggcaggacttgttgaagatgaactccgagaacgaattgagcaagtaggagaagcggcaggccacagatgatgccacaatcctcatcgatcaatcgctactggagcccagactggctgaaactgtgaaagcccttctccgatgccatgagagccagagagagcttgtcttcagagactgaggcaccataggaaacacaggaggggccaaacatgtgatgggactccatctcccaagagccaggagaaatcagagactgaaagacaccctatggctaaatgcaaggatgagagacacaatacataaagtagagccggacctatgggatatatagtaggtggcactagaggtgatagaaaaaaatgagaaaatagaaaatgaaactagaaggctgaatagaagtataacaaaggaaagagatgaaacgatggatgagtaaaagtggcgtcagtaacggacatactgcgaccgggagtacaggaaaaataggtatagacgagatgtaacagaagagtgaaacagattgagaacacacaaaaagagaagaaaggaaaataacgaaaatatgagccatataaaccgttaatgataggaattaggacaataaaaatgaggaaaaacaccggataatatgggagaaaccggaaccactgtatgatatcacagagatccaagaatgaaacgagaacaagagagaataaaaaaactaaaaatatataagaagataaaacaaaagttaagtaaaaataaaagatgatggaatagacaacgtaggataaacggaagtgcgaaataacaaagataggagatagtagagactaagcgtagagtaatatagaagtatggacaatgaattaaagcaaacaaagatagtgggtaagaggagaaagagaaaggaaagataaagataaatgacgagagacgagatagggacaaacggagtagagaaggaaaagatgtagaagtataattgaaagtaaaggaggagaagagaataggaag

SEQ ID NO: 607510 - DNA, 1086 bp, Homo sapiens
ggtggccaagtgccctggacaacgtgaatgcccgcttgtacatggatccgacgctgtgtctactaccggaagtccactgctggagtcaggtcactactgggtcaccaaaggcaaggtgcaggtggtgatcccgtttcctgacagagtcgtacaggttgcctagccaggaccctaccgtgagaatgtccatccccatctgtaccctgaatgaagcttccctaatgccatcgagcacaccctgcagtgggctcgggatgagtctgaaggcctcttcaggcaggcagcagaaagatgtgcaagcgcatggtacctcagcagacgcccatagtttgtgtggagacgaagcactgacggctggctatggcactcaggtcccttggtatggttgctggatggtctgtgcagggcgagcctggtgtctgtcgagcgaccacagagcctgggtctgactgcgtgaccatgggcctgtgcagccacctggacagcacccagtaactcgaacaagatccggcagctgctgcacaacttccctcctgacgcagctcagcaagctcaggagtcgccgttctggtctgggccaaacgctgtccacatccgctcacctttgatgtcaacaatcccctgcatctggactatgtgatggctgctgccaacctgtttgccagaactacgggctgacaggctctcaggaccgagctgctgtggtcacattcctgcagtctgtgcaggtcccccgaattcacccccaaagtctggcgtcaagatccatggttcttgaaccaggagctggagaggcgccaatggctctggtgatgacagtcgtctaagaggagctcaaagggcatctgccaggccaagaaaagtccctggatcagaatgttcccattgactttggaaaagggctgctgtccagggactttcctatgggattcatccgggtggatccagccccggcggagaacttgaaatccttctgggaacggccagagcaacctgttgcgcggaatctccccgcatggtccgaacacaaaacgggtgctccttgctgggctgcacggttcagggcgccacgtgttcccccaaagg

SEQ ID NO: 607511 - DNA, 307 bp, Homo sapiens
tagacacgcgcctcgatctgactacgcggctcgatctgactacgcgcctctgtcttcaaccagcacccgccttgggctgcaccgcagcaccctgacttcggccctcccccccatggcttcaacgggcagtctccacacatgcggagacagggcccgctccacatcaaccacgatgaccccagcctgctccccaatgtgccctacttcgatttccctgctggactgatgccccccctcgcgaagcttgtagatcacgagtacaagcctttggaccctaaagacagccgcgtagacaggagatcctcta

SEQ ID NO: 607512 - DNA, 923 bp, Homo sapiens
tcccgcaccccctctacctacgcctagcttaggctaccgcggtctaccaagctagtagctatagacggcgcgcgggactccgacgccgcttcttggccagcgttctccacacccggacctgggtcgctatgtgcagcagctgcacgcgtctgagcttcagcgtcagccgcgacggcgcctcgtctcgcggcgccagggcagttcgtaggagcgggcaggtgcatcgacttcgcccgcacggaatccaggggtcgtcaatcatcatgtaaactcgacgtaccgtagctgcgatgccccagcagtcagtggccgcaatcaccttaactgggcgcctgtgcagcgcaggcagcagccatccactagccaagtcaggtacgcaggagatctcgcacgcctggctgcagcacagctggcacgagccagatcggagacttgcgacgctgactaccgacatccgacaagacccattacccacacacgaccaacccactagacactccacagggccacgtgcgcaaccccattcacccaaccaacgaccgaaccacgcttaccgaccagcggcctaccgaccccacgagcacggattcacggactccctgaccccagaaccacggttgcaacagcagcagctgcaaagcagttgacccccaccacacctgccatgcaccacaagacctaaaggcacctggcatccatcccgcgctacaaggcgtgccatacacttcccccctaatcgggcaactttccccaacaggccacacacgaggccacacactgggacacacccccaacaccaaccatggacgcccaccgacttaggacacccgaacgcggacacatggccttgaggcccacctatcactacgcaataccaacgacttgacccctaggacgcaccgatttcccaagctagagcccag

SEQ ID NO: 607513 - DNA, 158 bp, Homo sapiens
taccagatagtgaggaaagttgagcctataatgacgtttaagtcctgtgaaagcctgtggctactaaaaatgttgagtcctgtagatccgtcggaaatggtgaagggagactctaagtactctgagagcttgtagcggggtaccggaggctcgatatt

SEQ ID NO: 607514 - DNA, 485 bp, Homo sapiens
  misc_feature (51)..(51): n is a, c, g, or t
  misc_feature (99)..(99): n is a, c, g, or t
  misc_feature (430)..(430): n is a, c, g, or t
aaaaaacagttaggcaaagaacctaagcaaacccctcctgtggggccaagnaaagagaaatttaaaaataagtatgtggactttcaaccctccctgccnattaatccacataattgccaggaggtatcaccccagaaagataagtaacatgttgaacatgatttggctgttcctcccacccaaatcctcatccttgaaatatagttcatgtaatcccccacatgttgtgagagggacccagtgggaggtaattgaatcacaggggcagttaaccctcatgttctcgtgatagtgagtaagtctcacgagatctgatggttttataaggggctcttccccccgtggctgggcacttctctttgttgccgccatgtataagaggacgtgtttgcttccccttatgccatgattgtaagtttcctgaggcatnctcagccatgctggactgtgtgtcaattaaaactctttcctttatgaaaaaaaaa

SEQ ID NO: 607515 - DNA, 936 bp, Homo sapiens
  misc_feature (14)..(14): n is a, c, g, or t
  misc_feature (791)..(792): n is a, c, g, or t
  misc_feature (795)..(795): n is a, c, g, or t
  misc_feature (798)..(798): n is a, c, g, or t
  misc_feature (800)..(800): n is a, c, g, or t
  misc_feature (805)..(805): n is a, c, g, or t
ggcagccggccggnagtccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatccaacagttggcaagatagacgtgaaaacgcctttgtgggttgagatcgctgattggtgacacaactggcagaaaacaggatatgccttggcaggggtgtgtgtgttgtggttggnncgngtngnggggncccacagcgactttactttgtgcttcccgcacgggagataaaaccctctttgtcgtatttaccgggaagaaatttccccggcttcaaacacggtgcattagcctcgccacgcgtttcatgggacgttaccc

SEQ ID NO: 607516 - DNA, 492 bp, Homo sapiens
  misc_feature (188)..(188): n is a, c, g, or t
  misc_feature (209)..(209): n is a, c, g, or t
  misc_feature (427)..(427): n is a, c, g, or t
acagtaaaaagaggagctgccatcattagggaagcaggagttgaggagagtcagagtgacaccactgaaaaatcttctctgtcttgagactaacaaggtaccttccttgccagtcacaacccatggtcctaagatggtcacagctaaggaggcagcttggtactgcctgcaaggacaaactcctaaancaacagaaagcccagatgtcncaatacccatagcaatatgtgctttcaagataattatagatgtgctttgatgtactcatgtactagactgttaaggatagttttctttaaatcagtagcataatcaattttgtcatgctgtctgctccccctcacagagtcgcagcttggtttagtcattacgtagacaagacccctatataagaaaaacttaaaacaaagacggtgcattctctcgnaaggtcccgtgctctgtaatggagtaggttttaataaacgtgcttccttcgctgcaaaaaaaaaa

SEQ ID NO: 607517 - DNA, 1612 bp, Homo sapiens
tccttcgcctatatcttcacccactttctcaccaagtcgaattctcagataggagacgactcgactctcagaaacaaaggaagtttacgtgtgtcatactcctgatgctatcactctggaagcaaatttctaactgggataactaagtccgtgtagtcaccagagtccttactatatgatggctgctcgccatactgacataaattgcgtctcctatgcagactgcagatgtatagtcggctggtacgtcagatagtcgcgagcctcacgtgacttcagactacctctttacctctctgtacgactcaagggatgaaggatgacggaagacttaagagaactatatcctatccagcacgagtgtctcatcacgccgccgatggattgctggcgatggacatacacacctactgacagcttatcatggtaacttgcacggctctcgtacgaccaatggctacgacagtcacggctctcgtagcacatgcacaatggtctgctttacaccaaacactcagtcccagtgcattcctgaacgaacagcaaacttagcgacctggtcatgcaagggcatgattctgacacgcgcgacgaccacgcacacattaaactacatagctgatgcatcattcgcgttcgagtcaccttatacgccatgcataagccacgattcgcagtaccacattgaggatccacgcggcaaccccgacacatgacataacagtggcgcaaaagagaaaaccacccgacataggacataggaacacacaggaacaacgactcgcgactatatgcagcccattccacggataactcttggcagacaaccactcctacaagctaatcgacggccaacgagtacaacgcatcagcacgcccacgacaccacacaccgccgcgtcaatgaccctcgcgcacgaccaagcacgacacacaccaaaccaacgaaactcagactcacgtaggcacaacacacctaaccacaccaccacagtcggcagcaaaccacaaacgatacaagagcaacaccacagaatcagaagcgaaccacaccacacctaccccgcccccacacgaacagacgaaagcaccaaaacccaatgatgagacagccacagcgaagatgagacaccccaaccaccctagctcagtacctagaaccaccactacccaacacacacacccacacacggagtaacacgcagtacagtcacacaagaaccacacccagaaccagtgacagaacttccattacaactcacacagcagtcacactacaccagcactagcctcaggacacacgaacgcaactcaacacgcaagcctacgacacacacacaaaagagcacaaagccaacaagcaaagacagccagctcatggcaacaccacatagccacaaatcctgactacgatgcaacacgagacagccatcaaagcagacaaacatcacagacagaagtaaacaaaacgggccacaccagcccgatccagacctcaaccacaacactcgaccacacaatgcacagaacaacattctgacttcaccatcacatacaccacacagcactgagacacccacacagccagcacgacgagccacacagcgcacaa

SEQ ID NO: 607518 - DNA, 541 bp, Homo sapiens
gacccactgcacccagcccctcagactacatacttagagtccctgaatggcagtagcgtcagaattctagttggtaagctatttctacctataattctgttaatgttggatgggaattccactcccaacataatacattttggttcctcggctacccttacatcatcctgggccaatcctctccttctgtaacccaatttggtaccagggcacataagtttactcaccgaggagacaaggaggcaactcaactacttgcttgcgttcctgtacatgaacggaataatcgggtaccaggttcacggtgactgatcatcaccagacagtgaaagaagtgaccgggtgggccacggatggtgatgtcctccggtcattggtatcctgattggtgaccttaagatgtagcagtgaggttggtcctatattcagctactcacaataagtatacaggggtaccgacaaataggaatggtgccatggggtactgggggtcactaaactaaactatgagacctgaaaggggccgggaaccgagctcgaa

SEQ ID NO: 607519 - DNA, 940 bp, Homo sapiens
  misc_feature (795)..(796): n is a, c, g, or t
  misc_feature (799)..(799): n is a, c, g, or t
  misc_feature (802)..(802): n is a, c, g, or t
  misc_feature (804)..(804): n is a, c, g, or t
  misc_feature (809)..(809): n is a, c, g, or t
agaagcgtcccagaccatgcgtcgggcgcgcggcgcctagtacgtgagtgaaccatggtcatagctgtcgccttagcgatatcctggtcatcacgtagtgctgggatctctccgccgataagaatggcccgcggggcacctggtcgttctgacgagggtccagaatgctgtcctgagctcagttcactttcatctatcagacaggagtcccatgtcgagtcgtcgagtgatcggattacagacccaggtccggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatccaacagttggcaagatagacgtgaaaacgcctttgtgggttgagatcgctgattggtgacacaactggcagaaaacaggatatgccttggcaggggtgtgtgtgttgtggttggnncgngtngnggggncccacagcgactttactttgtgcttcccgcacgggagataaaaccctctttgtcgtatttaccgggaagaaatttccccggcttcaaacacggtgcattagcctcgccacgcgtttcatgggacgttaccc

SEQ ID NO: 607520 - DNA, 843 bp, Homo sapiens
  misc_feature (14)..(14): n is a, c, g, or t
  misc_feature (502)..(502): n is a, c, g, or t
  misc_feature (513)..(513): n is a, c, g, or t
  misc_feature (517)..(517): n is a, c, g, or t
  misc_feature (519)..(519): n is a, c, g, or t
  misc_feature (528)..(528): n is a, c, g, or t
  misc_feature (536)..(536): n is a, c, g, or t
  misc_feature (540)..(541): n is a, c, g, or t
  misc_feature (551)..(554): n is a, c, g, or t
  misc_feature (564)..(564): n is a, c, g, or t
  misc_feature (566)..(566): n is a, c, g, or t
  misc_feature (570)..(572): n is a, c, g, or t
  misc_feature (577)..(577): n is a, c, g, or t
  misc_feature (586)..(586): n is a, c, g, or t
  misc_feature (594)..(594): n is a, c, g, or t
  misc_feature (600)..(600): n is a, c, g, or t
  misc_feature (608)..(608): n is a, c, g, or t
  misc_feature (612)..(612): n is a, c, g, or t
  misc_feature (616)..(616): n is a, c, g, or t
  misc_feature (625)..(625): n is a, c, g, or t
  misc_feature (631)..(631): n is a, c, g, or t
  misc_feature (645)..(645): n is a, c, g, or t
  misc_feature (647)..(647): n is a, c, g, or t
  misc_feature (651)..(651): n is a, c, g, or t
  misc_feature (656)..(656): n is a, c, g, or t
  misc_feature (659)..(659): n is a, c, g, or t
  misc_feature (664)..(665): n is a, c, g, or t
  misc_feature (668)..(668): n is a, c, g, or t
  misc_feature (674)..(675): n is a, c, g, or t
  misc_feature (686)..(686): n is a, c, g, or t
  misc_feature (693)..(693): n is a, c, g, or t
  misc_feature (696)..(696): n is a, c, g, or t
  misc_feature (701)..(701): n is a, c, g, or t
  misc_feature (706)..(706): n is a, c, g, or t
  misc_feature (710)..(710): n is a, c, g, or t
  misc_feature (712)..(712): n is a, c, g, or t
  misc_feature (715)..(715): n is a, c, g, or t
  misc_feature (724)..(724): n is a, c, g, or t
  misc_feature (728)..(728): n is a, c, g, or t
  misc_feature (733)..(736): n is a, c, g, or t
  misc_feature (738)..(738): n is a, c, g, or t
  misc_feature (741)..(742): n is a, c, g, or t
  misc_feature (745)..(746): n is a, c, g, or t
  misc_feature (748)..(748): n is a, c, g, or t
  misc_feature (751)..(751): n is a, c, g, or t
  misc_feature (758)..(759): n is a, c, g, or t
  misc_feature (763)..(763): n is a, c, g, or t
  misc_feature (767)..(767): n is a, c, g, or t
  misc_feature (769)..(769): n is a, c, g, or t
  misc_feature (771)..(771): n is a, c, g, or t
  misc_feature (773)..(773): n is a, c, g, or t
  misc_feature (775)..(775): n is a, c, g, or t
  misc_feature (777)..(777): n is a, c, g, or t
  misc_feature (779)..(779): n is a, c, g, or t
  misc_feature (813)..(813): n is a, c, g, or t
ggcagccggccggnagtccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtgcggctggggccnggtgggggtgngcgncntgggtgtgngttgtttntgcnncttgcgcccnnnngctggttggncngccnnntgtgntgtttggancgtgcttnatgggntcgcgtgntgcntgcntcgcgctgnccgccntgctagggctgcgngngcantgcgncantgctnnctnctgccnnataagccgctngcggtgnccngggtnttatngttncnctnggtgcattnttcncgcannnngngcnnagnngnctntggtttnngcgnggtntntntntntntntatatgatgtgagtgtagtgttgtgtttgccttnttttggttttttttttttgtttgtttttgt

SEQ ID NO: 607521 - DNA, 126 bp, Homo sapiens
gtccctgtgtgcacctcatggccccaccccaccaggaaggtgagtgtcccagaggaggagctcggacggccatgcttgcaagaaggccaaggggcccatcaacttcaccgtctttctcaggctctt

SEQ ID NO: 607522 - DNA, 1371 bp, Homo sapiens
  misc_feature (14)..(14): n is a, c, g, or t
  misc_feature (1226)..(1227): n is a, c, g, or t
  misc_feature (1230)..(1230): n is a, c, g, or t
  misc_feature (1233)..(1233): n is a, c, g, or t
  misc_feature (1235)..(1235): n is a, c, g, or t
  misc_feature (1240)..(1240): n is a, c, g, or t
ggcagccggccggnagtccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagaggtatgtctcaattttatttcctttaaattgggtcttctttctttgaagccaaatataaagatgtcatctgagaaaataagtattaaattagtatgtcagatgaaccttaccacatttgactttattttccaattaaatatgtattatttgggcactcagtgcccttaggcttctggaaattgggagaaaatcatcatcaagtgaaaatatggtttgctctcttttaacttattcacattaatactctacttccataacatatttattttttggtcagctaatgataaatttctctcagtaaaccatagctgggatataatcaagttctgtaggcatttgtttaattttctcagtttgtcctttctagatcaacactgagtttatctttcagtatggcctctgttacttgttattcaactgaagcaatctctttagaaaggatatggatataaaggaagcaagtttcatcgtgtcatcaaggatttcatgattcaaggaggtgacatcaccactggagatggcactgggggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatccaacagttggcaagatagacgtgaaaacgcctttgtgggttgagatcgctgattggtgacacaactggcagaaaacaggatatgccttggcaggggtgtgtgtgttgtggttggnncgngtngnggggncccacagcgactttactttgtgcttcccgcacgggagataaaaccctctttgtcgtatttaccgggaagaaatttccccggcttcaaacacggtgcattagcctcgccacgcgtttcatgggacgttaccc

SEQ ID NO: 607523 - DNA, 338 bp, Homo sapiens
cgagtttggcggcgaccggggctcctccctcttctgccccgggctcccctgctcttaacccgcgcacgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctacatagccactctgctctacgtggtccatgcggtgttctctttaatcagatggaagtcttcataa

SEQ ID NO: 607524 - DNA, 963 bp, Homo sapiens
  misc_feature (14)..(14): n is a, c, g, or t
  misc_feature (818)..(819): n is a, c, g, or t
  misc_feature (822)..(822): n is a, c, g, or t
  misc_feature (825)..(825): n is a, c, g, or t
  misc_feature (827)..(827): n is a, c, g, or t
  misc_feature (832)..(832): n is a, c, g, or t
ggcagccggccggnagtccgtcagctgtcccagagcctgtgtcgcgcccgtgccggtagcgcccgtgccggtagcgccgctgccaccgctcaccatgggcccgggtcctcggctgctgctacctctcgtgctttgcgtggggctcggcgcacttgtgttttcttcgggggccgagggcttccgcaagcgaggcccctcggtgacggccaaggtcttctttgatgtgaggattggagacaaagatgttggcagaattgtgattggcctctttggaaaagttgtgcccaagacagtggaaaattttgttgctctagcaacaggagaggttaagccagtatatgaacccagtctgttgaaatccagagctaaggaacacagttgtaaagacgactgtacctctttgagaaggatggagtttggggactcatctagcagcatctcgacaggtgtgagcatctatggtgagacatttccagatgagaacttcaagctgaagcactatggcattgggtgggtcagcatggccaacgctgggcctgacaccaatggctctcagttctttatcaccttgaccaagcccacctggttggacggcaaacatgtggtgtttggaaaagtcattgatgggatgacagtggtgcactccatagagctccaagcaactgatgggcatgaccgtccactcaccaactgctcgatcatccaacagttggcaagatagacgtgaaaacgcctttgtgggttgagatcgctgattggtgacacaactggcagaaaacaggatatgccttggcaggggtgtgtgtgttgtggttggnncgngtngnggggncccacagcgactttactttgtgcttcccgcacgggagataaaaccctctttgtcgtatttaccgggaagaaatttccccggcttcaaacacggtgcattagcctcgccacgcgtttcatgggacgttaccc

SEQ ID NO: 607525 - DNA, 408 bp, Homo sapiens
cgagtttggcggcgaccggggctcctccctcttctgccccgggctcccctgctcttaacccgcgcacgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctccgagatttggagatgagagggagctgaatccggtttattttcttctggccttttaaagtttctggcgagggaacgtatttgcgaccaattcgatctggaaatgaggccatcgtttgcttggccgcagtccttctgcc

SEQ ID NO: 607526 - DNA, 122 bp, Homo sapiens
agcaacagtcacttgcaacaagcagacaggcagtccagtccgccaacgtctattattataccaaccccactgtgtcgttggccctacatggtgcgtttttcccacacggtgcgttgggccta

SEQ ID NO: 607527 - DNA, 328 bp, Homo sapiens
  misc_feature (277)..(278): n is a, c, g, or t
  misc_feature (307)..(307): n is a, c, g, or t
  misc_feature (322)..(322): n is a, c, g, or t
  misc_feature (326)..(326): n is a, c, g, or t
cgagtttggcggcgaccggggctcctccctcttctgccccgggctcccctgctcttaacccgcgcacgggggcgcccaggccactgggctccgcggagccagcgagaggtctgcgcggagtctgagcggcgctcgtcccgtcccaaggccgacgccagcacgccgtcatggcccccgcagcggcgacggggggcagcaccctgcccagtggcttctcggtcttcaccaccttgcccgacttgctcttcatctttgagtttgtgagtggctcctggcnnagtgaagggacggggtgggctgagccgtngctctcatcggcgcntganac

SEQ ID NO: 607528 - DNA, 161 bp, Homo sapiens
  misc_feature (58)..(58): n is a, c, g, or t
gctttggaacaattaaactacagctcattctcttgcctcctcgcctgagttctccagncaactcaagtggcactcctccatgaagcccctgtaggtttcctccactgggacaaggacgcgcagagatgaaaggcacgagaagtccaagcccgtaggggaaa

SEQ ID NO: 607529 - DNA, 1311 bp, Homo sapiens
  misc_feature (698)..(698): n is a, c, g, or t
tgtgtaagtggtcgacgatctcgccagatattggagtggtggcatcttaccggcgcgtatgtgacggcacctctgttgtcgccgcgttttggggacacggcgacatagggccgtggtgtaaaaacgaggtggtgtccagagggcatagtagcgatagtttcccgccccccttaaggggaattccccatttcgtgtgaaggggggatttaacaccagtgtcaccacagtgtgtcacccccgccgaatgaagaagcttgtatgagagtctcgccacgagaagtgatgccggccacggcgccccggcgtaaagcttttggaaaggggaaacccacaagagccatcccacttccgggtggaattaaaaaggaaaagtggtccccccaaacctaaactaaggtgttttggaaaactagcctctttggaaaggacttgggaaaagaaatatttaggagaggggggagtaaggggctctttcctaaggggtggaatagccagcacgccatggcaaccaaggaaggttcaactatgggtaacgcttttggagagactgaatataatgtaagagtggagactctgggagtttggaggcccattatgaaaaggggtataagagagttctctgaagatgtatataagaattgttggggaaaaaattatatgtgctgtgaacgcacctggctggctatagccccacacgnggtgttcaagggcgtttggcacagcactgtttgccccttcgcacacgcacagagcctatactttgctcacggcacacaatattttatacttctacagtggcgtttctaatagattgttcccacaaggcacataatgtttaaatgttatagtgagaccccggttttttatatgagatccacggtatagtataaccacgagtttataatatacgagaatgccacttataatgcttttcacacgttaaaatatactctataatgggagagcccacggccactcggtgtggcttaatgccccgtatatccccgcacctcttgggagggctgaagaataaggtggagtcacacttgagggtccacaggagagtttgaagaaccacagcctggccacacacacatggccaaaaccccactttttatctataacaaataccaaaattatccacgggggtggtggcacgacaccctgtatatcccacgctatactcgggagggctgaggtattgagaatctgcttgagaacccacggagggcacagaagggtgcacagtgaagccgagagtcgcacccacctgcactccagcctgggtaacagagtgagactctgtttcca

SEQ ID NO: 607530 - DNA, 232 bp, Homo sapiens
aggggatcgggcggtcatcatgagtcaacagataagggataccttagagagaccacaaagatctattctcactttgcacaacttgtactcagcctcctcaggtgtactacgatgtacagcaaagcgacccttggtgtcatagatcagactgaaattctactcccgtcttgtcgatgctgatgacatccattaatccagcagggtaggttatatcagttcggaccttgccatc

SEQ ID NO: 607531 - DNA, 311 bp, Homo sapiens
caaaatggcagagtatgacctcccaggggcacaccacccaaaaagggaagaaagccacagatgggcgtgcacacaacttcctaaacacactgcgcatgctcccctcccaagtgtaaggagggcactgcacttatgagtagcccagcctaagggaagaatcatgggaaaggggccagcgtataaataaagtcctaggatcaaggttaaaatggcacttgaccttcacgtgcccgcttgggtctcttccaagcattatttcatttctttcccgttctaaagctttttaaaataaacttccactcctgctttga

SEQ ID NO: 607532 - DNA, 228 bp, Homo sapiens
  misc_feature (24)..(24): n is a, c, g, or t
  misc_feature (190)..(190): n is a, c, g, or t
gcgtcgtctctacacgcatccccngttatcaccctaccctcatctttatttcgcgaaggggaggggcgaatcctgggtcgcgcaccctcaccctgctccctcccagcctcagcttcagctcgtccctcgtgccccccctttcgtggtgcaatgggagagcgaccaggtgggcgcttcaggtctctggaanctcgccacacgcgtgctgcactggggcagggtggagcg

SEQ ID NO: 607533 - DNA, 360 bp, Homo sapiens
tatgtagccatgaaaagaataaaatcgtgttctttgtagcaaaatgaatgcagctggaggccattattctaagcaaattaatgcaaggacagaaaatccaaatactgcatgttctcagttataactgggagctaaacattgggtagtcatggacataaaaattgcaacaatagatacatggaactattagatgggaggagggacaacggattacgaaaactaaaccgtttgggcacatgtagctaaagtatactgggctgaccacaaatcattgaacaatacccaaaccctacagcatccatatgccatcatgcaattataacccaggtaacaatacctgcgcatgttctacctttatct

SEQ ID NO: 607534 - DNA, 329 bp, Homo sapiens
  misc_feature (29)..(29): n is a, c, g, or t
  misc_feature (218)..(218): n is a, c, g, or t
  misc_feature (269)..(269): n is a, c, g, or t
  misc_feature (289)..(289): n is a, c, g, or t
gtttttctcagatgcagtgattttaagantcacatggagtgtttttaatgttctattccttccccccaacatacttgttttgttgggacctacaattctgcctttgctgggtgcagtggctcacgcctgtaaatcccagcactttggaaggccgaggcgggtggttcacctgaggtcaggacttcgagaccagcctgaccaacgtggtgaaacctgtntctgctaagaatacaaaaattggccgggcgtggtgacgggtgcctgtgatncccagctacttgggaggctnaggcaggagaatccgctttgattccgggaggcaagaggtt

SEQ ID NO: 607535 - DNA, 360 bp, Homo sapiens
  misc_feature (310)..(310): n is a, c, g, or t
ctaggaagccgctctgaccatgttcacgctttcgcgcgccgcgcgtttaccatatagagccggtctgtcttctagtcaccttggcggcgcccgggggtttaagggaagaatcccataatgctgaggctatggagaaaaacgccttagtcctggaccctgaaagaagccggtgagagaagtggtgacttggaatcctccataggaaagtgggtagaaaaggatctaagggtacctcaaggttctcaggacctcctttccccagatcttagggtcctgccctgtgggtctcctgtgtccaggggagaggatnctgggagtagaattgtgaagggcaaatccctgttcccggtggggatcctc

SEQ ID NO: 607536 - DNA, 104 bp, Homo sapiens
ctccctgggaggtgtttaatatccactgtgaataacactgatctggcattcccttccctggggcttgcaagggccttctggtccagccctagcctggcacagtc

SEQ ID NO: 607537 - DNA, 351 bp, Homo sapiens
cgtcgacaaaaggagccaagacgtttgggattcactccttcctagcatccaatacggtgacccatctctattatccagagttggcgcgtcagctctttgaattggctgttgaaatcaaggaaaagttgggcatttctctagactttatcaatctttctggcggtattggtgtcaattatcgtccagaccaggaaccaaatgatatcgccttgattggtgagggagttcgtaaggtatatgaagaagtccttacgccagcaggtcttggtcagattaagattttcaccgaattgggtcgttttatgttggcacctcacggtgctttggttacaagagtgactcatagtcgac

SEQ ID NO: 607538 - DNA, 320 bp, Homo sapiens
  misc_feature (39)..(39): n is a, c, g, or t
tgagagcaagatgcttgacagatgctagccttccatgcnccgttccctttccgagacagagtctcactttgtagcccaggctggagtgcagtggtgcgatctcagctcactgcaacctccacctcccgggttcaagcgattctcctgcttcagcctcctgagcagctgagattacaggcatgtaccaccacgcccagcaaatttttgtgttttcagtagggatagggtttcaccatgttggccgggctgatctccaacttctgacctcaggtgatccgcccgcctcgacctcccaaagtgctgggattacaggcatgagc

SEQ ID NO: 607539 - DNA, 602 bp, Homo sapiens
  misc_feature (325)..(325): n is a, c, g, or t
  misc_feature (393)..(393): n is a, c, g, or t
  misc_feature (406)..(406): n is a, c, g, or t
  misc_feature (448)..(448): n is a, c, g, or t
  misc_feature (457)..(457): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (486)..(486): n is a, c, g, or t
  misc_feature (488)..(488): n is a, c, g, or t
  misc_feature (496)..(496): n is a, c, g, or t
  misc_feature (537)..(537): n is a, c, g, or t
  misc_feature (541)..(541): n is a, c, g, or t
  misc_feature (598)..(599): n is a, c, g, or t
aagcctcgtcaaagcaaattataacgaccagtactatttttttttggaattgaaaacccaagaagccctaaaataagaacagtgagatcaaaggctggtttctaaaacaatgcagaaaatagaaccatgttggaattcctaaattctagctttcaaatactactgtttccaacagtgaatccttgacagagactgaatgcagatggaattttgaaacattttcagtagctacctcctctcctgaaattcctataagtggcagaggaaaatccaaatccctttaatataacatgttccatctcatgactccctgcttacacacatntgtgtttgatttgcttccatttctggaagatgggaatttgcagaactggtgacatttccctttattanaacacccgaaatnccccgaaaaaaacaattctgtgcctcccccttttaggattcnggttatganacctaanaaagtngnggtaaaaaatcccngngaccgccngttaaaaaagtgaattggaaaaaaaagggttccccaagttnaaanaaatttttgtttcccgaaatgccccaaaaaaatccctttattccggcccgggggttnnatt

SEQ ID NO: 607540 - DNA, 750 bp, Homo sapiens
tttctagtaccattcggtttaggacgcgcgtgccctaggtaggtataggtcgacacgatggtgcatagctggttatccgtatgagatccttgggtcgatcgacctagtgcttgtggattctcaaccgaataatacaacgcccggtgtgaaccagatgctgttctagagctaggtccaggatggaggttctagaggtcataacttggatctattcaatcgaggatttccaaggcgaggctcgtatatcaaattacgaccccgcccggggattgattcaatggaaggtagcatgctgaatggctaaatgggcaacaatttgaatttcccctgaaattttcttggacacaatgatggcacaagaaaaacacatgcaaaggcacacacaaggaaccagctggcaacgcacaagcacacatttcagcagacagccatttacacggtgatggcttgtggataacagcgactggctaaattgggccttagttatttcaggttgcctggccacggacaacctttcgccccaatggttgcattgtaccacaagagccctttggtgacagcagcacaggatttaaacccaggattggaaacgcagaggttaggacttgaacattgaaatacaggggggacaggcgaggtattatttggcatgggtggattgggctccacgagtagagttattgaaaggaggtttgggtagaagattggatggaccagaccagtagtggcacgaggcttggtacccgcaca

SEQ ID NO: 607541 - DNA, 155 bp, Homo sapiens
actcacacagagaccaaacttcttagttaacacatgtgaggcaatgtgcggtgctccttcatgttcctccttccgaatacttacaaggtaggaaatttcttattcagatgttcatgtgtatatgggggtgttatacacacacgcctatatacctt

SEQ ID NO: 607542 - DNA, 122 bp, Homo sapiens
aacattcgtgtactgggggtaccgccaattctgctccatggacatccggaaggacaggcagttgttgatagttggcataacattggccctgtagtcgtcaggtgcttgcctctctccagaaa

SEQ ID NO: 607543 - DNA, 332 bp, Homo sapiens
tgacacaggctcttgcttttttactcaggctgtgatgcaccggcatgaccatagctcactgcagcctcaacctctgggctcaagtgaccctctcacctcagtctcccaagtagttgggactacaggtgtgcgccgtcatgcccagctaatttttataagattttttgaacggcatctcactgggttagcccaggtttgtctcaaactcctgggatcaagtgatcctcctaccttggtcccccaaagtgctgggattataggtgtgagctcgcctcccggtcctaaatttagtcataaatttagccgtcgttctaaagttcccagcttaccac

SEQ ID NO: 607544 - DNA, 463 bp, Homo sapiens
cttgttgtaacatgggtgtattgaataatggtggaaattgggcttctagtgtacccatcatccaaatattaaacactgtacccaacaggtaatttttcaacgcttactgccgctcacactctttcccctattggagtccccagtgtctgttatctccatctttatgtctgtgtgtacccattgtttagctcctacttttaagtgagaatatacgcaatttgttattttttatgtctgaatttagttcacatagaataatggcctccagctctatccatgttgctgcaaatgacatgatttcattcttttttatagttgcataatactccatttatatatctctctctatatatatctcacgttttctttatccagtcaattgttggtagatacttaggttggttccatgaatttgctattgtaaatactgctgcaataaacatacatgtacaaataaaaaaaa

SEQ ID NO: 607545 - DNA, 478 bp, Homo sapiens
  misc_feature (400)..(400): n is a, c, g, or t
ctggtcgattacaggatccccgccgtacagttggagtcagcacgtgcctggagctgacaggcgctggtgtgtggccatgctcttatgtggcactcgggcagtccgctagtgcctcagcatgtcaaactccagctgtacgcacggagtctggagtccacaccagagcagctgcaggccatgaggcacattgttatgggcaccacctgtcccagcccctcacatcatctttggagctcccaggcactggcaagactgtcacgttagtggcggccattaagcaggtggtgaagcacttagcccaagcccacatcttgagctgtgctccatccaactcaggggctagactactctgtcaaaggctccgggtccaccttcctagctccatctaacgactcctggncccccagcaggacatccgcatggtacctgaggacatcaagccctgccgcaactggtacggcggggggtaccgagctcg

SEQ ID NO: 607546 - DNA, 144 bp, Homo sapiens
ccgagatcgcgccactgcactccagcctgggcaacagagcaagactccgtctcaacaaacaaacaaacaactcaaaaaacccttaactccatattctcttctggcacgacacactggcacgtggatccacaatggcacgtggat

SEQ ID NO: 607547 - DNA, 1467 bp, Homo sapiens
  misc_feature (940)..(940): n is a, c, g, or t
ttttttttggagggaatgtcagtccacctttatggggcgaaaccctgcaggggtaactggtttaaaataatctcgtggccctggccccacccatgtggcccgggggggctcaagacagatcatctccagctggccggggcatactccagatgagacctggtttgggccagtttctggtgggagggagaatgggtgggtggttcttcccgggtctttctgagcgtggctgggtctgggcaaaacactggtgagtaagtgttgtgtggggcgcccgaggacccacctctcgtctttctgggcggtgtaatgttctgtgtgctattcttattggcgcggtgtggtgttgtagaaagaagagaggagatctccgggggtgtgtgcctctcaggtgtgaaaaagcgagatctttctcttcagagtagggcctctctctcagaattgcacccccaggagcgaatctctcatttcgcccgtgaattaggtgttcagagagcagcgagagagtgtgtcacaggtgaacagaagaggggtgtgtagctctctctgcggagcgggggaaagtgtgtatcaccccttgtggcgcccgagggcaaaccaccttttgggtgtgttaagctgtgtcacactttcacaattcgagggtatattgtgccctcccgagggggcacccacgggggggtgccttgggaatgtgttttaagaccatgtgtgggcctcgtgagtaagtgtctccccttgtggcgagggtccaggccgcggctctccacaaaactctcccgggtgggtggggaaaacacctcgagaacaccaacgcgcggggttctcggtgggggcaaacagcacgaggtgaaaactagaccgggggaaccgctgttttttggaaaggtggcgccccaaaagagaaaggctgtggtggttggccatatatataagggcgacnttaggaatcataccgggggggggaaggctgtagcctcccccattgttggtacaattcaaaaaaaggctttatgacttaaggcatattttctgggaagactgatgtgggggccctacattgtttaagagccggccttctagaaaaacgagggaagggcggggcagcaacatcggctccgcacttgctggcagcacatcaaccaaagagcaaatcggcaccacccacagttggtggggcggcccccccgtcgaaattttcttccccaaggcgtcatgttggttcacacgcgggcgggcacccacaagaaaatttatcaaagcactgagacatggatatgggcgcgacaacgacgacttagtgggtggtccccccttgttgtgagggttcgtgcgccaaccaaaagcatgctttagggcgtcttcaccagagaaacaagaaccactatatgttgttgagatgtgctcgcaaccacacaggtttcagtttccccccggcagcatagttggcgttactatcaattcttcggg

SEQ ID NO: 607548 - DNA, 784 bp, Homo sapiens
tttctacttggagatggactcgtatcagaggctgcagcagctgcatgtggcgctggggtcaaaccgagccaaacatcccctgaggcatgccctctgaggggggagcaggctctgggttgctcctgctagcccccaggtggtggtgggcttgcccagtgcccagtacacatcatgcatggtcacaatgcctggcacccactacctagggtaacgccagcgcggtgggcccgcgaagcaacctacgggccaagcagaggtacttggagcctacagcaggagcggggaaccgcctaaggacggggagcacggaggcgagccaaggcttggactccatggggccttataaaccacgctagtagcgttgtgaagggcccggaggcgaagaagaggcacaaaaaccgaccattagggaggaaggactatagaaggcccaccagacaggccttggatactccaataggtgcgaagaaccaatagagccccacaatggtgcataggagccccagggggctggagaaaacgaccgcaaggacggtggaggggcacctccgcaaggcacaatcaatgcgcgtacgaaaggaagcgcaaacagagcaaacgtaggagaagctgaaatacacgccacgagtggattaggggcgcaaggaataaatacaaaagccacaaaccagacggcaacaatagaactgcgcgacataaacgcaactcatagaaagaggccatgaaacgcgaggcagacccagacgaaattagggccaaaagcagagcagccaggggcaaaacg

SEQ ID NO: 607549 - DNA, 386 bp, Homo sapiens
atacccagtctcctagtttaaggcttctccagtgtgtgcctgacctcctatgattgactaccacacacttgtcttagctctttatcagttctatcctcacctcccaccagagactgcaatcatccacagtcactgtccctctgaaatgagacccagctccagaacagatggcagtctgaacttccagtcctgggatagacctcataaagccattaccaggaagcagacagccagagagcaagcagagtgtacagggctagactacagcaaggaggggacagctattcttgatttcaaaacagatatcaccagaggacttttcgcagtagaaagcccacttagtaactaactgtgccccctacctagccatacaccctaaagatacc

SEQ ID NO: 607550 - DNA, 186 bp, Homo sapiens
atgcctctcgtcttaggtgggctggtggggtggggctggcagtgtgaagtgaggctcctgggctggagaatcacaggcagggcccatccgcactgtgctcagtgctcattcctcggacacccacacccacccagttcacttgtcagagcttggatttcatgtgcaaatgagttgaggggagaggaa

SEQ ID NO: 607551 - DNA, 391 bp, Homo sapiens
aaaaaaggtttttaaggacctaaatgggaaggtccaaattctttgaagggattaacgaaatttttaaaccgggtcaatccatttgaagaaaaagttgggcaaaataatcagcattgctccctcttttatttaatatttggggactggttttatccacctggaagttgaaggtaaggggttttgggaaatacttggatttactctgcttacctttttgtttaagtgtttacacagtttggttcaattttaaacaattggccctttactatgttatttttattttgtttgaaaaccttatcccccctatttatttttgttacaatttttacttatgttattttgttttgcatttacaaccccctttttaaataaagtgtttttgggactttta

SEQ ID NO: 607552 - DNA, 529 bp, Homo sapiens
  misc_feature (81)..(81): n is a, c, g, or t
  misc_feature (181)..(181): n is a, c, g, or t
  misc_feature (395)..(395): n is a, c, g, or t
  misc_feature (417)..(417): n is a, c, g, or t
  misc_feature (518)..(518): n is a, c, g, or t
  misc_feature (528)..(528): n is a, c, g, or t
caatcatcgcccgtttgataatgtcggcggcggttccctgccattggcgcgttaatggctgcacgttcagccgctgcacgncgagcaccattgctggatttgatatccggcagatacagacggcgtctggatggtgagatgagtgaaggcgagctggtggatgcattccgccatgtgagtnatgcgtttgagcaaaccagcgaaaccatcggcgtgcgcgcaataacgcgatcaacgacatggtgcgtcaacgtctgctgaaccgctttaccagcgagcaggcggaagggaacgcaatttaccgtctgacgccgctcggcatcggcattactgactactacatccgtcagcgcgagttttctacgctgcgtctttctatgcagttgtcgattgtngcgggtgagctcaaacgcgcanagaatgccgccgaagagggcggtgatgaatttcactggcaccgtaatgtctatgcgccactgaaatattcggtagcagaaattttcgacagtatcgacctnacggaacgtnt

SEQ ID NO: 607553 - DNA, 461 bp, Homo sapiens
gcacgagggcaaaaagcagccaagtcatctttttgttggctctgtttttgcagtgccattattgtcctggcaaattggaagaatttagacaaggaattagtgaattacacatgcatgtgtgttaataccctttcttttattactttttctttggtttttgaaatttaatttgctgacatttgaaaatatacctacaattacttgttactgaataactacttattcaaaatatcatggaggaaaatcacaagacctctaccgtgattcagtaactaaattatgttaatagctacctgaaatttcctaaagaaagtccaaaccaatggactccactaaatgatctcttagagaattactgcttatctctcattatgatggctggttaggataagagagtctgtgtcctcaagagcctagcagccatgtttaggggtgggctgtatgaatatatttcattgact

SEQ ID NO: 607554 - DNA, 570 bp, Homo sapiens
ggacaccttctgtgtacagagctctggacatgcattgtctgagctccacagaatgccccattatgcagatgaagaaactgaggccccaagaggtttgagagttgctcaagtcacagagcccaatttgacaggatctgatgcctgggcaggtgctccccttactcaatcctgccccgcagggtgaccctgtttgcagcacgatgtctgaagaagaggcggctcagatccccagatccagtgtgtgggagcaggaccagcaggtgagggctgcctctcccatggagcagggacagaaggtatcgtgtgggacagtcccttctaggagcgtttcaggccaggtatcccgccccaatcctctccttgctgggaaaacctgagtcataaaatattttggtccatggaggggatggtctatttcctagtgggggcttaatgaggccctgggaggggagtgtctctcaaagacacccagctggcttctgtggcccctcacaccacctgagtcccctctactattttttaaccaaatcaacaacaacctatttagctgttccccaaccttttcctccg

SEQ ID NO: 607555 - DNA, 397 bp, Homo sapiens
gagtcttgggatctgtcatctgatgctgtgtgggcacctaaggtgaatgtcatggcagaaagtgtcggtgcttagtgatggctgctcacctgtacaactcatgggacctttgccacatgagtgagctgcactgtgacaagctgcacgtgtatcctgagaacttcaggctcctgggcaacgtgctgttctgtgtgctggcccatcactttggcaaagaattcaccccaccagtgcaggctgcctatcagaaagtggtggctggtgtggctaatgccctgggccacaagtatcactaagctcgctttcttgctgtccaatttctattacaggttcctttgtaccctaagtccaactactaaagtgggggatataatgaagggccttgagcatctggatt

SEQ ID NO: 607556 - DNA, 652 bp, Homo sapiens
gggagcctcgtctcgatgctagcccgggagctacccgccgtcgtcgcccctgtccgggccagctaggattagcgcgctgagacgctgtggcttctgcgatgagtcgcctcgtgcccttcgagtcgacgccgagtagcacgtagggcctctaccggacgcagtcttctcgtccagactgccgattcgcagaaagccaggtgatcaccgttaatgcccgtagctgcctgtggaggaggcgggtgaggacttatggctaagaggctgagacaggcattccaaggggactccatcccggattttcgatgctgctgatcctgggggtgggccccgatggtcgacacctgcatcacgtcttcccagaccatgcccctcctacaggagcgggacgaagattgtgggctccgcatcatggtgactccccgaagccatccgacacagggtgtgaccctcacgctatctgtcctgaatgcagctcgaactgtcatctttgtgagcaactggagaaggcaaggcagctgttctgaagcgcattcttggaaggaccaggaggaaaacccgctggccgccggcctggtccagccccgacaccgggaaactgtgcgtggttcttggacgaggcggctgccgcctcctgaccgtgcccttcgagaag

SEQ ID NO: 607557 - DNA, 140 bp, Homo sapiens
atatcgtcgactgagctgaaggaatttttctcagtactactactaaactgaaaaaaagtcagcacttacattaagaaaattggctacaaggcccacacaggagcatttgtgccaatttctgcgtgcaatggtgacaacat

SEQ ID NO: 607558 - DNA, 437 bp, Homo sapiens
  misc_feature (5)..(5): n is a, c, g, or t
  misc_feature (32)..(32): n is a, c, g, or t
  misc_feature (77)..(77): n is a, c, g, or t
  misc_feature (208)..(208): n is a, c, g, or t
aaaanttccccccacttcattgacaaaggtangaacctggaagcccccctaagatgtccttatcaagcttgtttggntgtgggaacaaaagggacaagggtaataatagggcttgaaagctgtcaagtgggcaaacatcaaaaatggagtcagagctgggcacaagtggttcacacttgtgatcccagcactttgggaggccaaggcnggcagtattgcttgagaccgtgagcttaagacctgcctggagaacataggaagaccctatctctacaaaaatttaataattacccaggcatgatggcacgtacttgtagtcgtagctacttgggaggctgaagtgggaggatcgtttaagcccaggagtttgaggctgtagtgagctatggttgccccactgccctccagcctgggtgacagagtgagacctcgtccct

SEQ ID NO: 607559 - DNA, 402 bp, Homo sapiens
gccagaatgttcctgcgacaactatctgttgatggcctgcagaagtccattctgtattacgcggatgcttgcttggttgagtgtcggagggatagcatctacgtcgctgggtgcgtcagccttcccccctctcgttgcatgtgcgatatgcggcatattttcggtgcgtggctgattagtgaacgcggcgactggtcggcacgtgaccgatgaccgtcatagttgtgtctccttctcgttctgcacgactcatgccccgcatagcggacttccttcaagttgggggttggtagaactaccaacgatactaatcttttcgtgatgaacctcaccctacgcttctcttgagaatccgataggcctgtcgcgtcttttaaacaggattttctgtgcccttttcaa

SEQ ID NO: 607560 - DNA, 345 bp, Homo sapiens
tgcttagaggatcccgcagaggggtctccagatcacctaagaaaccccagacagagggtcccagactcacctaagacacccccagacagagggtccaagctcacctcagagacacccccagacagagggtcccagactcagctaagacacccccagacagagggtcccagactcacctgagaaatacccccagacagagggtcccagactcacctaagacacccccagacagagggtcccaaactcacctcagagacacccccagacagagggtcccaaactcaactcagagacacccccagacagagggtctcagccaacccaacagacacccctcgtgcgggt

SEQ ID NO: 607561 - DNA, 706 bp, Homo sapiens
ggtcccttagaggatgttgggccctaaaattaccttgccaagagataaataagtgggggttaaaacaaatcatgttataacaggccgggcgccccatggtttcggttgtgtttgcgcgccacgctttggggaaaaaaataaaattggtaaaaggcagccacatacccattcttgtggcaacaataactacaaagtgagtttgtatgtatatagagagacacgctgtttgcatcacatccgcaaggaggcaaatcattccagtctcttttaaaaaagactctccccactctcttcttatataaatctctcttagcaaaacaaaaaatctctatattctacattaacgcgcgtcttgtataacaatataaagactcgctctatgtaaactattttctctctcaggagaaactctcgtctgattatggagcgacatctttcgccgctgccgcaccctgagaagagaatctttttttcccacgggcggcacacgtgagatgtggaagaattctttttgtgtctatataaaagtcactgtgcagcaccaccatgtatgttcttaaaaagatacagtgaacacatattttcggagctctccctcatgccgcactggtgagggcccccctccctccatgaagaaaaaaatttagagacgtgtattctgaaaaaaaaacaacggatacttcttgttaaaagtcccacaatcgtc

SEQ ID NO: 607562 - DNA, 653 bp, Homo sapiens
gcacgaggttttccctactcttacatcttgtcatcatacgaatactcacctttggaaaccactgcaagcaatacatacccattcaagatcctaaattcagagttatcatatggaccaatcactgttcaggaatttatggaggttaaaaacgctctagtgtcttctgaagccatggagcagcatctaatgaaagtgagttaccacttgactgactagctgaaaattatgcactataagtagctcggaaactatgcttattaatcaataggaccgtcaactatttggtgtattcttcacatataggtgctttctaaataaaattttgaaagtaacttctaatcttgaatgtgtcttctactgaaaattttatgactatgtttgttcattctttttgctttgtggacttaaatcacttaccctttggttcgttaattttccaatgttctttctcatttttaatctatattactttaatattttctttttctatttatatttacctctttaattatttgccttggaataaattgtattgtatctataatatctcggttattccttctttctttatttatattatctttggttgtattagctgtttatttattcctctatattctatatattacttatacttattgttgtattcttca

SEQ ID NO: 607563 - DNA, 1149 bp, Homo sapiens
gtccaggtctgtgcattcatggggccgagagggtagaggctggcagttgaaaggaggaggccctggcgaaagagaggaggtccaggtgtcatcagtagcgtcgccaatcctcttgggctgaagcccggcgttcgcccagccaagggcatgtaccttgagccctgagggccttcatcggcagtggtcaggaagcccggagccattggcaacctcacgctccgaggtcttgacatctcagcttcatctcccttcaatgcgtccaggtagcagagacatgcaagacagacgaacagcagcctgcgccaagccctgtgagggcggtatgggatccgactacgccgccccgggaggtgccaatcaccgagagattcaacatcccggcgggaccacagaatgagcagtcttgtggctgttgcaagccatccgtaggtatggcaaagactttggggctattgcagaggtgattgggaacgaagactcgtgacccaggtgaagactttctttgggagctaccggcgccgctttcaatctggaggaggtgctgcacggacatgggagcgctgagcggggactgcgggcccctggaagccacacaagtacaccatgggaggaggctaggagaaggggctccataggcaggcaccgagaccctagaggaagatgatgaggctccagattgcactcgggctccacgtacgtgccccgaaaaaagggcgaaagatcgccaaaaaggaaacgagacacaaacacaccatgagagaccacacggggtacacacgcccacaccgccataaagggaacgacgacacagcaacccaacgacacaatatagctcggagagccacatacacatgaacacatacgtagcaatggacaacagagcaggcaagaacaaaacaacaaaaacgaatacaccgcacaaggacggcagagagaaccacaacaactgagggaggaccgacgacgagagcaactcaagaaggggcacagactacgaaaaagatacaacaagcgagccacacccgcggagacgacagctcgaggaagacgaaccagacgagagatcacacaacacaaacgcaacgcacagccacacacagacgcacgcgggagcacacacataacaagtgacacacgaacccccaacgg

SEQ ID NO: 607564 - DNA, 319 bp, Homo sapiens
  misc_feature (103)..(103): n is a, c, g, or t
  misc_feature (109)..(109): n is a, c, g, or t
  misc_feature (112)..(112): n is a, c, g, or t
  misc_feature (176)..(177): n is a, c, g, or t
  misc_feature (180)..(181): n is a, c, g, or t
  misc_feature (185)..(185): n is a, c, g, or t
  misc_feature (199)..(200): n is a, c, g, or t
  misc_feature (202)..(202): n is a, c, g, or t
  misc_feature (226)..(226): n is a, c, g, or t
  misc_feature (240)..(241): n is a, c, g, or t
  misc_feature (244)..(244): n is a, c, g, or t
  misc_feature (265)..(265): n is a, c, g, or t
aagctgagtgtgcagatgtgcgtttaacaacggacacccattcccaattcatgacttcccacttcatgactttgcttctttggagataattaccagctttggncaaagnacncactgagaaaactattagtttcctagttactaaactgcaatgtttgctacttttctatgaaggnnggnncctntaattagcacccanntnacagctgctgaaactcggccgcangtaacgcaggcccnnctngtgggttgtctttcctgcccnaaggtctgaagcccatctggtctgagtgcctagctctcttgccatcaatacccc

SEQ ID NO: 607565 - DNA, 83 bp, Homo sapiens
gggtccaaagagggtccggcacagagaagggctaaggctgactgtgacatcagcaggttgaaggagcagctcaaggctcgaaa

SEQ ID NO: 607566 - DNA, 911 bp, Homo sapiens
atctgttctggatctcaaacatgccttctttactattcctttgcacccttaatcccagcctctcttcgctttcacttggactgaccctgacacccatcaagctcagcaaattacctaggctgtactgccacaaagcttcacagacagcccccattacttcaatcaagcccaaatttcttcctcatctgttacctatctcggcataattctcataaaaacatacgtgctctccctgccaatcgtgtccgactgatctctcaaaccccagcaccttctacaaaacaacaactcctttccttcctaggcatggttagtgtggtcagaattcttacacaagagccaggaccgcaccctgtagcctttctgtccaaacaacttgaccttactgttttagcctagccctcatgtctgcgtgcagcggctgccgctgctttaatacttttagaggccctcaaaatcacaaactatgctcaactcactctctacagttctcataacttccaaaatctattttcttcctcatacctgacacatatactttctgcttcccagctccttcagctgtactcactccttgttgagtctcccacaattaccgttgttcctggcccagacttcaatctggcctcccacatttattcctgataccacacctgaaccccatgactatctctctgatccacctgacattcaccccatttccccatatttccttctttcctgttcctcaccccgatcacgcttgattcattgatggtggttccaccaggctaatcgccacacaccagcaaaggcaggctatgctatagtacaagccactagcctgcctcctccaaaactctaattcctttccatcgtggaatctatctcaggaataatgtctccaggtccatctgctgtactaaaattct

SEQ ID NO: 607567 - DNA, 270 bp, Homo sapiens
atcgtgtgcaccagcttgacctacagcagcattttttaaaggtagatttttggccacatttaaaaaaatcatattttttttggagtgctaaggaaaaaatgggtgacagtccagaaaatattataaagatgagtgggccaggcacagtggctcacgcctgtaatcccagcactttgggaggccaaggtggatggataacctgtggtcaggagttcaagaccagcctgaccaacatggagaaaccccacagcctgtgcaacacgaaataag

SEQ ID NO: 607568 - DNA, 351 bp, Homo sapiens
  misc_feature (182)..(182): n is a, c, g, or t
  misc_feature (292)..(292): n is a, c, g, or t
  misc_feature (337)..(337): n is a, c, g, or t
  misc_feature (350)..(350): n is a, c, g, or t
gaggcagggttgggagttggagcaggaagctgagggtcttgtcatgcccgcccttccttccacgtggctccaccaggctgccctctgggaaaggaggccctggaatgcccgcagcttcacagcaggaagagagcacggtccacgttgcccacaggttcctgctcaaatccagagtgagcctncaggacagccagaaagcccacccaaggtgcctcagcctggagctcacccaggacgcagagcaggtgcaggtgcaggtgcaggtgcaggtgcaggtgcaggtgcagacggnagacggacgcatcaggggcgtggtgtgaataacgccccgcttganaagctcaggcctng

SEQ ID NO: 607569 - DNA, 125 bp, Homo sapiens
acgaatcgagccggtaccgatactatacccacttcacaggccatccagaggagctaatgaattatgtaacctagcaaagcctggtacaaaacacacccgttggcctggatatgaacacatattcc

SEQ ID NO: 607570 - DNA, 345 bp, Homo sapiens
gtcaaaatacccagtaatgtatacttagattttatttatttgagatggaatctcattctgtcacccaggctggagtgcaatggcacaatctcagctcactgcaacctccatctctcaggttcaagtgattctcttgcctcagctcctgagtagcagggattacaggcatgagccaccacaccctgctaattttttttgcatttttagtagagacggggtttcaccatgttggccaagctggtctcgaactcctgacctcaggtgatccacccacctcggcctcccaaagtgctgggattacaggcgtgagccaccgtgcctggcccacgcaatgagtacagatta

SEQ ID NO: 607571 - DNA, 959 bp, Homo sapiens
acgcaggacagaccttagccaaaccatttatcgccatattgaaagtatagagcgatagagaattgaatcttggtgcaatagatatagctagcgccatggggaagagatggaaataatctaatacgcgcacgtcataattatagcaaggtactaacccaccttataccctatctggcaatacatgacattaagctagtacatatatctttgacaaggagtagccctaaaggctgaaggaaccgcgcgccgtgagagatccaggtaaacgagctctagcctaataggaacagtctaaagaagcatgacaacatccccggtactactgatagacaaacaataggtaggggacaggattttcatagcggtacggagcgaccgagcagaatccctagcgcgaagctcatgggtgtagtgagtccgtgggttgggtcgcataggtactaggaaatctttagttgggcatactgtgtaaagtttgcccacacgagaaatcgcgatcataagatgcacccgtttgggtaaaatttgttagaagctgggtatgaggtgccagatagagatggtacacacatgtgctgcatgttgcgagacgcatgcgtaaggaaaaacagaaagagccgttggaatagggaggaacgaggtaatagagaaacatgttaaaagaaagctcaaattacgttgatgggtcgcgttagacataggtctagggcgcgaccccaaaggtttcacatggaaagaggccggtgtacaaaggtccgttccaaaatcgacacactaagcgtaaactctgtaacacaaaatattccccctagaataagcacttagttacaaccgtggaagaccattcacgttccaacaaggcagcgaaactaaggggaaccaagaatccttactctaggactctagttaagaaaaggaaagcttgaaatggttaaggcaattaaaagctcaagcgatgg

SEQ ID NO: 607572 - DNA, 162 bp, Homo sapiens
gataccccattatgtttcatgcctgtagtcccagctacttaggaggctgaggcaggagaatcgcttgaaccctggaggcagaggttgcagtaagccaagatcgcaccactgcaccaggctggagcctggtgacagagtgagaccctgccacacacacacaca

SEQ ID NO: 607573 - DNA, 109 bp, Homo sapiens
gtgtatagtccagctggtaacctcctctgccgtcgccacctgtctgggtgccgtgtctccttcctgcctggccgtggtgcgtcctccccgtcatcgggcgtgtgcgctt

SEQ ID NO: 607574 - DNA, 293 bp, Homo sapiens
acagacattgaaactctttgcacgagctggccattacaatgaaagagagagaagccaaagagatgcatgaaaggaaacgacaacgggaagacagagattgaccctcaacgaaaaagccaacacgggaacagagagtggcagaacaacactttgacggaaacgtccagcatggctcgtgctggacacgcctggccgaaaccttccacagccaactaccgaacggggaacgaacagagaacgaacaaactccggacccttccctgacgcacccacccgacaacgtacaaaacctg

SEQ ID NO: 607575 - DNA, 216 bp, Homo sapiens
ctttggcttttgagggtgctccccccccagccccccccccccccccaaaaagtttcagggcaaaattgaacaggtttcgggaaggacccttcatgccagctaaaaaggctttgggcccaggaaaaaattgggcttcgggcaaaaaaatgtttgtgctatttagtactatgtaacaaatccctccaaaacttcattgcttaaagcccccagcctgta

SEQ ID NO: 607576 - DNA, 193 bp, Homo sapiens
agcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcttggagaggcgtcgagcacagtagggcggcgggg

SEQ ID NO: 607577 - DNA, 193 bp, Homo sapiens
agcggccacgctgaggcgagggtgacacaccatgctcacggcccctggagaccgtcgtgctggcgagccgtgctccgtagctccccggtccgcctcggcagcggtcagagtcgcctacaggagttgagccgcccgcgccagaaggttttggcgaagctcctccagtagcaggacccggtctcgggaccagccg

SEQ ID NO: 607578 - DNA, 379 bp, Homo sapiens
ctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgtttttttttttaatgggggacaaaagagagggaaagacccctataaaatctatatataacaatgtaaccatatacttgcatgtcttaatacaaactgaagaattagcctaactgccatatcaagttggcagattttaatccatgggaa

SEQ ID NO: 607579 - DNA, 429 bp, Homo sapiens
gggctaggtacgaggctgggttgccagaaggccggcggaggagccggatctgagccgggaggcatggaagaagacggaggagcctgggcgacatgctacccacgtgaattgccctgtgcacctccttctatcgcccaatcgtgctcctgttcatcgctgcttccccgctgccgcaattgagaatggttgcctcatgggatgacggatgttccttcgatcgtatgactcgcacgccctttttacgactggcacgatgacggaatgtgacgtgctggactgcgcagtggaccctccatgggatgacgcaactcgccagtggtgcctgcactatggacttgcttgtgtggcgtcgggaggcgcttcgaggtcattgcttctggacgccaatccagctactgctgtagcccacatgtgtcagctgcggggtgg

SEQ ID NO: 607580 - DNA, 476 bp, Homo sapiens
ggctgccccaaacgcagagaggatctgttagtaaattttctatcaatttccttaaagatatgctaggaagttgttagtacttccaatccctcatccaaatcccaaaaagggccagccctgagaagcttacctgaaatatttctttccttctctcatggaagtccataaaagccacccctcctccttatcctttcaactgggcaactatagagtgagggagattctaattgtattaggcactttccctcactagttagatgttgacttttcctctaaaactccattttcagattccccctcacaaccagcagaaagatgactaccttgcttgactatgtttgtatttaaaccttgggggaactaaaaatctattcaaatctcatggacaaccttattttcctctctgcgtttcaaacgcagagaggagaggcagaggaaacagctttacaggacttttcttatcaaaatctgggaag

SEQ ID NO: 607581 - DNA, 357 bp, Homo sapiens
  misc_feature (23)..(23): n is a, c, g, or t
  misc_feature (67)..(67): n is a, c, g, or t
  misc_feature (76)..(76): n is a, c, g, or t
  misc_feature (91)..(91): n is a, c, g, or t
  misc_feature (100)..(100): n is a, c, g, or t
  misc_feature (116)..(116): n is a, c, g, or t
  misc_feature (126)..(126): n is a, c, g, or t
  misc_feature (148)..(148): n is a, c, g, or t
  misc_feature (157)..(157): n is a, c, g, or t
  misc_feature (192)..(192): n is a, c, g, or t
  misc_feature (216)..(216): n is a, c, g, or t
  misc_feature (218)..(219): n is a, c, g, or t
  misc_feature (226)..(226): n is a, c, g, or t
  misc_feature (246)..(246): n is a, c, g, or t
  misc_feature (249)..(249): n is a, c, g, or t
  misc_feature (253)..(254): n is a, c, g, or t
  misc_feature (262)..(262): n is a, c, g, or t
  misc_feature (271)..(271): n is a, c, g, or t
  misc_feature (276)..(276): n is a, c, g, or t
  misc_feature (285)..(287): n is a, c, g, or t
  misc_feature (355)..(355): n is a, c, g, or t
aaaaaaaaaaaaatgagaaaaangaataaaagaaatataaagaagaaaaaaaaaattttaatttttnaaaggaaanaaaaaaagaaaaganttaaaaaanattgaaaaaaatattnaataaaaatntaaaattaagagaaataagaanatatatagnagataagtaaaaataaaaagaaagattaaaaagangattatgaaaatgggagggaaaantnntttttantgtagggaattaattaaacnggnaatnngggtttanggataaganggganggggggggnnnagaaaaatggaagttaggtttaaagtatatcgattttatttattttttcgaaatgcaatttcaggggntt

SEQ ID NO: 607582 - DNA, 497 bp, Homo sapiens
  misc_feature (170)..(173): n is a, c, g, or t
  misc_feature (175)..(175): n is a, c, g, or t
  misc_feature (177)..(177): n is a, c, g, or t
  misc_feature (249)..(249): n is a, c, g, or t
  misc_feature (254)..(254): n is a, c, g, or t
  misc_feature (257)..(257): n is a, c, g, or t
gacatcttggtgaaggtcagtctatagaaggaagaagctgtagatggagatgtggtgttgcaagtctagagggatgaggtgtgggaaggtggaagacaagaagaagcgggataaccctgaagatgtatcatcgagactgggaagatcgggtgggaagcctttgcatcgcnnnnananggcacaggtgacatctttcttggagtggaccggtcggtgcaggccctgtagtccgccacagggctctgagcngcacnggncccgggtgctggcatctggtggagcggaccactcccctcacattccacaggcccatggactcactttggtaacaaactcctaccaacactgaccaataaaaaaaaaggtgggtttttttttttttttttttttttttttttttttttttttttttttttttttttttttttttttttttttttttttttttttttttttttttttttttttttgtgggggagaaaatgggcggcggagga

SEQ ID NO: 607583 - DNA, 273 bp, Homo sapiens
tgtctgacgtcggtcgctctgaggatcccggcaccattgtgctggcatctggtggagcggaccactcccctcacattccacaggcccatggactcactttggtaacaaactcctaccaacactgaccaataaaaaaaaaggtgggtttttttttttttttttttttttttttttttttttttttttttttttttttttttttttttttttttttttttttttttttttttttttttttttttttttgtgggggagaaaatgggcggcggagga

SEQ ID NO: 607584 - DNA, 519 bp, Homo sapiens
  misc_feature (170)..(173): n is a, c, g, or t
  misc_feature (175)..(175): n is a, c, g, or t
  misc_feature (177)..(177): n is a, c, g, or t
  misc_feature (249)..(249): n is a, c, g, or t
  misc_feature (254)..(254): n is a, c, g, or t
  misc_feature (257)..(257): n is a, c, g, or t
gacatcttggtgaaggtcagtctatagaaggaagaagctgtagatggagatgtggtgttgcaagtctagagggatgaggtgtgggaaggtggaagacaagaagaagcgggataaccctgaagatgtatcatcgagactgggaagatcgggtgggaagcctttgcatcgcnnnnananggcacaggtgacatctttcttggagtggaccggtcggtgcaggccctgtagtccgccacagggctctgagcngcacnggncccgggtgctggcatctggtggagcggaccactcccctcacattccacaggcccatggactcactttggtaacaaactcctaccaacactgaccaataaaaaaaaaggtgggttttttttttttttttttttttttttttttttttttttttttttttttttttttttaaggggggtttttttttggggggggagggggtggggggcgacacagggggggagagaaaggggggcgtgtgtaaaaccccaggttgccccaaac

SEQ ID NO: 607585 - DNA, 111 bp, Homo sapiens
ggggtggggggggggtaaaaatggttggcctgcataaggtggccttcccatttaagggccttttttgtgaatgaaagccctagtgtgatgagaattaaagagaaagccaga

SEQ ID NO: 607586 - DNA, 911 bp, Homo sapiens
atcgaggtggatggaaagcaggtagagttggctttgtgggacacagctgggcaggaagattatgatcgcctgatgcccctctcctacccagatatttctgtcccaacgtgcccatcatcctgggttggggataagaaggatcttcggaatgatgagcacacaaggcggtgagcctagccaagatgaagcaggagccggtgaaacctgaagaaggcagagattatggcaaacaggattggcgcctttgggtatccttgcgggtgtcacgccgcagagaccaaagtgtgggtgagagaggtttttgaaatggctacgagagctgtctgaagctagacgtgggacgaacaaaatctgggtgccttgtctgtgtgaacccttgcttgcaagcaacagcccttatgcggtgaatttggaagtgcgtgttaataaaatcctagtgtatgattactgcctcggccattatctaataatttacctaaagattacaaatcagaagtcatcttgctaccagttatttagaagccacctatgattattaccgatgtcaacccgtcgtggccccgcaggtccttttgacactgctctaaaggcctctctggatcccactgacacacaaggcgctaattcaggaattctaacttctgtctttctagaaagagaaacagtggcacttgtgtgaatagggcggactacttatacctaacatgtcggctaatatttgcacgcgaaggacctggtgggcccttacggcttacccgaacaactgtggatccctgggggcgcggtttgcgatggcaccaaaacccactctcgggcgacgtgggcagtggcacatagacggagtcgcagtgtgcaaaaactctcccgagtttgtttgtccacaacacaccggcgcgtcatactcttctctc

SEQ ID NO: 607587 - DNA, 476 bp, Homo sapiens
  misc_feature (170)..(173): n is a, c, g, or t
  misc_feature (175)..(175): n is a, c, g, or t
  misc_feature (177)..(177): n is a, c, g, or t
  misc_feature (249)..(249): n is a, c, g, or t
  misc_feature (254)..(254): n is a, c, g, or t
  misc_feature (257)..(257): n is a, c, g, or t
gacatcttggtgaaggtcagtctatagaaggaagaagctgtagatggagatgtggtgttgcaagtctagagggatgaggtgtgggaaggtggaagacaagaagaagcgggataaccctgaagatgtatcatcgagactgggaagatcgggtgggaagcctttgcatcgcnnnnananggcacaggtgacatctttcttggagtggaccggtcggtgcaggccctgtagtccgccacagggctctgagcngcacnggncccgggtgctggcatctggtggagcggaccactcccctcacattccacaggcccatggactcactttggtaacaaactcctaccaacactgaccaataaaaaaaaaggtgggtttttttttttttttttttttttttttttttttttttttttttttttttttttttttttttttttgtttgtgggggggggggggggggggggggggggggggggggg

SEQ ID NO: 607588 - DNA, 173 bp, Homo sapiens
atctctcgggacaactggcacagcgccgcaaaccggggggcaagagaaagcccttccacaagaagcggaagttttagtttgggcgcccagcttgcaacaccaagtttggccccgccgcattcacacaggtccgtgtcgggagggttcaagaattcccgtcccctgggttggac

SEQ ID NO: 607589 - DNA, 310 bp, Homo sapiens
  misc_feature (4)..(4): n is a, c, g, or t
  misc_feature (48)..(48): n is a, c, g, or t
  misc_feature (56)..(56): n is a, c, g, or t
cgangttgcagtgagccgagatggcaccactgcactccagcctgggcnacagagcnaactccgtctcaaaaaaaaaaaaaaaaaaaaatcttgaggcaatatttaaaccttcttctctagggctttccatttgatatgtattaatagttccaagatcttctacgctagtgttactaaaaatctgtcaactgattttgactaggagcttgttcaaaaaactcccaacattaactggttaccacggccttcagatgaaacaggagacctcaatactctaatcacacaccaagttaagttggctaaggcaagg

SEQ ID NO: 607590 - DNA, 212 bp, Homo sapiens
gagaagacgacagaagggcaactttaaaaaaaaaaaactaacactaattttttccctaattaaaaatgaagatctggccaggtgcagtggcgcacacctgttaaaccctgtctctactaaaaatataaaaattagccaggcatggtggtgcgttcctgtaatcccagctactcgggaggctgaggtaggagaatcacttgatcctgggagga

SEQ ID NO: 607591 - DNA, 546 bp, Homo sapiens
  misc_feature (471)..(471): n is a, c, g, or t
cacaccgccaccttggccagaccccacacccccggagccagaggaggagatccggggatcagatgatgaggagcaagaggacccggcggactacggcaaagggtggatatcatccagtgaaaatgggagacctcttcaagggccggtatcatgtaattagaaagctgggatgggggcacttctctacggtcgggctgtgcggggatatgcaggggaaaagattggtggcaatgaaagtggtaaaaggtgcccagcattatacggagacagcctgggatgaaataaaatggctcaaatgtgtccgagaaagtgatcccagtgacccaaacaaagacatgggggtccagctcatggacgacttcaagatttcaggcatgaaggggatacatgtctggagggtcttcgaagtactgggccaccatctcctcaaggggatcatcaaatccaactatcaagggctcccagtacgtngtgtgaagagtatcattcgacaggtccttcaagggttagattacttacacagtaagtgccagatcattcatagtg

SEQ ID NO: 607592 - DNA, 102 bp, Homo sapiens
cctttaaaatggttttcttgcacgctttattatacttaaaaacgaacaataaagaaactattttatccaacgttaggttttgttttcaagtgcattcattct

SEQ ID NO: 607593 - DNA, 1158 bp, Homo sapiens
atgggaagagggagggaaaagaagatgcaagcaaaaggttttgtttgtcttcttctcattgttttcttttcttcttttaccgccgcgttttttttacgatgtattccactatttttttatttctcgtttctgatctgtttcttatttttcttgtttttgcagatggggtctcctcttggttgctctcttgctcttctgtgttgtatctctgtttttttacccgtcccttttcctgccggttttccttgtttctcctctgtctttcacttggtttgcttatcttagttctctagttctgctgtcatcctagcgtgatctctttgttcgcacgaattggtgattgcatgatcaattctgagcagagtctgatgcttagttccgcagctttccattgagaagtcgttcttcgttcccgtaatagcattccttaatgacctgcttggctcacatgtcctttctacattagggaacgtatctgctatgatatccacaaatttttcagatagtgccctttaaacaattcttatatgcctcactgcttgttattcttaggttattcccacacttgactttatcattgtttactactagtaaaaagcaccattgcctaataatccctaattgttccactaagaaatataatgaaatgatgttaagctttttgaaaagctttaggttaaacctactgttgcttagattaatgtactttgcttgcttccctgttatctggaatgtggcattagcttttgttatctttaaccctcctctaattctgtattcaagttccgatgacgttaaggttggagagctaaacacgtgggatctctttggataactagacatgacagttttgcatcaattataatcggcattgtacatagacaaggatatcggctaccttattgtctaaatctgcactttcctaaatatcaaaaaagggaaatgaagtataaactcaatttttgtactcaatctcgttctcgaaacactgacgttttagttctgcgttaatatatagggctttgccccttttctgtaacgtctcttgggatcctgtgtatgaacgctgttctcattaaacaccatacagttaagtccattctctggtactagctactaattcgtattaaactcgagctgacattatactttttttct

SEQ ID NO: 607594 - DNA, 339 bp, Homo sapiens
accatacattaatgcactgctggagagaattaaaagaaaagttatgaacaccagaacagaggaacctgatcgggatgaacgtctcacaaaagagaagcaagaaagacgaggaacgagaaaaagagcgggagagagaaagagaagaacgggaaagaaaaagacgacgagaagaggaatgaccgggaacacatgaaagaagctcgttgacaattaaaatataatatacaaaaggtgtgttttactcttgtagggatattatcccctattgtgtgtggagggtgtcaccacattctcacgcgctgtgtgcgcacctgtgtaccgcgcgagagtatctgtgag

SEQ ID NO: 607595 - DNA, 135 bp, Homo sapiens
tagctggctcctggaggataaggcgtggtgctaataggtggaggtacgtgaggatacgtaacggttcggcaagtcgtctgtccctattgtctaggtgtttaatattgacttgattggtacttgtgtctatcacag

SEQ ID NO: 607596 - DNA, 183 bp, Homo sapiens
tcgtgtctagcgaaactctgtacacgggaggcatgcaccgcagtggtgaatacacgtcgaccaggctccatgttaacgatatttggacagtcatcacggttctcacatattgaaggaacatgtctagggagacatgcatcgcagtcgtgaatacacgtcgagctggaggcatgccctgcgatg

SEQ ID NO: 607597 - DNA, 171 bp, Homo sapiens
acctatatggacagaacggttatcctgatatcaccactaggaaaacactggccaacaaatttgattagtccggttcacgtgataaacgtaagttcaacctcgtatgcatgcttcttagatttttttttttttatattattttttttttttattttttttttttttactttt

SEQ ID NO: 607598 - DNA, 316 bp, Homo sapiens
  misc_feature (86)..(86): n is a, c, g, or t
  misc_feature (148)..(148): n is a, c, g, or t
  misc_feature (238)..(238): n is a, c, g, or t
agcttcctggtggccaagccgaggttagaagctagttctggtgggtgccgaaagcccccgatgtcggcagctctgccaccaggccngcacaagcaggtggtgtaagaggggaggcgttggggccggcagtgctcaagtcaggattgancccgtctatctggaaggtctgttgagggtgtgtgctggtggccggaggtggtggcaggctgactacctgccattttcctgcagtgcctangcccaggagagggagcagcccccggtcaggacccagctgcaggacaccccatcctcatggaccttgcttcccgctctc

SEQ ID NO: 607599 - DNA, 807 bp, Homo sapiens
  misc_feature (32)..(32): n is a, c, g, or t
tgttttatgttggttggtatcacttacaaagntgatgtcacccccttccactcgccaagtctgctgcccaagttctagccaatctggtgccctactacccagctgatgtctgaatctgattggaggaatcttggaagccaccagagccagggatgggtccattatatgatccatgaaccagaacctcacatcttgctgttccggcgcccactacccaagaaaccaaagaaatgaagctggcaagctacttttcagcctcaagctttacacaggtgtccttagttcctaacatctttctgataacattattacgtcgccttcttttttctcactttgatatttaaaacaggttcaatacactggttgaatgtgctggtaactcgctttgctttttgagtacacgcatcaccaccatacccgatccagaggaccgctcgtgttggaccgcaagcctagtccgcccgagaccccctacgccacgattagctcgcggcgtcggaccgcccccggaccatggtagccctccacgcccccccgctgcaccgtctcgcaaagccacaatctcgtaagacccacccgttccatatctcccccgcggcggatgcttcttcgctccatatctccccgcactcataatcgggctcccgagcccgtcctgtgccgccctccccgactgctcagtcgccccggcgccgcttagtcggcattccctccgctcgcgagacattacccagtcgttttccggccgccccgccaccatcccatgtcttccggtacccagcgcagcgagaatatcgcgttcgctct

SEQ ID NO: 607600 - DNA, 216 bp, Homo sapiens
gggggaaattttttttttaaatggccccacctcttggggggtgtttttttgctggggcctcccaaatatttctaaaaaaacccttttttttttgggaaggggttaaaataccctcccccccctttttttctataaaaagaattttgagggggttcccttaaatttttttccccccggccctttttcccctttaaatttaaaattaagtggttttta

SEQ ID NO: 607601 - DNA, 888 bp, Homo sapiens
gactgactctcttttcagactcagcccacctgcacccaggtgaaataaacagctttattgctcacacaaagcctgtttcgtggtctcttcacactgacgtgcatgaaatttgttgccatgacttggatcgggggacctccctttggagatcaatcccccatcctcctgctctttgctccgtgagaaagatccacctatgacctcaggtcctcagactgaccagcccaagaaacatctcaccaatttcaaatccgtacaagaaggcaggaatgtcaggcctctgagcccaagccaagccatcgcatcccctgtgacttgcacgtatacgcccagatggcctgaagtaactgaagaatcacaaaagaagtgaaaaggccctgcccggccttaactgatgacattccaccattgtgatttgttcctgccccaccttaactgagtgattaaccctgtgaatttccttcccctggctcagaagctctcccactgagcaccttgttgacccccgaccctgcccaccagagaacaacccctttgactgtaattttcctttaccttcccaaatcctatacaagggccccacccgtatctcccttcgctgactctcttttcggactcagctcacctgcacccaggtgaaataaacagtttattgctcacgcaaaaaaaaaaaaaccacaaacgaaaagaacattttgtggccgagcacaggagccgcagaaaaacgatctcaaacacaagcgattgcgatcgggggccaccaacggcaagagacaccggcgcaaagagggccaatgagaaaaccgaggcagaacaggcgcggaatcaccaacaaaacccccgggcgcaggaagcttaacaaccaggagacacagcgacaaggagcca

SEQ ID NO: 607602 - DNA, 369 bp, Homo sapiens
  misc_feature (132)..(132): n is a, c, g, or t
  misc_feature (174)..(174): n is a, c, g, or t
  misc_feature (179)..(179): n is a, c, g, or t
  misc_feature (257)..(257): n is a, c, g, or t
  misc_feature (297)..(297): n is a, c, g, or t
  misc_feature (313)..(313): n is a, c, g, or t
actgctgctgggatcaggttgaatgaatggaactcttcctgtttggcctccaaaacagcctaaaaattgaggggctgtgtttgaggggaccctccccctggggaagtccgaggggctggggaagggtttttnacgcccagcctggagcaggggggccctggccacccctgttgntcacncattgtttggcagcctgtgtccccaatatttgtcagtcctcgacagggagcctgggctccgtcctgctttagggaggntttggcaggaggtcctttcccccatccctccatttggggntcccccaacctttgcncagctttccaggtgttgagatataatgccccagcccaataaacctttattccggca

SEQ ID NO: 607603 - DNA, 152 bp, Homo sapiens
tctagaggatccgagtgaccttctgctctggttgggaacttgccgtgatttttctagcagataggtctcacatgttggctcccacgatgtaaccctgtgacgtcgaagttgatgcggataaatttgccgaatcgtgaggagtagtcgttctt

SEQ ID NO: 607604 - DNA, 738 bp, Homo sapiens
cctttcaacaattcctgttgactccaacactcctttgaccacttctactgaagccagttcacctcctcccactgctgaaggtaccagcatgccaacctcaactcctagtgaaggaagcactccattaacacgtatgcctgtcagcaccacaatggtggccagttctgaaacgagcacactttcaacaactcctgctgacaccagcacacctgtgaccacttattctcaagccagttcatctcctacaactgctgacggtaccagcatgccaacctcaacttatagtgaaggaggcactccactaacaagtgtgcctgtcagcaccacgccggtggtcagttctgaggctagcaccctttcaacaactcctgttgactctagcagtcctgtggtcacttctactgaaggcacttcatctcttacacctactgaaggtaccagcatagcaacctcaacgcctagtgaaggaacacctccattaacaagtatgcctgtcagcaccacaacagtggccagttctgaaaccaacagtctttcaacaactcctgctgacaccaggacagctgtgaccacttatcctcaagccagttcaactcctacaactgctgacggtaccagcatgccaacctcaactcctagtgaaggaagcactccattaacaagtatgcctgtcagcaccacaacagtggccagttctgaaatcaacagtctttcaacaactcctgctgaccccagcac

SEQ ID NO: 607605 - DNA, 172 bp, Homo sapiens
cacagtatgccatccactgattggggaaaaaactagatgatacaacatgatccctgttgtgtaagggatagttaaggtcatactaggagcaattaggagccatatgcctgggctgagaagagctaggcagtagtgaccttaggatatgagtaaactcaccgaacaatgccaa

SEQ ID NO: 607606 - DNA, 451 bp, Homo sapiens
  misc_feature (179)..(179): n is a, c, g, or t
aaggtggcctgggtctctctgctgtcactgaaggggttggaactgaattacctgcaagaaaacaagaattataatgttctcctcatcgtctgtgaagtgagtaggaaatacagaggacaaaagcaagaagaatctctcctactaagtcttaaaaaaataggacagcctgtcaaatggcnagggccatgagtggaaaaagaaacaactattgacactgggggccctgatttctcccacgcacatgtgcgctgctgaaaccttccctggagccattccctcacagcttccagaggttgtgggggcatagcaggtgagcctgacacagattccccatgacacaagttacaaacagtgtgaggaacaccagaaaataattatcctcccaaaaaaggaattatgagtgagaaaccaaaataaacatcttcaaatgttcaaaacgattaaaaaaaaa

SEQ ID NO: 607607 - DNA, 237 bp, Homo sapiens
cagcactaacacacacagcctacacaccagacacatcaaaacgcgatacgatatcttaaggtgtaaacctcagcttggaagaaaaaacaaatgagacttatggaaaattggaagctgtgcagtataaaactcaagttgttggtggaacaaattactacattaaggtacgagcaggtgataataaatatatgcacctgaaagtattcaaaagtcttcccggacaaaatgaggacttgg

SEQ ID NO: 607608 - DNA, 975 bp, Homo sapiens
gctctacttgaatcctcccctacgggtccgcccccaatgtctgatagatgttgtggatggtctggttgttctgccgggagacaaggtgataacatagatttacgtgaatacgtaaacggtgtctaagaatatgaataattctaacccaatgacatgacattcttagagctgtagacctcagctagacaggggccatatttccagcagcgcattgagagtagctcccatttcggctctaggacattttagtaggcttgagcccatgcgtcttaatcggcagcatgggtggacgacaggatctgcagggctctgcctgaaacacacattagcaagcttcacaggttgtgcctcattgtagatgtctcttgtgtctgaaactagatagctttactcggacgtcatgcatcattggatcgttcagtatctgcgaattatcgaaggggtccttgggactgccctgtggggcttccccagggtgggccatggagagtggggtgcaaagggaaggtaaacaggacacgactgattgtcttgtcgaagagatggtccacgggacctaagacggctcaggggccggagaggagaaatcacctcgcagaagcccatacaaatccaggaaagcagtggagctgccttggagtgctagtccgaacctgaagaagagaagcatgctgcgaggcttgtagtccaatcgaaccagggtgattagcgaccgattgctgcgaggactccaaagccgcaagcgtacgagtagacacacgacaaccgtaccgttgacaacgcgaagcccagggggccaagtgtcaaaatagagcagcatgcaagggctggatggggtcgccgaagaccaacccggggcaagccataggcgagctaggccgaggaccagcgagtggaaaagctaggatcccaagcgccgatacctggccgggggagtaacacccctagaccgactgggcgtcccggcagaaagac

SEQ ID NO: 607609 - DNA, 1188 bp, Homo sapiens
gaggcagatatcggcggtcccgcagggtctgtctcattgcttccaacagtgtaatgagacggaaccagatccaggtggaatctactatccagacctaccgaccgcacctccgatatcactcatccgctatgacaacactaccgggaaccatctatctcggccatctcctgcataatctagggacctgccaagcaaccgtacaaaacgtaggttcagctcctatcttgccaaaccaacacatagaacctcccaagatctcgtccggcacttcattccaccagactgtgaagcgcaagccgtcaacacagcctagctcacacatcaggtaccttgcaaggcccatccctacaccctaccctctactctgcggactaactattcccgcaccgccaatgcatactgacctctcggacacggacgtgacccactacctaccagcacaaattaggccccgcacgcaaacaagccgccagcaggcgaccacacagccggtcccccaggaacgatcgcacaacaacccagccgatgccagacccccagccccaactacccaaggacacatcacagacacccacacctgcacgcacaccacccacacaaaaaaccccccaaaaacggccacatcaacacgctacccagtggcaccccgcacggacacaacagcatgaaaccccaagccccataacggacaccccacaccagcccccagaagaaacagacacagcacgagaacccccaagcctgccgacaaacacccagagcagcacccaccaacaatagctcacccaactcaaccccacactaccgaacatcggcacacccccgagaccaaacatcccccagcccgactgtcgccctgacccacgacaacgcacagccacaccccccaccggacaccgccccccccgccacccacgccccgccccctccccccacgcagcgaccattacaaacgacccacgcccggcagcgccacgccccacaaacaaacactaatactaacacacactcttcccctcacaacaccagcaccacaaaccccccaaacaacacatacaccccccacaccacccaccacaccaccccacacaacctcaacacaccaaagccaacctccacccccccacccccacccctactatacacccaaccaccaccatccacacaccccaccccatcagtcacttc

SEQ ID NO: 607610 - DNA, 458 bp, Homo sapiens
  misc_feature (4)..(4): n is a, c, g, or t
  misc_feature (24)..(24): n is a, c, g, or t
  misc_feature (34)..(34): n is a, c, g, or t
  misc_feature (68)..(68): n is a, c, g, or t
  misc_feature (79)..(79): n is a, c, g, or t
  misc_feature (132)..(132): n is a, c, g, or t
  misc_feature (456)..(457): n is a, c, g, or t
aatnattttttttgaagccaaagntcttggtccntgcccccccaggtggagtaaaaatgcttaggaancatggccccantgtagccctcaaaccttcctgggctcaaaatgatcctcccacttcagccttcntgagtagctgggactgcaggtgcacactaccacacttggctaattttttaatttttttgtggacacgaggtctccctgtgttgcccaggatggtcttgaactcctggactcaagcagtcctcctaccttagcctccgagagtgctgggattataggcgtgagccagtgtgtctagctatatatttattcatttattttgtttgttttaaacataattttttttttttgagatggagtttcactctttttgccactgcacttcagccggggtgacagagcaagattccatcctcccaccacccctgcccgcccccacccaccccnnc

SEQ ID NO: 607611 - DNA, 1268 bp, Homo sapiens
  misc_feature (917)..(917): n is a, c, g, or t
ggagtgcgagaacgacccccggatcgaccaaagcccgtgcgccgtgcatcccgcgtccgagcacactagcgtccctgctgccgtctgcttcagccgacacacagtgcccaagattggaaatggcgtgcaatggcggatgcttgaacggcgagataagaggctagatagggtgaacggacggaacccacagcagaaagatcctgagcaggctctgtctgcttaaaccctgctccttccacagcactagagcccgagatgccttaaaagaggctccccttgcaacagtacaagggacgaagagaggtaacccagaatgggtaacatagacgggaagagaagctgagtgcatggaccacgggaaggggaaagtaacccgtgcggagacaactggaagatgccaagagatcatgaaccatggctaaccacgtaaacgtcgttgataggctgcctggaagaatgccaagctgaaagtgtcgtgcacttgtaagtgagtacacgtgtgtactttcctggatgacttggtacaggttgtgacaactacttagttctctttgtatcaaaaggtgttctagtaccaaatatgccagtaagtgtgtagttaatccaacgttgtatatgttgcattttcgccttgtataccacataggtcccatatcttatgtgtgtgttgatgacaagcgcaccatgacacaacgaactcttctccaactgtcgcgctgtcgcttgccatggtggagcgcgcacaaaaagggcgaggaccaatatgttgtctcccgccataacttccaacacaatgtgtggtcccactcccccaacaaggatggcttgtgccgacgaacatgtgggaaacccggttttgcgagatcgaaaaccgataagccaccccagttttctgcgcccctttactctttcaaggngtctaatcgcggtgaatgcaaagacagagctttttacccgcgcgtaagtgacggtggtgccatacctcccaagaggagattaacgtagaaacagacgggaggcacttcccatccccggtttcgcacacatttgtgggtgcacacatcaccattgcacgattggtgacggctaacaacacccaatgttgttggggaccattctacatatacacacacagcgcactgttctggcgctcgggaacaataatgttgcggcgaaccacatcagcaacgcacgccaccgtgatcgttgaggggatggtaccctagcaaagatggtgtggcaccgcgacaactatgggcagcttcgaa

SEQ ID NO: 607612 - DNA, 337 bp, Homo sapiens
aggagaatccagaaatatggcctcagagctacactgtctagatcttcgacagagctgacaaaacaagcaagtgaggaaggaattccctatcaataaatggtgctgggataactggctatcacatgcaggagaattgcttgaacccgggaggcagaagtggcagtgagctgagatcgcgccactctagtttgggtgacagagtgagattccgtctccgaaaaaaaacgcgaaacaccaagaaagaaaaaacacaatttctacgggtcctcagggtatcatatcagtgggagggctcctaagaatgtgggaagattagcgggggacccctcatagagtc

SEQ ID NO: 607613 - DNA, 482 bp, Homo sapiens
attctcctctggtgcctctgctacttcaccatcccacaccaacttctctctttgctattaaagtctactaataacaatggctcacatttattgagtacttactctgccaggcactgtgcgaggggctctacatatattagcttttgatcctaacaaaatcctgaaaggttgatgttatcctcactttacagatgaggaaactgaggctctgaaaggcttgcaagtgacagagcaggaaccagaacccaggtttctctgaatctcttaccactataccttactgcctcgtggtatatgccacctgttgaaacatggctttgtaatcatcttcaccccgagagaactgtcattttgcagaatgcagagactgagtcaaaatattaataataacaacaactacaactaccaccaccacccaccaccacgacccaccgtcagaatttactgtgcacctactgttgccaagcactctatttttgtgc

SEQ ID NO: 607614 - DNA, 735 bp, Homo sapiens
  misc_feature (19)..(19): n is a, c, g, or t
  misc_feature (227)..(227): n is a, c, g, or t
  misc_feature (233)..(233): n is a, c, g, or t
  misc_feature (264)..(264): n is a, c, g, or t
  misc_feature (270)..(270): n is a, c, g, or t
  misc_feature (274)..(274): n is a, c, g, or t
  misc_feature (291)..(291): n is a, c, g, or t
  misc_feature (354)..(354): n is a, c, g, or t
  misc_feature (382)..(383): n is a, c, g, or t
  misc_feature (385)..(385): n is a, c, g, or t
  misc_feature (393)..(393): n is a, c, g, or t
  misc_feature (422)..(422): n is a, c, g, or t
  misc_feature (431)..(431): n is a, c, g, or t
  misc_feature (444)..(445): n is a, c, g, or t
  misc_feature (466)..(466): n is a, c, g, or t
  misc_feature (470)..(471): n is a, c, g, or t
  misc_feature (499)..(499): n is a, c, g, or t
  misc_feature (511)..(511): n is a, c, g, or t
  misc_feature (515)..(515): n is a, c, g, or t
  misc_feature (526)..(526): n is a, c, g, or t
  misc_feature (529)..(529): n is a, c, g, or t
  misc_feature (538)..(538): n is a, c, g, or t
  misc_feature (542)..(542): n is a, c, g, or t
  misc_feature (551)..(551): n is a, c, g, or t
  misc_feature (553)..(553): n is a, c, g, or t
  misc_feature (556)..(557): n is a, c, g, or t
  misc_feature (576)..(576): n is a, c, g, or t
  misc_feature (578)..(578): n is a, c, g, or t
  misc_feature (598)..(598): n is a, c, g, or t
  misc_feature (604)..(604): n is a, c, g, or t
  misc_feature (611)..(611): n is a, c, g, or t
  misc_feature (625)..(625): n is a, c, g, or t
  misc_feature (628)..(628): n is a, c, g, or t
  misc_feature (653)..(653): n is a, c, g, or t
  misc_feature (703)..(703): n is a, c, g, or t
cgagagtcgggggcgaggnctcccccaccgtccccctgcccccacgccacgtcgcccagcggcatcgtggaaagaggattctcccatgcaaaccccggagccagaggagaaggggaagcgccattttgcgccccctacccccggggcacggacacggccacagcacggggggcggtgaggccccggggacacgagaaaggggggagggagaggggaccccgcccgcngatganccgggggaccggcgaccggacgcggcggggnggagcngagnggcacagggggcgaggnttgtggcagcgagtgccccctcccctcctttcggacgaagaaggaagacttgggctccgcgantgggcaggaaaaaggggagggagcggcnncngcccgcangcggcccgggagggaagccccgccccctncccgcgggngaaggacacccgnntcccaacagagactgatcaanaaannacaaagtagagaaaaggaaagcggacgngtggggcgggantgcntcctccccgcntcntccccctcngagngcagtgcangnggnngggtccaggccccggcccngngcgaggggggcgcgcgcgcncccgcnggtctgngcagatggtccagntcncggcgcgacgcccccgcccgcgcgncccggcgaggccacaaggcgggcaggagagggaacagcccagccgcgggnaagaggcggccgggcgatggagggcaccggga

SEQ ID NO: 607615 - DNA, 284 bp, Homo sapiens
acacagatttccttcagtaatgaagcatatggaagaccgagagaggcttgtaccttgggagtgcaaggaaatacatctattagtgccccttttggcagcaggagctcagacacacccatagagtcttaatgacgatcatctaattacctgcttaccattaactgagaattataaacaagttggcctaaaaatgtgccatgcgatgacaagcaaacatgcacagtgactgcaacacaattcatttctgactgacattcctttctgcaactgcggtgacaccacaa

SEQ ID NO: 607616 - DNA, 895 bp, Homo sapiens
  misc_feature (114)..(114): n is a, c, g, or t
  misc_feature (705)..(705): n is a, c, g, or t
cgttctgccagtgtctctcgatattttgttcttgttcttatgtaccgcattatattacaatttcacgtattcatattggacaccacaccctgctgctttgcctacattgcccgnccactgccccgtgcccacatcaaggagtatttttacaccagtggcaagtgctccaacccagcagttcgcctttgtcacccgaaagaaccgccaagtgtcgctgccaacccagagaagaaatgggtttgggagtacatcaactctttggagatgaggtaggatggagagtccttgaacctgaacttacacacatctgcctgtttcttgcttgctcttgtcctagcttgggaggctctccctaactattctaccccacccgctccttgatgggtccattttactaccacacagtagaagttacataaaccttccgtaggcatggacgtgttgtatcatatcttgtattaccagcactttcgttaggccatagccgccgcatcactcttatgtccctgacttttttactaggcatttcattcctgagtgaatcctattccttactaatactcccttacatacctatgttcaagatctctctcttctgtatattccctcttctttttataccctgctgtaacgttattgtaaataacaccctatatacataaatctttctattaatttatttacttcctactaatatctaaatcnggagtagatttatattaattttctctctcaaaaattctaatttggatttattaagttttcttcaacctattctctcttctcgtatcctatatttatctttttctaccacatcattcctgttttttctcgacatgtccgccatggcatttttagatgttccagttattgttactatttctttgcgctgact

SEQ ID NO: 607617 - DNA, 126 bp, Homo sapiens
atctatgtgcagaagatactcacgtgagataggtgctgatgtattgtggtgagacacacaaacatggcgcggtaccatgggatacccagtgatgaccatatgagagggcttctattggcaaatgta

SEQ ID NO: 607618 - DNA, 931 bp, Homo sapiens
  misc_feature (50)..(50): n is a, c, g, or t
  misc_feature (60)..(60): n is a, c, g, or t
  misc_feature (99)..(99): n is a, c, g, or t
  misc_feature (111)..(111): n is a, c, g, or t
  misc_feature (150)..(150): n is a, c, g, or t
  misc_feature (741)..(741): n is a, c, g, or t
tggacctcgcacagcctctcccacaggtaccatgaaggtttccgcggcancctcgctgtnatcctcattgctactgccctctgcgctcctgcatctgcntccccatattcntgggacaccacaccctgctgctttgcctacattgcccgnccactgccccgtgcccacatcaaggagtatttttacaccagtggcaagtgctccaacccagcagttcgcctttgtcacccgaaagaaccgccaagtgtcgctgccaacccagagaagaaatgggtttgggagtacatcaactctttggagatgaggtaggatggagagtccttgaacctgaacttacacacatctgcctgtttcttgcttgctcttgtcctagcttgggaggctctccctaactattctaccccacccgctccttgatgggtccattttactaccacacagtagaagttacataaaccttccgtaggcatggacgtgttgtatcatatcttgtattaccagcactttcgttaggccatagccgccgcatcactcttatgtccctgacttttttactaggcatttcattcctgagtgaatcctattccttactaatactcccttacatacctatgttcaagatctctctcttctgtatattccctcttctttttataccctgctgtaacgttattgtaaataacaccctatatacataaatctttctattaatttatttacttcctactaatatctaaatcnggagtagatttatattaattttctctctcaaaaattctaatttggatttattaagttttcttcaacctattctctcttctcgtatcctatatttatctttttctaccacatcattcctgttttttctcgacatgtccgccatggcatttttagatgttccagttattgttactatttctttgcgctgact

SEQ ID NO: 607619 - DNA, 93 bp, Homo sapiens
gattagaagtctctatttaatttttttgtggaaagatgtgtgcaggatgcatgcatgatatacagaccaacttttggggaatgcctgtgttct

SEQ ID NO: 607620 - DNA, 288 bp, Homo sapiens
tgcatgactgcaggagtctgaatattctctgaatccgcatttaatatatggtgtgatttctcccatagccaggattcacaggtccaggaatcaaggaggtaaaaatgcaaatggctcccagctactcaggaggctgaggcaggagagtcactcgaacccaggtggaggaggttgcagtgagccgagatcgcgccattgcactccaacctgggcaacaagagcgaaactccgtctcaaaaaaaaaaaagttatatatttatatatagtcgtaatttatgcagctggtca

SEQ ID NO: 607621 - DNA, 779 bp, Homo sapiens
cgggcggacactcttgtggatccggagagtggtcgggccggcagagcagtggggccgaggacaccagtgtctgtatctcagagccgatgggccgcggagactgatctagccgccatggattggatgtgcttattcatctataatcacaaggtgggcaggtgctcatctacccgagtactaccgagatgacatcgtggagtgaactgcagtggatgcctttcggcgtcaatgttatccatgcccggtcagcagtgtagacgcagaacaccgatcagccaacatatgactacgccaccacgcttcttaccaacgttaacgtcgtgtccaacactttggctaggcagacaagctcactcaagacagaatgtcaaaccgactgaccattggatactaacgaactacctactatacagcactgctgctcaccgcttagatgcgcctgcccgtaacataacgcgacatcagcactcacgaccgcacggtcaactcttaccatccaacggcaaacacactcactcagactgcctcccattactactgcagctcgtgccttgggcaatcgcaaccactttacctaacgcaacctcactgggcgcctacacgccaaacagcaacttaccccgcaggaacacaagcggcgccgtcctggcaccaagcgctacccagtctacgcaccaacccaacggcggcattcacacgaggtacagagcagatcagcaaccaaacaagacaggaagccagcaccacagcaatacaccaagagcccagggtaacccggg

SEQ ID NO: 607622 - DNA, 916 bp, Homo sapiens
  misc_feature (385)..(385): n is a, c, g, or t
  misc_feature (421)..(421): n is a, c, g, or t
ggcgatagtgcggccagaggatgacgtggcgttcggaacctctgctcgtggtgtcgctggtattgcaagaggagtcagtgagtcgatcgttcgcaccgtataggaaagggaggcttctatccctcgagaaaactatgttccatgagcattctggtgctgcaacagccagtggggccaatcctgctagacgttggagtctcctcacgagaagacgcatctagtcagagacgggcgcgcgacaactgaccatggataggagatagtggcaagctatgtgatatgcatagctcgtgcagagagtctacatagtgcggccgcgagtcgcaccgagtagtgtcttgagtgtgtgatcttagttgatcggagaggttgaacagaacactgncgccgtgtatactaattgagcaggaacgtcgggagnctaagcatgaagcccgtggctatgttcctgtgtgttactcgctccgtgcgtgaaggtacgggagatgactcgagaggggggccgagatgcgagagaacatttcgtgggcgactcgttgcggaatggagggcatcaagcgaaaagacggatggtgctgcgtaccccaatacgtacgagcttcgttggggcgccacccatgcaagaggaactcacgacatgcaatagggggtgactatgcggatgcgctgtgccctccccaaacggtactcggcgagctctaagggcgaagcatcgagtaggcccatgttagcgcagcatacccaataaggaggtgtggcaggacgggccaggcggctcgggaggttagccgaaggggtggtagaggggcaaaggggaaccacaggggcgtaaaactggacgacccgagagaagaaaagcaagagaaagtatgggctagatatggagaacgagagaaacgccaagaggatctcgcga

SEQ ID NO: 607623 - DNA, 514 bp, Homo sapiens
atattggaaaacttaaagtgcttttcccccaattttaaaaatctgaaagaacttccatctatcaacggcactggccatatttcttgcccaaacgtcacgagagtttaactcaaactctgctaatacttcctcctccactcgccacacctccacaccctaccttgtataaccactttgtgtctttattattacccccagcacgcgataatattttacaagatcttactgccacgcacatgaaccttaggattcacacccatgtcacattctccatacgctacccttaaaatcaatgagtacacaagcttttctgctacggcttctaaaactgaaggcaccttttttcgttttttttcttgcaatgtatccttatacacaccctgctggcactctacaactttgttagtccgtgttcataattgaggaggtaactataccactattgatgaaaaagattaacagaccattgtctattatgaatcattccactttatcaacaatgaaaaaaactaca

SEQ ID NO: 607624 - DNA, 647 bp, Homo sapiens
gtctagatttcttttcttaatagtgtcatgtcgccttgctctgggttgtattgtctttacaagggaaagtaagtccagaggctttcttaggtctagattaaacgtttcggggaccagaactacttcgtaggttatttctatgtcatattgtactgtcagaaaacattctagagtacgggtcctgtgcaggttagtgaaacctaagggatgatcatgtgggtaagcgtgtaaccgccgtaagtccattgtagagatttgagttgtacgtgggtacagtacactctagtggatgagacgttgtcatctctgagaagagttatagtcacgtgtacttaagccctggattgaataccaagatgaataattgacaatagactattgagaaaatgaactgccattagaaggcgtcaatcattaagttgctaaaattaagacttatgtaaccactcacgagggaattaaccaggtagaacaatgaaccttaaggaaactaaccatttccagcaccttttaaacaattaatcttcaagcagtacttgacggtattacacacagaggtagcaaccgtgtatagaacaatgtcccctggtattatgacagtttggaaaacagttacggttttggaagcagcaatttattcggaaaaa

SEQ ID NO: 607625 - DNA, 420 bp, Homo sapiens
agtacgagtagagagctagtgtcgagacagttgttttcttcattacacgggcagaaagcggtatgtaagcgaaggacatggaggtcgtgttataccagagagctactgtgatataagaactcttgcagtcttagatgtgatataagtgtatatctggattgtgagaggtgttagcacaaggttttatgatcagtcttttaagcacttggttagggtacaaggtattactgacattttatcctacatttaaggggaatttttaacgggaacggatgaactttcaactcaggtgttcgaggagtcaatgacttgcagagaatggtcctcttgttaagtggaatcttctaatgagctacctttagttagtgacatggttattatatcaagattccggtttgcattgatgcatgactgtgcatc

SEQ ID NO: 607626 - DNA, 334 bp, Homo sapiens
ggttggtatagtccacctcaactgcctgctatgatggataatgattgagagagtgaggagaaggcttactgtttagttgagggagagatttggtatatgatttgagatgtggggctagttttctgtcatgttgagaatgaagcaggcctggatgtcagatgtgtgtgtgcctatggttaacattcttgggactcatgaagtgaaatgtgtgggctattcctatgttttatttgctatatcccattatagattattaattgattgatgtatatgatttgttatgtatttggttattgtgttcatatgtcctgtgagatgtatatttgtttgaatg

SEQ ID NO: 607627 - DNA, 289 bp, Homo sapiens
tggtggatcgcttcaggccaggagttaggatcagtctgggcaacatgacgccatctctgaaaaaaatttaggtaggtttagtgttacgtgcctgtagtcctagctattcagggagctgaataggaatatcacttgagtccaggaggtcaagactgcaacgagctataatcacagctcactgcagctgcagcctcctgggctcaagcaatcctctgcctcagcctcctgagtagccgggattacaggtgcgagccactacgcctgtctgatttttttaattttttgtaga

SEQ ID NO: 607628 - DNA, 452 bp, Homo sapiens
ctgcgtcaacgctagtgccgtcaggcgctgcgcgctacctgttgccaggctgccagctccaggaaatgctagtgagtcggaggaagaccgagcgccggagtgtggagagcccgtccgtctccagcaggcaccggggtgtctgatcccaagttccaccccctccattcaagagatatctcatcatcaagaaagggcgtgctaaagacagccagtgctacaaagttgacttacgagtctcagagcacagatacccagaattctcctccgagtccaagcgggagacagaatatggtccctgccgaagagaaattggaagacacattgaatcacctgaagttccttcaatgtgctgagtcccagtgggttgtacacattcccaatttgtgacaagaagggattttcataagacaaagcagtgtcgcccttccaaaggcaggaagcggggcttctgc

SEQ ID NO: 607629 - DNA, 157 bp, Homo sapiens
ggggtcaccaccctgggaggggaaccagagtggaagagaaaaccccaaaattagcaaaagtccacggtgactagccgaagagaccgagctgagggggagaagaattgtcggagacaaaaacgcgccgagagcccaaccatacaaaattagaggcgga

SEQ ID NO: 607630 - DNA, 664 bp, Homo sapiens
tgtgggggtggggggggagggggggggaaggggggggggtgggggaaattttattaaaaaggggggggggtgggtgtgggaggaaatgtttcacaaaatgcaggggtgtgtgttattggattggtggctcgagaggcgaccatggtggttgtagttgcttgtgccacttacataaaaaaacgatggtgggtgtcaaacatagtggtcgtctttggtcggcaccacaacacttgtgtggtggagtactctctgtggtgagatttgcgcgtccatctttgttcgtcctccttcaagaaatcattgtcgtggcgtggcgtggtcgtgcacaccatccaacgaccgagggcgtggtgtgtattcacgccgcgatacaaacaaacacacaaggcgggaaagatggggctgcttggaccggcgtctcactaccactcgcgcttcaacccgccctcagcacgacactcaaccatgcgtgccgccccctctctcgacaacccgcggtacacacgtggacgaccttccgacgtggcccccatcgtcgccgccgtcggcggggcagcccccccccaacctcccccgcgaccgaacgggcgtcgactacgcggcggcagcgcaataaccacccaccgcggggggcgtcaaccaggacgtaagacaaccagctctg

SEQ ID NO: 607631 - DNA, 165 bp, Homo sapiens
gcgttctctagcgggcgtctttccagaatccgccgtgcaatagtccctggcctattgttttacagggaaacgaagtgggaaggctaaaacagtcaggaggttggcttagaagcagccaccctttaaagaaagctaatagctcactgatcgagtcgtccgagcgga

SEQ ID NO: 607632 - DNA, 212 bp, Homo sapiens
gggcccccccccccccccccgttcctgggggggtccccccccccccccaatgttggggcccccccgggggttttaagggaaaaggggggccgggcccccccccctttttttttttttttagaaaacccgggggggaatttggcccttgggggtttttttttcccctttttttttgatttttttgggaaaaaaattttttcccgggggtttga

SEQ ID NO: 607633 - DNA, 222 bp, Homo sapiens
  misc_feature (131)..(131): n is a, c, g, or t
tatgtggcagatgatcagacatcgtgttataacatctccttcttgtaagtgcgtgctttctctacagtatgctttcaacaattgacgtcaatccagttgtgcttctgtgctcaatgctcgtgtatgacctntttgcatcattttgatttattggatactttgtcttggtctccccatggatgcttttccaaaaccaacattaccaaattaaaacccaaattt

SEQ ID NO: 607634 - DNA, 575 bp, Homo sapiens
ttgagtggacatccatggatgagaaatgcggatatgggactgcgggcgcgtgccaccacgcccggcttattttttgtatttttagtagagacggggtttcaccttgttagccaggatggtctcgatctcctgacctcgtgatccgcccacttcggcctcccaaggtgctgggattacaggcatgagccaccgcgcctggctctgctaataagtattcctatacgattgattcggaaacgtttactgtgagagatgaaatatactaacctcttcccccaccattactttataccagtagaacctcacattctacttcagataacttatccttccaactcctcgtctccttctgagtacttagccgtctatacccgaataagaattcgaccactctggctatctagaacaagtgacatgtaattaacactttcccgtcagaatctatcttatcctcaagatgcatcggtgacaacacactacctatgtactatgcaaggcttactacatctactcgtcacctagcaacagcataggaaacctccacaaagtgtcctattagctaccacgaacagggc

SEQ ID NO: 607635 - DNA, 651 bp, Homo sapiens
gatcatgcccattgtccagagagccttgcaggtaccgttccagcggacacgtccggaagatggcaggcccaatattattggctacgatgtactccctgacagtacctagaaggacttggctccgtacctgcccagcgtgacgcctggcctgaaacgacatcgtttgatggaccctgtgccgtagtagagtgcagcgtacccgatatctgtctagaaggctcctttgtggtcatggtgaagggcatgggggagtccgctgcgtttgaggcacttgttgccggatggacgtgatagtggagacgaactgacctatgagactagagcgtcgtgtgagagtcgcatcaggagcgtgcaaacagggagttggctgaggtcatgaccggtattggggggtggaagcaaaggtaggaagagaagttgggactgtccacgcaatggtcgtggcggttcactgtctcagttgaacaggtgtccctgttgcttggcccaatgtccgaagcaggtgctacttctcccgcatgattggatttaggctgggccatcaccgttctcgggactaaggggtcctggtcgatcatgttggggggctcctctgagcggctgcttctccctgccctggtcgtacgagtgcctccgtgccttgcggggcca

SEQ ID NO: 607636 - DNA, 317 bp, Homo sapiens
  misc_feature (1)..(1): n is a, c, g, or t
nctaggggctactggatgccttgttcaggggccagcaggagctagggataaacagatctctagggggactgctttgacctgcgctgactctgtctgagccacccaactggagtccaaggcctgaggcacagacgtacagatgccccttagcagggtcctcctgatcaacacctgctcccctgtactcattagcaacctcacccaccctactctcaaagcacacttggctctcgtatccaggagctctgcatctgtagattcagcaacagcagatggaaaatattcagaaaataaattggacggttatgtttctattg

SEQ ID NO: 607637 - DNA, 159 bp, Homo sapiens
gcagacacagcacgtgagctgatgatccatctcaatcctgtcaaattgcatataagctctgaacatgccctccagcctatcgaagctgcagataaactgtcatacgtcgatttcatgtgttgtctgcgtccgcatggtttcatgtcatagagctggttg

SEQ ID NO: 607638 - DNA, 662 bp, Homo sapiens
  misc_feature (82)..(82): n is a, c, g, or t
  misc_feature (96)..(96): n is a, c, g, or t
  misc_feature (190)..(190): n is a, c, g, or t
  misc_feature (458)..(458): n is a, c, g, or t
ttgaacccggagcaagagtttcagtagctaagtcaggccattccctcaagctgggcaccaagagtgagtctccgtcaaaaanaaaaaaaaaaaagnctgctgatagcctcagcaatgaaggtttgtgtcaccccaccagggagggacccatgaccagctgaagtgcttgcagcctggcaaaggaaaaaanacaggctgaggcacatgatagaagacaggcagggatgccacaatcataaccatggcaaagaccaggatcagaaaggcccaccatctctgaccccaaatccctgggcagatggttccagaactcagaattttcccagttgtagaaagatggggccaggtgcagtggctcacgcctgtaatcccagcattttgggagtacagggtgggcggatcacctgaggtcaggagttcgagaccagcctggccaacatggtgaaaccctgtctctnctaaaaaaaaaaaaaaaaaaaaaaaaaaaaaaaaaaaaaattagccgggcgtggcgatgcatgcctgtaatcccagctactcgggaggctgagccaggagaattgcttgaacccgggaggcggaggttgcagtgagccaagatcgcgccactacactccagtccgggcgacagagcaagagtccattcccccaccaccaaaaaa

SEQ ID NO: 607639 - DNA, 214 bp, Homo sapiens
agaattgcttggacccagcaggcggaggtgagtgagctgagatcacgctattgcactccagcctgggcgaagaaatgggactccatctaaaaaaaaaaaaaaaaggagggagagagaataggtgcttcaagatagtttcatcccatgggggtcctgtttccaatgggggcccaaaacgggtgtaaaaatatagacttggaagctccatagaccg

SEQ ID NO: 607640 - DNA, 142 bp, Homo sapiens
ccgtagatgggatatgcgtgacttaagaagtgtatggattctcggcgtgtgcagtgtggagattcggcgtgtgcagtctggacgttcggcgtgggcgacaacggtctgacctgtccttaagtatgggtactcggcgtgtgca

SEQ ID NO: 607641 - DNA, 266 bp, Homo sapiens
tcctgatgccagttggcactgcagagttcacacaaaccctgcacattttgatactacaacgccctccacgcacatgcacacctacacacgcatgccacacacatgtgcctgccatgtgtacacacacacaggccgatttgttgcatttgcagcagctatgcctttcaagcccaatgcactaagccagcgcacagtcttagccacctcttggcagcattttgtttttgcagaaataagcctccctcttcctaaaatgccccaccagc

SEQ ID NO: 607642 - DNA, 603 bp, Homo sapiens
gaacaggttggctaaactttttcattatctcaccggagccgagtcagtttggggccgctgctcatgatttttaggtgcccatttgagatagacctccaacctctatttgttagaaccagttgattagaactagtccggtagccatggtcgctgaaaagctcatggcaggtgtaagattgtgaacatgactcgatgcatgacatggagttggggcctcagtgttcaccaatgcagtagaagaactagaggaatacactcatgggtgaactggggaaagcctacatcaaacgagggtttttgctcaagatgcaaagcatcatgcgaactttgtggtatcccatctgtgaaacagtctctcctttccaggttaaaatgcaggaagatgacacaatcaaattgctccaactgaagacacagaggagtctactggtatgggaacctgcttctatatcacaaaagcactgtgttttagagaccaatgttgcggcttcactgagaaatctgttggttcaacagagaccgactactcccgaatagccgccagtatacttaagttgcccgtaacaactccttattttacaattagacactgtgtatgccctt

SEQ ID NO: 607643 - DNA, 293 bp, Homo sapiens
atggccgcaaacacccatgtcccatgagtagctctgttgggtagtgtagggagaagcggctggagtacatactctcaactcctcgttatgttggtgtctggcgtgtgctaatagtactactgagctctgtgttggggtcatggatgagcggctctcttggatcttaagggcaggccactctcttcttgccttgaaagaatcctccttcctcacacctgggctcctctggcttcagcttctcagcagcaagcaccaggcttccacaacaacactatattttcatgctactttcc

SEQ ID NO: 607644 - DNA, 723 bp, Homo sapiens
  misc_feature (68)..(68): n is a, c, g, or t
  misc_feature (79)..(80): n is a, c, g, or t
  misc_feature (107)..(107): n is a, c, g, or t
atcaaccagtcagatttaagattccagagaaaagtgtttgcttttttttttaaatcttccctctatancttagcaattnngaactactttcaagaaggacttcatancaggaaagagccagtgattcccaaaattacaaatgccacaaaattctcacggtgcccctggtgctatacaccagcctctctcagccccatgcccaggaagggcctgaccattatggatgcagcatgctcaccctcctccggagccggtcccgctcttcccggatggcattcatggtggccttagtccggttcagttcttcctctttgctgcacagcatggcagtcaggctctcattctcttccctcagcccagccagctccttctcccaccgagacctctcttcagccaggttgggatacaggtcccggccaagcaccccctcaatctcctcgactgtcttaatagccaggtcacagtgctcgctggctgtggtgagctgctcaatgtgcctgtccacctcggccacggagaggctgcagctgctcttcttcctgccgcagacaacattctccagccctgtcagcaccctctgcagttctgcggggatagagacagaggtctggtcttggtccatgcttcgagagtcctcgttgacctcgtgttggctctggctgagttctgatcgcagttctgagtactcatcttcctccctgatggtggtgccttgcagacggt

SEQ ID NO: 607645 - DNA, 101 bp, Homo sapiens
acacagatgctaacttctcacgctggagatccactcggagaccattcacccacacaccctggttgggagtcaacgtcaccatcccatccgggaccacagtg

SEQ ID NO: 607646 - DNA, 777 bp, Homo sapiens
  misc_feature (68)..(68): n is a, c, g, or t
  misc_feature (79)..(80): n is a, c, g, or t
  misc_feature (107)..(107): n is a, c, g, or t
atcaaccagtcagatttaagattccagagaaaagtgtttgcttttttttttaaatcttccctctatancttagcaattnngaactactttcaagaaggacttcatancaggaaagagccagtgattcccaaaattacaaatgccacaaaattctcacggtgcccctggtgctatacaccagcctctctcagccccatgcccaggaagggcctgaccattatggatgcagcatgctcaccctcctccggagccggtcccgctcttcccggatggcattcatggtggccttagtccggttcagttcttcctctttgctgcacagcatggcagtcaggctctcattctcttccctcagcccagccagctccttctcccaccgagacctctcttcagccaggttgggatacaggtcccggccaagcaccccctcaatctcctcgactgtcttaatagccaggtcacagtgctcgctggctgtggtgagctgctcaatgtgcctgtccacctcggccacggagaggctgcagctgctcttcttcctgccgcagacaacattctccagccctgtcagcaccctctgcagttctgagttcaggtcactgcagttgtccatgtcagcagtaaccatggtagactggttttcggggatagagacagaggtctggtcttggtccatgcttcgagagtcctcgttgacctcgtgttggctctggctgagttctgatcgcagttctgagtactcatcttcctccctgatggtggtgccttgcagacggt

SEQ ID NO: 607647 - DNA, 119 bp, Homo sapiens
gtgggtggcttttttaaactttatttggaaataattgtgaatctgaaagtggcaaatagtggataaagtctatataccctttattctgatgactgctaatgtttaaccccactagcctt

SEQ ID NO: 607648 - DNA, 930 bp, Homo sapiens
  misc_feature (51)..(51): n is a, c, g, or t
  misc_feature (58)..(60): n is a, c, g, or t
  misc_feature (68)..(68): n is a, c, g, or t
  misc_feature (86)..(86): n is a, c, g, or t
  misc_feature (106)..(106): n is a, c, g, or t
  misc_feature (109)..(109): n is a, c, g, or t
  misc_feature (135)..(135): n is a, c, g, or t
  misc_feature (149)..(151): n is a, c, g, or t
  misc_feature (155)..(155): n is a, c, g, or t
  misc_feature (163)..(163): n is a, c, g, or t
  misc_feature (170)..(170): n is a, c, g, or t
  misc_feature (892)..(892): n is a, c, g, or t
aacagtggaaagaggttcacatagcatggtaggttgagagtgcttatgagntgatcannntcaaaggntacacatcctgggctatnggactctctgtagcagattnggnagagagtataatgaagaatcttaggngggtgcacccagtnnncacnatgattangggtctntacggaataaaggatgatttcttccttaggtgtccttgcatttgggacagaaatgggatctcagaccttgtgaaggtgactctgactttctgaggaagagcccgtttgaagaagagggccagatacactttgggggatccaaaaggagctgcaattttaaagtcttctgatgtcatatcatttcactgtctaggctacaacaggattctaggtggaggttgtgcatgttgtcccttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacataccaacaatgcaacccactatcccagtgttatacccacttaaaccccccattaaccttggacngtggacaacaacaaaacaaaaaaaacacaacaacaaaa

SEQ ID NO: 607649 - DNA, 272 bp, Homo sapiens
acctgaggacccggctatacattatctcatcaactaacataggaaacgaaacaaatactgcatgttctcacttattagtgggagctaaataatgagaccacatgaccccccagaaggggaccaacacacacctggggccttattggagggatggaggggtgggtgactaatgtgcatagccggttatcacctttatcggcttgatgggggagctttgaagaaacacgaaagagggatgactgagaaaatcagaatagtggagggcgggaaga

SEQ ID NO: 607650 - DNA, 710 bp, Homo sapiens
  misc_feature (51)..(51): n is a, c, g, or t
  misc_feature (58)..(60): n is a, c, g, or t
  misc_feature (68)..(68): n is a, c, g, or t
  misc_feature (86)..(86): n is a, c, g, or t
  misc_feature (106)..(106): n is a, c, g, or t
  misc_feature (109)..(109): n is a, c, g, or t
  misc_feature (135)..(135): n is a, c, g, or t
  misc_feature (149)..(151): n is a, c, g, or t
  misc_feature (155)..(155): n is a, c, g, or t
  misc_feature (163)..(163): n is a, c, g, or t
  misc_feature (170)..(170): n is a, c, g, or t
aacagtggaaagaggttcacatagcatggtaggttgagagtgcttatgagntgatcannntcaaaggntacacatcctgggctatnggactctctgtagcagattnggnagagagtataatgaagaatcttaggngggtgcacccagtnnncacnatgattangggtctntacggaataaaggatgatttcttccttaggtgtccttgcatttgggacagaaatgggatctcagaccttgtgaaggtgactctgactttctgaggaagagcccgtttgaagaagagggccagatacactttgggggatccaaaaggagctgcaattttaaagtcttctgatgtcatatcatttcactgtctaggctacaacaggattctaggtggaggttgtgcatgttgtcccttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgatatgccattcttgctggggatcctgctagagtcacc

SEQ ID NO: 607651 - DNA, 136 bp, Homo sapiens
ctccgccatgtctttatacaacattgatatctgtatatactcatgaatatacccggggttataatccaatgctactttatttatggctcagatgttctagctttgtcgttgggagctatttcagttggttcctgtg

SEQ ID NO: 607652 - DNA, 186 bp, Homo sapiens
  misc_feature (173)..(173): n is a, c, g, or t
cagagatccaaacagtgccagagtccaaacagtgcccagagtccaaacagtgcccagagtctaaacagtgcccactaggcgctgtggttaagggctgtacctcgcattatgatgctgttgtgaactctgcttcctccggagtactttcagctggcttaaattcaggggtactnggcgctatgccga

SEQ ID NO: 607653 - DNA, 312 bp, Homo sapiens
agggtctcactctgtcacccaggctggagggcaatggtgtgatctcagatcactgtggcctggacctcctcaggctcaagtgatcctctcatctcagcctcctgagtagctgagactacaggcatgctccaccatgcccagttaacttttttgtattttgtagagatgaggtgtttcccagacaggtattgaactcctgggctcaagcaatcctctcgccccagcctcccaaagtgttacttaggattacaggtgtgagcctggcccagtgccttcttatctgtaggcgaactctggccaaatgtcgacgcg

SEQ ID NO: 607654 - DNA, 436 bp, Homo sapiens
tggcattagacctggcacgatgacaccacggagactagaactcacacatccagacttcgtatgtgttttctttgtgtaactagtccgtatgaaggtggtgggtgtaagggagaccactgccggattcataagatcctctatgaactccaagattcgtacagcagagtgatgtccttcatactcatgaatgttggactggttgaataccactgtagtaggataagcctgaatgttatacatgtgagcagagtccctcatgaactgtacactctagtgtaccaaacttaagctgaccataaagaagattagatgctcttcgtaactctggtcgtcaagctcgacatggtggacaccagggggcaacgaaatcaacaagcacaaatggttcttagacattggcaggaaaattatgaggtcccctgaagatgttggctgg

SEQ ID NO: 607655 - DNA, 564 bp, Homo sapiens
gtacgatcgagctcggtaccagacgtcattctgcatcaggattttttttttcttcttccaacttttaggttcagggggtacatgtgcgggtttattatatgggtaaattatgtgtcacagggggtgggtgtaccaattatttcatcacctaggtagtaagcatagtacccaagggtagttttggatctcaccctcctcccaccctccaccctcaagtcggtcccgggggtctgtggttcccttcttggtgtccaggtgttctcagggtttagctcccagttataagtgagagcgatattgggtttttccgtgccggtattaattcacttaggagggcctctagctccatcggtatggctgtaagggacatggtctcattcttttttaatggcggtgtagtatggcattcggccaagattggtaatggggggacttttttctaatagattggggtgaaagtggattgtctattctggacttttactaggctctgggaccccaggtaacctaggaattagagtactatctgtgagatcatggatttgaaatcttgctttgggaggt

SEQ ID NO: 607656 - DNA, 299 bp, Homo sapiens
  misc_feature (15)..(15): n is a, c, g, or t
cccccccccccgggnaaagggggttttccccttttaacccccgagccccccccccccccaaaaaaaaagaggggggggttggggggggggccccccccccaaaaggggggcccccgggggggggccccccccccccccccttgggggggggggggggttttttttttttttttttttttgggggggggggggggggggggggtttttttttttcttttcttttttttttgggggggggggggcccccccccttttccccggggggtgtttttttttttttttaaaaaaattttttttta

SEQ ID NO: 607657 - DNA, 417 bp, Homo sapiens
ttcggaaagtatcgccccgacgaccgcgtaggtgatgccgatgcgcaatgcggtgaagaaccgagggagggcagacggtaggcgtacgtaccgaaactgttgccagcgtgaggctcccatgctcacgaggagagacctcgcatcgcgatcggctgccgcgaagccctcgatgagcccgatggccatcgggaagaacgtggccagagcaatcaccagaaccttgggcagcaatccgaagccgaaccagatgatcagcaacggtgcgatggcaatgatcggcagcgtctgcgacacgacgaagagtggtacgaatgcgcgccgcagccacggtgagaaatccaccgctaccgccagtagccaggccaggacgagggagacggcgaaaccgacgagggtcacctgcagcgttgcggccgc

SEQ ID NO: 607658 - DNA, 368 bp, Homo sapiens
  misc_feature (9)..(9): n is a, c, g, or t
aaacctcanaccaatcattccattccatataaaaagcataacaatacataatatatggttattaatgcacctcgatattatttgtttataaataaattcatgatagcttcttttttctatttaacgatggggagggttgctgcggcaacgagtattccctttgcaactacgggcatatgggttagcttctccaccaggagggttgttgttggttggacaacctgggtctttggctccaggtacctagcatggatcaagcaccccagggacgatattagtagcccccaacacatctgccagcactgccatgcttattagaacaaagcacaagaaccatggcttcatcttcttcctcccaaggtcgacgc

SEQ ID NO: 607659 - DNA, 502 bp, Homo sapiens
cttctcccctgacaacaaatgctgatgaggatgtggagaaaagaaaactttcactgttggtgaaagtataattagaacaactactgtggaaaacagtatgtagatttctcaaaaacctaaaaatagaaccaccacatgatccagcaaaccaagtataaccacaggaaaagaaatcagtatatcaaagagatacttgcacttgcatatttatcacagcactattcatgataacaaagatatggaattaacctaagcatccatcagcggacacagggataaagaaaatgtttatgtacacagtggaatactatttggccataaaaaagagtaaaatgttattgctaacaacatggatggaacttgaggtcattatggtaagtgaaataagccaggcacagaaagacaaataccacatgttctcacttatatgtgggaggtgaaaaacttgacctcatggagatagggaatagaataagttatccggggctgtcaggggagaaga

SEQ ID NO: 607660 - DNA, 1347 bp, Homo sapiens
gcatagtacctcatccgccaccttgctcgaccgcagaccgcatccgtgcgggtcgcctcctccgccgtcgtgggtactcctggcagctttatcgccagagtccctgaactctcgctttcttcgggaatgcccctgacgtcggatcaccggcgtggcccgaccatgtcagatgccgccgttgacaccagctccgaatatcaccaccaaggtacttttgaggagaagaaggaagttgtggaagaggcagtaacaatggcaaagccacgtcccggtgcactaaagggcgtagactgccaggatgtagcgacaaatgacgtcgttgtccctagtgtacgcggtgaactccatggaagtggcacgatagtaagacacaatggcagtcaacggcaggccacggtgcacaaggaccacacgaacggagagacatatgtcaggccaggtcacatgcatcgacaaacagcgggaacccacggacacgaggccacttggacagcacggccgctacaaggtgggctaaagaggagggaactacccgcattgacccatatgacgcgaggacctccgctggcgcgcacagacaactgcgacggtcacttagtactcagctacacgccaacgcgtcaccccaaacgacagcaacgacagagacatatcctacagcaagctaaactagattggacataccaacgaccaccggttgggaggtcggcaaacgccgcgatggagcgtggcacggcccgccgcgacgtcacatacgcagacgggacgcaacaggggacaaaggacgcacccacaccggagcagggcaggggaggagaaggggacagtaatgtaacgacatttgagccccgtatggcacatggggacgccaacaccaacgcgagacgaaaagtcgaaagcgcaagttgtagcccaagacagacaaggtacacacggaggggaggtccaccacaacagggggcgcgacgagagaaggagggcaaacaccgcaggaacaggacgtcaaggacacgcaggcacgcgcacacgagagaagaaacgagagcggactcggaaaggaaagaccagtgcatgtgggaccggtacccgatcagacgcaacagagcgcgcaacagacagggaaggcccagacagcaaacaccaacgaccacgacaggcgaaagatagccgtgacaggtatcggatgagccgtcacgacaattcctgacaagcgacaaatatcacggaaggcaggcggcccgtgagagagcgcaacagaaggaacgcctgagaacaaggaaggacccaacgcggcaggtcaactgggaggcggaaacagcagcaaggacgaaaaagagaccgagaaga

SEQ ID NO: 607661 - DNA, 151 bp, Homo sapiens
gacggggccgaggaagcacaaactctgggggggcgacccaggcttctcatacttgatgatatagccggaaatcctggcaagtggcggctgccatgataccagacaggaattgggtgtggagtccaggacacgcagagtgactggtgcatca

SEQ ID NO: 607662 - DNA, 253 bp, Homo sapiens
ggagtaattgcttgaacccaggaagtggaggtttcagtgaactgagatcgcaccactgcactccagcctgccaaactgcatctcaaaaaaaaaaaaccaaaaccaaaccttggggcctgggcctaaggccccctttcaatcccaatttcgggggcccaaacctgctttgcttaagaaggggcttaaaaagatttaaccccttgccagaacccccttgccaaaacaattaatttgcccaaaagccccttaatgc

SEQ ID NO: 607663 - DNA, 316 bp, Homo sapiens
gcagccatcgccacagagctggcacaggcccacatctgccaggcatctgaaaacgtaagagcacttgggagatgcgggagtggagaggaggagcctcccctgcccggccgtcagccatcgtaatgacatgtctgtgggttgccctgtgccgccaggctgggctgtcggaagcacccagcgacgtgtctgtgggtccgccccgtgccgccaggccgggccatcggaaacacctgcagtaaccggagtgccctcgctgatagcccttgttccggggcctcgtcctgggctgtgcagagctccagccccagccccagcc

SEQ ID NO: 607664 - DNA, 728 bp, Homo sapiens
gtgtggaggctgagaggatgttttcatttggtccatttagcatgagagtaaatagctttagaacatgggcatgaggtccgaatttgaatttcattcttattactgcttttagaggaattagtttctatcatgtggcatatagcaaatcgcgaagttgcatttaaagattaggaattcggtaaattttgagctttaccagtacgttgattcacttgtttggaattatggatcgtcagctggagtagtctgagatcacatcatctcttttctgatgatgggttgcgtgtaaaactacaatttttttcctgtattaccttaatttattgagacagaagtttcactcttgttgcccaggctggagttgcaatgtgcgcagatcatccggtcacatgcacacctccatctcctgtggtgcaaagtgattctcactgcctcatcctcccgaagtagctggcatctgcaaggcaccctcgccaccatgcccggtaattttagtatttgctctttagtagaggtggggtttcactatatgttagtcaggctggttttgaacttctgacctcaggtgatccacccatctcagcctcccaaagtggtgggattacaggtgtgagccactgtgcccgcatgacttaagtgagatgaaccatgaaaagtgaaccatgaaaattcagtttatgttctaatttttattattatttttgagatgaagtctctctgtgtcgcca

SEQ ID NO: 607665 - DNA, 179 bp, Homo sapiens
aattttaaaaaccgtaattaattccttatcaccattataaaaaccttgatctttttatttgatctaaaaaagcctccttccacagactttcttcacgtagaaatgggagttcgttataccagtgttgtttttaactaataaggctcttctagaattcagccctgcctgtaacgtctctc

SEQ ID NO: 607666 - DNA, 251 bp, Homo sapiens
  misc_feature (15)..(15): n is a, c, g, or t
  misc_feature (20)..(20): n is a, c, g, or t
  misc_feature (22)..(22): n is a, c, g, or t
  misc_feature (29)..(29): n is a, c, g, or t
  misc_feature (115)..(115): n is a, c, g, or t
  misc_feature (123)..(123): n is a, c, g, or t
  misc_feature (181)..(181): n is a, c, g, or t
ggaggcggccggcgncgcgngngggccgngctgcttgggcctgagtgcgtccggcgagtgcacctgtgcccagtgtgcggagagtcgttcgccagcaaggccgtcaggaaccgcntgcccgtnctgcacgccgcccaggtgttcccctgcaagtactgcccggccaccttctacagctcgncccgccttacgcggcacatcaacaagtgccacccatccgaaaacagacaggtgatcctcctgcaggtgcc

SEQ ID NO: 607667 - DNA, 601 bp, Homo sapiens
ttagaccacgggttggcagcctggagcggctgggaggatgggcctctccgctgcggccccgttgtggggtcccccggggctgctcctggccatcgccctgcacccagcgctgtcggtgcccccgcgcctgtggactactgctgtgctggtgcgctgggcccgctgggcctgcagatgtgcctcacttcctagcagctgctgctggactgcgactacgcatgtgttctgatgctggtgcccctgctggccctggcatgcttcttcacactgctaccctgcggcacctgcaatgctcatcagcatcaacaagcgtgtacactggtgcaatgtgctaactgcctgagttcaacctccgccacgactggaactctctgctcagccactgacccctggctgctcttcagacactactctgcgtgcctacttccccgactgccctgcgacatggtgctgctacctgggtgacttctgctggacacgctgtgggctccgtgtccagtacaacaccaccatctgcccactgtcactctggacaaggacctgacaggcctggaatggccactacttcatcctaactgaccagaagggccggtgcatcagt

SEQ ID NO: 607668 - DNA, 116 bp, Homo sapiens
gatggataggtacttaattactgtacccctccaccacctttctccttgcacgatctatgcagaagacaggtaagggacacagaagtagtgtccgtcttcgtcagaataccacagac

SEQ ID NO: 607669 - DNA, 279 bp, Homo sapiens
aggttgcccccacttacagtcatctttccaccatgcacgttgggcttgtggttgcctcagacgccgcctcaaggctgagtcagaaccagcttcctcttgcagggagtgtatggggcttacactgaatggtgtccctgagcccttagatcagagaatgatagaatgcatattatcatctccactttatagatggggaaactgaagcggggcgcccgggaagtgctcaaagtcatacctcttggaattgggaaggcaggacaggcactcaggctgtctgag

SEQ ID NO: 607670 - DNA, 117 bp, Homo sapiens
acaacgagtctactagactcccctacaacctgcaaatcgaaccacagcatccagagggctgaggaccgaggagcgcgagcagctcaacaccctcaacaataagtgtgcctccttggc

SEQ ID NO: 607671 - DNA, 867 bp, Homo sapiens
ggccggtaccccaactcctctcggtggcaggggggggggtcccagtcccccccgtggggcaatggggctgcccattctcgcctccgcgtgtgccccccctccttggtaggagcctggccacaggcgagtggcgtcctgcggcccccgtggcacgacgtggcaagacgtttgtcgcccctgtgcgtcaagcctctctcccccgttcacgccccagaggttcattgtcccccccaggggctcattgctccgaacactcattcccatcgggctggcccctaccagcgggtccccccgcggctcatggcacctctcttagttgcctcccgtcacctgctccagcccgggggacctgaatggtgtcttgtcccgccgcccccacgccgggttgaattttgcccctgtggggttcacgccgccaaccaagggggtagaagcccctcgtggggaattctcaccatcgccccgctccccgctcgcacgcgctgggagtcagcccgccttcgttcggcactccgggtcacacgaactccgccatttgtcgtccgccctcttttgctcaacacagctccctcgcactccagcattttctgcgtctcaaagcattgcccgtgttcagccgcaaactccctgtaatagcagtgatcgtgtacaccctacccttccctcgccttttcttttcggcaccacggaacgcacttcaccgcctcctcatattttcacccactgcgcgaatactttaaatcgcgctccccccgagcccccaaaacaccccagaatgtcccccccccacgcagccaaagactccaccacgcctccatcaacaaacagggtgcaaaaataaaacaactttaaaaagcgaacataaca

SEQ ID NO: 607672 - DNA, 1055 bp, Homo sapiens
agattgctgtcaataaaatggtaggttttgacccgtgttccgtactaaaggcacgaatgtcgctccctgactgtctgccatgaaagtctcgctccatgttatatggtcctatgtcctggcccttgtgaactatgatctgcagatgacttgtctcgggcttggactagtgttgtacgtatataatcccttcgacttcaactcgcggatggtagaatatctagattaggatgtttcatccgtgtcgagaccctgcgcaagatgtcgggtacgtgataaagcgtgtattggagtcaattgggtctttggaagtacggctcatgatcaggtttcctgggcctataatgccgtgaaatgtgtctgctatgttaatggaagggaccttgacggtctgaagcttccatatgggacagattgcgccaggtttaggataacataaatcctgggccgtatcgtaagtaccacccaccatatgccgaagatatctcataatacgtatgcctattctaactgttcaatgaggggtatcgtcatgtgatcctattcgcgtttacgcgatagggcgatcttatccctcaataatgagctgcggggtttatctagagggagtacacagcgcactttggagaataaattcagggtttccctgggcttggccgccatgtcgacttgaatgttttatacgtgtatgtgccaggtctctacttagtatcgaacctgtgggacggaggacattgagcgtcgcatgatcacggagtcttgtgggactaccaggagggtgatggagctggctaaaattaacatcgcggttaggagagaacgtcttcgaagagatatttcctaggctgccaattggatccactgtttgtggggcctggacaatgccagttcacccaagtgtttcaactctctataatcaggttctgtggtttgggaacccttaaaaatccgggaggaattgcgtgtgaatagccagcacagcacacacgatggatccgaaacacgccatgggtagaagggggggcacaattatagggcagatccactcttagaaaaag

SEQ ID NO: 607673 - DNA, 983 bp, Homo sapiens
gacagattgttagagctgagctgccctactacagctgctgccggcccctaggacatagcaggtacctcatctacgctgatcaccagtgcccatcgtgatccagacccggcaccagcctgcccaatgacaccgcagatgagccatggacgcccatgcctggatggcgtgcggtctaacgacacgcatcaaggggctccacttgtgacagacgtgggacttgttgtgcaactccatgcaaactgaatggagatggcccagtctatcttcatggcaggtatactgattggagggctcgtgcttgggagacctgtctgacaggttggccgaggcccatcctgacctgcatctatctgctgctgtcagccagcgggatccggtgcagcacattgcagtgcccactcgttccgccatctacatggtcttacgcttcctgtgttggactttgcatctcagagcattaccctgagcaccgtcatctttgacgtgtcggtaatgggtgctacccggatgcgggcaatcatgtcgacaggcactcgggtactgctacaccttgggccagttcattctgccggctggctagccatcccccagtggcgttggctgcagttaacagtggtccattccctttcttcgtcttcttcctatatccttgttggaccccctggttgcataccgcggggttggcctgtggcttgggaaggtcctcgaaggccctgaagatatccgccgggtggctgctcactggcaacaggggcgaaggcaaagcctatttgaggacgccactctaccctcatgggattcctttacgtccagtaccgcgtggccgttcgtatctcagcgtagagtctatttcctcgacgctagccagctcgcaaacggcttgtggcaactcgcacctcaccactctatggttcggcaccagctcctctcacacgagaatcgagtcgcacaactctaggatctgtcctcttcactcgtcgtcg

SEQ ID NO: 607674 - DNA, 643 bp, Homo sapiens
  misc_feature (12)..(12): n is a, c, g, or t
  misc_feature (162)..(162): n is a, c, g, or t
  misc_feature (230)..(230): n is a, c, g, or t
  misc_feature (241)..(241): n is a, c, g, or t
  misc_feature (258)..(259): n is a, c, g, or t
  misc_feature (296)..(296): n is a, c, g, or t
  misc_feature (306)..(306): n is a, c, g, or t
  misc_feature (343)..(343): n is a, c, g, or t
  misc_feature (380)..(380): n is a, c, g, or t
  misc_feature (395)..(395): n is a, c, g, or t
  misc_feature (419)..(419): n is a, c, g, or t
  misc_feature (426)..(427): n is a, c, g, or t
  misc_feature (435)..(435): n is a, c, g, or t
  misc_feature (440)..(440): n is a, c, g, or t
  misc_feature (446)..(446): n is a, c, g, or t
  misc_feature (454)..(454): n is a, c, g, or t
  misc_feature (460)..(460): n is a, c, g, or t
  misc_feature (462)..(462): n is a, c, g, or t
  misc_feature (608)..(608): n is a, c, g, or t
aacaaaaggttnatcattttggatttaataactagtgaaaacttttaatcaagcggatacctagtagactagataaatactggaagaaaaatggtggatcaaatacttttctacactggtaatgaaggggacattatctggttttgtaataacacggggttnatgtgggatgtggctgaggaactgaaagctatgttggtgtttgctgaacatcgatactatggagagtntctcccctttngtgacaactcattcaannattccagaaacttaaatttcctgaaatcagaacaagntctggctgantttgcagagttaatcaaacacttgaaaagaacaatcncaggagctgaaaatcaacacatagtcattgccataanaggctcctatggtancatacttgccgcctggtttagaangaaatannctcatatngtaantggaantcttgcancttctncncctatctggcagtttgaggatttagtaccttgtggtgtatttatgaagatcgtaactacagattttaggaaaagcggtccacattgttcagagagcatccacaggtcctggggatgccattaatcgactctcaaatactggcagtngtttgcagtggcttactggagcccttcacttatgc

SEQ ID NO: 607675 - DNA, 371 bp, Homo sapiens
  misc_feature (304)..(304): n is a, c, g, or t
  misc_feature (318)..(318): n is a, c, g, or t
  misc_feature (337)..(337): n is a, c, g, or t
tacaacctaaatttgccaacaaaaaaattacctatgagcctttatttgggttcaaaatacaaacaaaatgacaaagaacaaaaacactgccttcatcccctccacacacaaaatatgtaatatcagatgtgacagtaagatattagaacttgaggattctaacccttagttggttgaaaaccacgttgggacacttatgtttcaaacttttaactaaacctgcccaatagtaatcctaggaaaaatcaggaacctacgtattctggacatggttcagatggcaccccttcaggagtaggctctnttacccaacaactncactggatttcttacccgnatttttttgggccttttggttggctggccttcct

SEQ ID NO: 607676 - DNA, 222 bp, Homo sapiens
gctgctgtctactttttatacgtaatcccgtttccaaagaaatcctccaagctatccaaatatccacttgcagtttctacaaaaagagtgtttcaacactgctctataaagaggaaagttccactctgtgagttgaatgtacacatcacaaagtagtttctgagattgcttctgtctaggttttaggtgaagttgtttccttttctactgtgggcttcaatg

SEQ ID NO: 607677 - DNA, 138 bp, Homo sapiens
ctccgtagctgctgggggttgttgtgttgtgcaagggtggcagcaggttaacaggcagccacttattagtaatgttgatagtagaatgatggctagggtgacttcatatgagattgtttgggctactgctcgcttact

SEQ ID NO: 607678 - DNA, 230 bp, Homo sapiens
  misc_feature (74)..(74): n is a, c, g, or t
gcctgcgctcctcctggaagcggatgagggcagctctctggttgaccagatcgaccagcttgctcaggacctgngcctcagcctgccgatcagcagctgtctttaggcttccctcccggatcatgtagcctgcgagctactggaccagctgccactgagactgctccagattcaattcctgcaccgtgatcatgagctcggcctcctcagccaccaggctgtttttcttg

SEQ ID NO: 607679 - DNA, 490 bp, Homo sapiens
tttttttttttaattaaaacagcaaccaggtaactgccccaacccatcagggaaaggacccgggatgggcagtcgttttttcaaaaaaattatattttctttttttaaaaacaacaccaaagcaaacccatagccccgtgtcaagccagtcctcagggagagtgagctggaaggttccccctgtgcactttcttctgtgagcagagattctttgggccccttcccactgtggaccccagccgtgagcagagggcaaggcttcgtgccgtgcttggttacccatagggggttgggggacaaagcgattcagcttccaaaaccgagtgcaagaaaaaacaagccaaacccataaagagcaaagagaaaaaatatcaacgagagaggtataatattgaagaaaaaacagcgaagaggtgcaatgaccaccgtataacggtggcgggcaggacgtgggtgagccaggtgtgctccgtaaaggcccgtgtttgcc

SEQ ID NO: 607680 - DNA, 155 bp, Homo sapiens
aaaaggaggggttttcccccccccatatgtcccgttaaacagtttgtgggcttggaaccgtcccagccccataataccccagtagtttaatcccggggattgggttgaatgtgattttccttcctttattcccccccccaaaaccggctgggtga

SEQ ID NO: 607681 - DNA, 159 bp, Homo sapiens
ttttggggaaaaaaaaatattgtgttaaatgggggctgcccaaattcccggcccttttgcaggggcttttaagggccccttagtagtaatagttttttgggccggaaccataatgggaaagaatgtttaataataaaattttcccttttcccaatgcca

SEQ ID NO: 607682 - DNA, 404 bp, Homo sapiens
aagggacgggatctttcagagagcatctcgctgttataaaggaggctgctctgaaccgtcatctgaagtctgtagtgaggcctcttgttagggaaactggattgttagggttcaaaaatccattttgcgtgtgtgcaggacacaggtggtattaaacagaagagaaaatcagatgactgtgaaatgttcaatactaaataagatgatctttagtttttccaggggcattgttatttgtgaccacaatgaaaaatgtagacagtgatgatctggtaactggcacacttcccaagctcaagagctcaaaagaatggttggagcccaagcccctttgttttatggaggtatatatcaaatagtgtgggatttggagatttttttacttggaaaagctgctgtagttg

SEQ ID NO: 607683 - DNA, 1745 bp, Homo sapiens
aaaaaaaaaaaaaaaacacacacaaacaccaaaacacaccacacacccaccacaaacaacccacacaagaaacaccaatcacatccccagcacatcacaactatccaccgcccctcccacacgcttctccctacactaccgcccacctctaccacaccactcccacctacctatcctactctttactacaccacgcagcaccatactctcacgctcccacactcatcaccacccccccctacaccaccctccccctcttttccacccccccaccacccaccgcacctcaccacccacccaccacaccccccccgcacacactcaccccacacctccctcaccccaccacctaccaaaccaccaccactccaacaacaccacacacaccctctacaccacacaccatcatctcatcccccataaatcctctaaccccactcctctcatccccaactcatcccccccacccaccccacccccctccctctcctcccaccaaccatccacccaccacaccctcccccactccactacccacatcaactcccccttcccaactcctacaccccacccccacccctcctaactactctccctcccccccgtctcacacaccacctccccctcactcatacccctactcctccatctcccctcccacctctcacacctcccccccgaacgcgcgcgagcgacccgccccctggaccacgcaccgcccgcaccgccgcgcgcgcccgcacactgacccgcctgaccacggcccacaccagcacacctcagaacccgtccgcaccacgcgagcaatccacacacaccagccatcacacaacagcgcaacctcagcgccgccccccgcgcgccaccgcgcccccgcaccccacccccgccaccaccgcctgccacgcccctgctcctgcggcgctcccgcccaccccaccgccatgaccagaccccataagccaccccacgcgcctctccccgctacactcccacaccgcgcccccacaccccaaccgccaccacccccaagcggcgaaccacccccacgccacctactcccctcccaccaccaccacccccccacgcacccaccgtccccccgcaacaccaccgcaccaccgaccaccgcacgacccctccctcctccccccaccccccacccccacacgccccccctctccccacaacccccacccactccctccccgccccctcccatacacaccaccccacccacaacccctccctccccttaccctctcctcctacctcgccgcccacaccccccaccacacccacctcccctaaccacactacatcactctcccctcaccctcacctcacccccacacgctccactaccccactccctctccccacaccaccacaccacccacgacgcaccaccagacacactctgcaccccatccacaccattcaccacacaccgacagcccacccacccccacaagcccgcacacagaccacccaaccaggagcctgcccaaccaccaccacacccccaccacacccccgccacgcccaattcaccgcagcaccacccactccaccgacactcacctccactcgccgcgcgcacgcccccctactcactcgagccacccaccagacccccagacaacgcccgccctcacacgccgcaccacactcatcagtacagaccacacctctccaccactcacgtgcccgaacaaccgcgcgctctccgccaacccgccgcc

SEQ ID NO: 607684 - DNA, 120 bp, Homo sapiens
ggttgagccgcccaccaaaatgcagattttcgtgaaacccttacgggaagaccatcacctcgaggctgaaccctcggatacgatagaaaatgtaaaggccaggatccaggataggaggat

SEQ ID NO: 607685 - DNA, 182 bp, Homo sapiens
tataacatcccttaggagagagactgctggtggtgaactgcttttcttgtacggttgagggctgaaaaagccaatcttaatagacatgaggctcatgtctgcacagctgcgctctgcgcgcgactgcggggctgtcccctgctcaccagccctgcacgatgacatgtccccgctgctgagca

SEQ ID NO: 607686 - DNA, 174 bp, Homo sapiens
  misc_feature (94)..(94): n is a, c, g, or t
gtcccccaggtgttgctcaggctgaactcctgggctcaagccatcctcccatctcagtctcccaaagtctgggattacagggatgagacaccantgccagaccattgtcttcttaactgttgtttactatgtcattccccaacttcctctccttttccccagaatgtgagcttt

SEQ ID NO: 607687 - DNA, 375 bp, Homo sapiens
tccccctcctacccacgctggcttcaacatgcccaatagactcttccctgatcgctttgaaaatagatctgtgtctgggacaccatcccttaactgaattgacaggcactactgagacagtggtattcctaacaaaacgttgtcgaaagagaatcaccgcatactacaatactaccgaacagctatgagattttctatgtgtcccgcgttaaggcacagcagccggagtaacgagacgagtccagtgtggaattttagtgggtgacgagtggtataaagatgtgctgttagtcagtcatgcttcacgaggtcctaagacccagagaattctggaatttgtaggtaatactacacattcaataatgtatctattta

SEQ ID NO: 607688 - DNA, 770 bp, Homo sapiens
aaactctgtttgaggctctcagctctgaaggctgttagccccccaataccactttgcactctaaaaaaaaaaaaaaaaaaaaaaaaaaaaaaaaaaaaaaaaaaaaaaaaaaaaaaaaaaaaaaaaaaaaaaaaaaaaaaaaaaaaaaaaacaaaaaaaaaaaaacaaaaaagacagaaaaaggaagaacacaaacgaagtacatacgatagaaaagcgcaggggcgcatccatacacaccacacacacaagacaagtagccaacgacccacacaaggagcaaaaagaaaagacataagaacagcacgacgcaccagcaaagaacagagcaggagaagagaaggagagacacgacatgctgagcatacatagaaaagaagagcagatgaggaagagagcataccagcaacagtagtagtcaaagtaattaggtagaagaagaaagaacacgagatgaagtcagactcaaagagagagtaaccaaacaacacgtgaccacaacgatagaacagtacacagtcaggtacagcgacgacgcgtcagcagcgagcagtagcgagcatgagaagcaggtgtagcagaacaggaggtacagggcaagctgagagcgaggagtgataaaaaagcgaagagttcgagcagcggagcgaagggagactagagacggggggagagtagagaacgagggaacacaatacgaaaacataaaaacaacaaagagaaaagaacgagagcagagggaatatacaaaaacaaaagacaaagggcga

SEQ ID NO: 607689 - DNA, 146 bp, Homo sapiens
  misc_feature (27)..(27): n is a, c, g, or t
  misc_feature (32)..(35): n is a, c, g, or t
  misc_feature (41)..(41): n is a, c, g, or t
  misc_feature (44)..(45): n is a, c, g, or t
  misc_feature (47)..(47): n is a, c, g, or t
  misc_feature (56)..(56): n is a, c, g, or t
  misc_feature (58)..(58): n is a, c, g, or t
  misc_feature (60)..(61): n is a, c, g, or t
  misc_feature (64)..(64): n is a, c, g, or t
  misc_feature (71)..(71): n is a, c, g, or t
  misc_feature (78)..(78): n is a, c, g, or t
cacgaagcaactagatatcaagcagangctgnnnntgctgnatnntnaacacaccntngnnctnccaccanaaccgancaccatcccggagcttcctgaactgggtaccgatgatgcaggcgaggagtgggcccacgcggcctttg

SEQ ID NO: 607690 - DNA, 465 bp, Homo sapiens
atctgccagtgatttagctatgccaactggttgaccctccattctctgccaagaggcatactctttctcattgtgtgcgctggcagcagtgcacttccacggagggagattaggatgccgtcagctgatacaaatgggtaaccttttctaatttaaaattccttttagggggtagttagacaatttatatatatatataataaaactattattatatatatagtatatatacattttcaaatttgattttattctggttgaggtgaatgtaagaggaatatataatttaatacaatgtgaacagggcttctgagtctatctcatccctacctaatatgttagggttttgccccttcatttcccttacaaaagaatgttagtaggtttatattaatcattgtgtccaaaagcaagcaaagcaaatcacagtgttcacagctctgcttcataacaaatacataaacc

SEQ ID NO: 607691 - DNA, 252 bp, Homo sapiens
ttatcgccggccctgtttagagatatgagatgatggtattgacgttttctaggaaccaacttctgggaaagatttcttaaagaacgaataaatatctgagagaaaaatacaaactagtaactgaaacaatgatgctacttccttttaatacttacaagcctagttttaaagtttctttagcttactaccattgttggggcacggatagagggtacctgcagctcgaagttcgtccatgcctggctctttgct

SEQ ID NO: 607692 - DNA, 806 bp, Homo sapiens
ggggagaactggagggggacacctatgaccgggtgctggctggatgtgccctgtaccacagaccgccactcccttcatgaggaggagaacaacatgctttaagcggtcaaggaagaaggagcgacagatacttgcctgtcgctgcaagatgcagctctcttggcggactggactcctgggccaccaaaccaggaggccactgttggtctacttctaccgtgcgtcacgtctgcacaacgttacaggaacgaggtactgatggctgacaaggctgaccacttgagctgcctggccaactcaactacagcacttcagggtacagggttggaagactcgtgacgtcacgttccggaagcggtatttcagtggacacattctatgtttgcattcatcgactcctgtcaggcttgagggagcctggtagataccaaacctcaatggccaatgtttggccccatgtacttctgcaaaatgcgtaggctagacatagtatcacccaatccctgaaagcaagaatacaaaagggtatactctagttggatgcgaccagaaactaggaaactgggaccaagtggcagagatgcacgtctcaggtccctgtctccatgccttgttctgtgtcagttactgcagtgttctcggcacataagaagtagaagatttgctgtcttgctgtccaattgtggagcatcagcaggtttccaactcactcacttaacccataccccatctccaggcctgtactaaagttgactgcccgcattagggggttagaaggagaatacagtcggagagctcacactaat

SEQ ID NO: 607693 - DNA, 100 bp, Homo sapiens
agagtatcccccggcgcacatatctaatctaacattgtgtgtgaggaatgtaggtttaaggccacattgtctttttcacctttccccagatgctgactga

SEQ ID NO: 607694 - DNA, 467 bp, Homo sapiens
ttttgtttttttttaaaggccccccccgggcttttagtcaccccaaaaaaattgtttccctaaaacccttttttttttttaaaaaaatttagggggtttaccttttttaacggggcccccccccctaatttaaacaatttccccctgggttaaaagggggcttttatatgtaaaaatttaaaggttgtttttttttcttaatgggaatttgacctttatccccttaaagggttttttttaaaaaaggtaaggaaaccccttttgggggaaattgggtttttttctaaaaaaagggggcccaaccaaaaagatttttttggggggttaaaggaaatttttaaaggtcccctaaccgttttttaaggggggggcccttataaccccttaaaaaccagcaaggggaaaaaaaagttttttatttctttggaaaaaaaagggaaagggccaaaaaaaaattttttttttta

SEQ ID NO: 607695 - DNA, 106 bp, Homo sapiens
gaatcgagcgctgacctgcttactgggcgtatggtagcagtggtaggagctccatatactctgcttcttctggaggagaaacagacactctactcccaaacacaca

SEQ ID NO: 607696 - DNA, 196 bp, Homo sapiens
  misc_feature (41)..(41): n is a, c, g, or t
ctgtacctaagttctcactctaaatatccctcaattgaccntgatgaaatgtgctgggggatgcatgtggatgcaatgcatgatggaatgaatcttgaaaatgttcatgttcctgtctagtgagctgtaatctgtgtgtgatcctctatgagtctgaccttgcagtgcattgcaatgcttgtgcacttgtgcctgt

SEQ ID NO: 607697 - DNA, 990 bp, Homo sapiens
gcctttaatccgtgcagtgaccgtgtgtcagaacaactcttgaatcactgaagctactaaccatgagccggcctctttctcgagatttctacttccctcacaagttgcccccgaaagttaaagccacagctgcgcctgcaggagcacctgacacaacctcagtgaccttgcagttaacccacgttaccaaaatggcttgcgtcgacttcgctatcttactggaaacactactactccttgtatcaagcaactcggcctcgcttcattacacacgcagagcaagatagactatgacggcacttccagcacatctcagcgaacccaccacatttgcctgcgttctaacaattcccagcttctgaccgaccacacacagtgcacgccttcactcgtcttccaagactaaaccccggtgcacaattcgacagccagctcgccgtggccccacttcacacggtgctgaccggcataccacaaacggggaacacaccattggccctttattaacaagatggcacatttgccttggaccagcggctcgcatacgtccgattatctcctaaactggtgaagctcccatcgcctccaactgtccaccaacaacgcacacctatgtacattattgcggatcccgatcagagggaacgggttcaggccattgaaccattgtcaagaccattcccaggctttcgctacgactttcggacctcaacagccttgatggcgcccttatatcagcaaattcccgggcacgcaccttacattggtcacttgcggagacagaagtcttagaatttggcacggccatcggctttaccccccgcgcaacttgggcccctgttgggactaaataataccacccttgtgggcaattcgggtccctgttcagtgtgaccttacggggacctttgggcgacaaaatcagttcgaccacgttccatgcgaagcggaaggtttaaccaatataaaccatacacagcgagaccagag

SEQ ID NO: 607698 - DNA, 289 bp, Homo sapiens
  misc_feature (8)..(8): n is a, c, g, or t
  misc_feature (16)..(16): n is a, c, g, or t
  misc_feature (25)..(26): n is a, c, g, or t
  misc_feature (68)..(68): n is a, c, g, or t
  misc_feature (207)..(207): n is a, c, g, or t
tgcatggncgattctngaggtaccnnaagcgctggcagtaacggatctgaacaaccatgagcagtgtncggctgtcgggccgtgacaaataagaggatgccaacgctgatgccgcagcgttcttcttagtgtcagttcttcgccatccatgagtgccagtggaactcctgtccgggcatctaacagataaaaatcgcatgtacgatngtgccgctgtgttttccggcctgacggtcaccagtttgacgccggctttactctaccttcttgccagactgggcattaatag

SEQ ID NO: 607699 - DNA, 383 bp, Homo sapiens
tacatatacaaagctcatcttttgatggggtaagtaaagtattattcttgtaaatataagtatcctggcagatagctggatatgagacctatagtcagatggctaggtagcaaataattttctccctttctgtagagctgtacactctgtagataagttatctttagccgtaaagaagctctattagtttaattaggtcccatttgccaatatatagttattcttgcaattactataaaggaatctattagtacatgaagatcatttccaggtcctacgtccgcaatggtatttcctaggttatcgtccaaggttttaatatgttttcattttagatttaagtttttaatcctgcctttgcctcccaaagtgctgggattaca

SEQ ID NO: 607700 - DNA, 324 bp, Homo sapiens
gttctagaggtccctgtcgggtgggtgcatccgcagcacgttggtaggcaaagcaggtgatcacttgagatcaggagttcacgaccagccgtgaccaacatggtgaaacccgtgtctctactaaaagtacagtaattgggcagacatggtggcacatgcctgtaatcccagctactcaggagactgaggtactagaatcgattggacctgggaggtggaggttgcagtgagccgagatcgcaccactgcactctagcctgggcaacagagcgagacccatctcaaaaataaaaaaaatgaaaaacttccaacagtactttccgt

SEQ ID NO: 607701 - DNA, 370 bp, Homo sapiens
  misc_feature (47)..(47): n is a, c, g, or t
  misc_feature (105)..(105): n is a, c, g, or t
  misc_feature (115)..(115): n is a, c, g, or t
  misc_feature (120)..(120): n is a, c, g, or t
  misc_feature (135)..(135): n is a, c, g, or t
  misc_feature (265)..(265): n is a, c, g, or t
  misc_feature (268)..(268): n is a, c, g, or t
  misc_feature (317)..(317): n is a, c, g, or t
  misc_feature (327)..(327): n is a, c, g, or t
  misc_feature (363)..(364): n is a, c, g, or t
tcccggtgacaccgcagtgggtgtgtgaggggaggacggaaagaccnagacgtgggcggatcaggaggagggtgaggaggcaccatgcgtgagatcgtgcaaatncaggggggcnagtgnggcaaccagatgggngccaagttttgggaggtcatcagtgatgagcatgggattgaccccattggaagttaccatggagaaagtgatttgaagttggagagaattaatgtttattacaatgaagttactggtaacaaatatgttnctngggccatcctcgtggatttggagccaggcacgatggatttggttaggtntggactattnggccagatttttagaccagacaattttgtgtttggnnagagtg

SEQ ID NO: 607702 - DNA, 1046 bp, Homo sapiens
  misc_feature (133)..(133): n is a, c, g, or t
  misc_feature (357)..(357): n is a, c, g, or t
  misc_feature (412)..(412): n is a, c, g, or t
  misc_feature (428)..(428): n is a, c, g, or t
  misc_feature (433)..(433): n is a, c, g, or t
  misc_feature (470)..(470): n is a, c, g, or t
gctctggcggacaagctctgccttgaggtccggcctcgggctcctcccatgccggcgttccgcaatcgaggttcagagattcaatctctctatccgatctcaattccctctgttcccctcaaattccacgtgntctcgcaacaacccacatcgtgatcgagccctagcgtcttggtgcgacgtgagcgctgggcccgagcgcggtaggtaccagacgctgctaggcatgatcgtgcgaggctcgcatcgcctcacagtgcatacaagacgcgtggcggcgcatagacgtaggcgcgcgccactaagcgtagcgtccactcaccatggatcgtcgcatcgccatggaatgtatgcgtnacgcgagatcgtatatggcactgagcgttgtactggctgtggggtagcattgtcncctcgggatcgcaatngcgancccggtatcgaccgtagagcgcgggctagccagcganggcctcgtgcgcaagaggcgcgatgcgagcgcaaacgaggggatgcatcgcaagcgccggttgcgagcatccgacgggtgtatgcggtccatcgccgttcaggcgctctcggtccactggcccttgtcccatggcccatggattcaaggcccatgctgacggcgcccctgcaatgcgtggaccctcaacagctcgcaggagaagctgctccgtggacgcgtgaacccgggctggggggacccggtttgtggtgggccagagttgtggttgggcttgacccttggtgggctagtcgctcgggcctcgagtgctccttgtagcgtcttctttgatctcttgtggtactcgaactgggttgcgccgaagtgtgtgatggaggcttcccatggccaggtccacctttggcaagagtatcgtgaggaagcaggggaggttaggaagcttgaagacttacttggtggaaccccgcgtggggggaaactgctcgtgggcctagctctcctgggcgccctggccgttaagcaggcccttgttcctgaactggtgcttgcgaaggcgccagatcttgtgcgccag

SEQ ID NO: 607703 - DNA, 638 bp, Homo sapiens
ggagccatttgagccatggggaacgctcacggactgtgtggtaatgagagatccacaacacaagcgctccagggcttgggttgtcacatatgccactgtggaggaggtggatgcagctatgaatgcaaggccaacaaggtggatgtaagagtgtggaaccaaagagagctgtctccagagaagattctccaagaccaggtgcccactcaactgtgaaacagatcttctgtgtggtggcattaccagcagacactgaagaacatcacctaagagatcatttctgacaacagtctggacacatcccaagtgattgaaatcactgactgaccgacgcagtggccacaacaaggggctttgcctttgtaaccttcgacgaccatgactccgtggatacgattgtcattcagaactaccatactgtgcatggcacaactgtgaagctcagaaaagccctgtacaaagcaagagatggctacgcgcttcatccagccaaagaggtcgaagtggtctctggccactctggtggtggtcgccggaggtggacaccgctgggaaccgaccaaccacggcgccggcacaggaaacacaccgcggacgtcggacggcccacggggccgccccgccccggcgcaggacca

SEQ ID NO: 607704 - DNA, 271 bp, Homo sapiens
catactgggatgccatgtaacgcatatggatagataacctataaggaaatgatcttctagaatcattaagcaggaaagaaagcatgaatgtagcgctatataaaaccacccttatctcccatgcaagagtttatcatactgcgcattgggcacaggatgcagacggttacttgcagattttctctcgaggagtctgcccagcaaaagcattcctggccattaactcaaaagtggctctgtaagttgcatagcactgcacaggaggttcacc

SEQ ID NO: 607705 - DNA, 275 bp, Homo sapiens
tcgtgccgctttattcatgccctctcagtcattgaatccatcattgtgctggccatggcctttgagcgttatgtggccatatgccacccactgtgccatgctgaagtgctcaacagtacagtaacagcccatattggcatcgtagctggggtacggggatccctctttttttccccactggctctgctgataaagacgctgggcttatgccactcctatgtgctctcgcactcctattcgctccaccaggatgtagcgaacttgtcctatgcgga

SEQ ID NO: 607706 - DNA, 100 bp, Homo sapiens
gcactgacggggtggaacctgtttttgttggcctcatctgcaagctcttgtccccatactcactgtagcccatgccttgcagtgaatgtacttgaatgtg

SEQ ID NO: 607707 - DNA, 312 bp, Homo sapiens
ctcgttactcccagattcggtacacacgaaggtgtacgcggcgaggttcagactggaggagctcagtgatggccggcattcacaagaaggtggcccggaacatcggcatttctagtgagatccgaggaggcggaacaagtccacggtagtctctgcatggctcaacgtgcacgtcggctgatacatgagtaccgcgtccataactcatcctcattccccaggtaagccctcgtgcccccaatcaagggagacagattctgctgagatgaacttgaatactggcccacccagctgaccggcaccggtcatgcc

SEQ ID NO: 607708 - DNA, 211 bp, Homo sapiens
aatagcgtgatgatcctctgacttctccttggtggatgctaactcgcgactcctgtgttaagcttgtgatccggtaactgctacgactacggcttcgagatcgagatcttccataacttggacttctgggcccatcaactttaacccggatgtaggcagtttctccctcatgagatctaaacttagtgttatccagttttcgaactgcata

SEQ ID NO: 607709 - DNA, 109 bp, Homo sapiens
tacgcatcgtgtgatgagcatgggtacacacacacccacatgcacacacagtgcaggtacacacacacccacatgcatgtgtgtgcatgtgggtgtctgtatgtgtgta

SEQ ID NO: 607710 - DNA, 948 bp, Homo sapiens
  misc_feature (663)..(663): n is a, c, g, or t
taaaaagggggcacccatgggggcccccccgggggaaaaaaactcccctcccaaaaaaaaaaaacagaagaagtcaagaagattctaacagaaaatgatagacgtgtgtggggaggcaccgtggcgccgtggtaaccccccggggtaacagagggggcgagtaggtcaaggaggggtaatcatgggccccacaacgagctaagcggatcgtgccgggtacaacactggacgccacaacggtgcttccccaagagcgtggtgagacagacgacagcaccccgtggttgcaagacaaaacgtgacacgaacagatttcgcggcacacaatgtgtggtggcccacaccccaggaggtaaaaacagcgaggagagaatatcccgcgggggaagaacaacacaacgagagtgaataaacaagcaacagagagcgcccagccgtccagaaaaaggaggtaagccgagaatccaggggcgaagaaagcagacactttctcacaaaataggagggagagacgccccaccattatgtagggtatataacccgaggagggaagcattcttatcacagaaagaacgaatcaagcaaaatggaaaagaaagtggacggaggcatctgacgcagagaaaatgctatgacacacgcatatgaagcgcgcggccacancggagtaaatgagaaaggcaataaaggtgatcataaaagcacagatgaatcaaaaagaggtgtagacacacgaaaaaaaagcgcggcgaccagggtgctcgaacaccacaagagagtgagcaagcgtgacaccaggaaggacgaagcgatcaatatacaccgacggaggtatacaggagaacgaacgacgaacggtcagacgcatgacatcagcagagccacaatgatgggtatagaaaacacgaatggatcagacggaacagatcgatctacggaagccaatca

SEQ ID NO: 607711 - DNA, 223 bp, Homo sapiens
  misc_feature (55)..(55): n is a, c, g, or t
  misc_feature (109)..(109): n is a, c, g, or t
  misc_feature (135)..(135): n is a, c, g, or t
  misc_feature (154)..(154): n is a, c, g, or t
  misc_feature (211)..(211): n is a, c, g, or t
gggcaacatagtgagaccccatctataaaaaaaaatcttaaaaattagccggccncggtggtgcgtgtctgtagtcccaactacttaggaggctgaaatgggaggatcncttgagcctggaagtttgaggctgcnccaagccatgattctgccnctgtactccatcctggtgacagagcaagaccttgtctcaaaaaaataataataaaancaaagtttgcca

SEQ ID NO: 607712 - DNA, 946 bp, Homo sapiens
  misc_feature (160)..(160): n is a, c, g, or t
  misc_feature (169)..(170): n is a, c, g, or t
  misc_feature (173)..(173): n is a, c, g, or t
  misc_feature (179)..(179): n is a, c, g, or t
  misc_feature (182)..(182): n is a, c, g, or t
  misc_feature (185)..(185): n is a, c, g, or t
  misc_feature (211)..(211): n is a, c, g, or t
  misc_feature (215)..(216): n is a, c, g, or t
  misc_feature (245)..(245): n is a, c, g, or t
  misc_feature (265)..(266): n is a, c, g, or t
  misc_feature (283)..(283): n is a, c, g, or t
  misc_feature (285)..(285): n is a, c, g, or t
  misc_feature (291)..(291): n is a, c, g, or t
  misc_feature (293)..(293): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (319)..(319): n is a, c, g, or t
  misc_feature (331)..(331): n is a, c, g, or t
  misc_feature (339)..(340): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (358)..(359): n is a, c, g, or t
  misc_feature (372)..(373): n is a, c, g, or t
  misc_feature (376)..(376): n is a, c, g, or t
  misc_feature (508)..(508): n is a, c, g, or t
  misc_feature (534)..(534): n is a, c, g, or t
  misc_feature (548)..(549): n is a, c, g, or t
  misc_feature (572)..(572): n is a, c, g, or t
  misc_feature (599)..(599): n is a, c, g, or t
  misc_feature (601)..(601): n is a, c, g, or t
  misc_feature (611)..(611): n is a, c, g, or t
  misc_feature (617)..(617): n is a, c, g, or t
  misc_feature (619)..(620): n is a, c, g, or t
  misc_feature (636)..(636): n is a, c, g, or t
gctgcggcgggagatgctgtcgggccgcggcggcgcttggcagccaggagctctgcattgaaggcactggggtgaggcttactgccggcaggctggatggcgtacaagtgaatgccgaagacagaagatttggatgatacaccactgactttctttgttnggaatacanngtnatgaanccnttnctggagcatgtctacaagctctgtangcannacgatctgaaggtgaagagaagacattancaggggacgtgaaaaccagnnctccacgaactgcaccnangaaacngntgccttctattcccananantgcttngcccataagctnagcctacnntctncntgncccagcagnnacagtcaacaaannggnacgcatgcgtcctatggacccttctacctggaatactctcttcttgcagaatttaccttggttgtgaagcagaagctaccaggcgtctatgtgcagccatcttatcgctctgcattaatgtggttggagtantattcatacggcatggactttaccangatggcgtatttanngttacagttaacatccctgatanctatccagatggtgactgtccacgctngntgtcgatatncctgtntnnacccgtagttgatccnacctcaggtgagctggatgtgagagagcattcacaattagaggcggcaccataatcatatgggcggtataagtgttgcaggagagtgtacagatgatcggcacggccgtagccagagctggagtatgattgaaagattaggtgtaaggaagtgtgaagggtaagtgggggctggtgtgcacttaaaacgaagataaattgcatgagcatgcgaaggaaaagtgtaaagaaaggaagagatgggcacggacgagcgtaacaaggtataatgtacaaagaatggatagtaattgggttttttttttcagaat

SEQ ID NO: 607713 - DNA, 914 bp, Homo sapiens
  misc_feature (128)..(128): n is a, c, g, or t
  misc_feature (137)..(138): n is a, c, g, or t
  misc_feature (141)..(141): n is a, c, g, or t
  misc_feature (147)..(147): n is a, c, g, or t
  misc_feature (150)..(150): n is a, c, g, or t
  misc_feature (153)..(153): n is a, c, g, or t
  misc_feature (179)..(179): n is a, c, g, or t
  misc_feature (183)..(184): n is a, c, g, or t
  misc_feature (213)..(213): n is a, c, g, or t
  misc_feature (233)..(234): n is a, c, g, or t
  misc_feature (251)..(251): n is a, c, g, or t
  misc_feature (253)..(253): n is a, c, g, or t
  misc_feature (259)..(259): n is a, c, g, or t
  misc_feature (261)..(261): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (287)..(287): n is a, c, g, or t
  misc_feature (299)..(299): n is a, c, g, or t
  misc_feature (307)..(308): n is a, c, g, or t
  misc_feature (312)..(312): n is a, c, g, or t
  misc_feature (314)..(314): n is a, c, g, or t
  misc_feature (317)..(317): n is a, c, g, or t
  misc_feature (326)..(327): n is a, c, g, or t
  misc_feature (340)..(341): n is a, c, g, or t
  misc_feature (344)..(344): n is a, c, g, or t
  misc_feature (476)..(476): n is a, c, g, or t
  misc_feature (502)..(502): n is a, c, g, or t
  misc_feature (516)..(517): n is a, c, g, or t
  misc_feature (540)..(540): n is a, c, g, or t
  misc_feature (567)..(567): n is a, c, g, or t
  misc_feature (569)..(569): n is a, c, g, or t
  misc_feature (579)..(579): n is a, c, g, or t
  misc_feature (585)..(585): n is a, c, g, or t
  misc_feature (587)..(588): n is a, c, g, or t
  misc_feature (604)..(604): n is a, c, g, or t
gctgcggcgggagatgctgtcgggccgcggcggcgcttggcagccaggagctctgcattgaaggcactggggtaagtgaatgccgaagacagaagatttggatgatacaccactgactttctttgttnggaatacanngtnatgaanccnttnctggagcatgtctacaagctctgtangcannacgatctgaaggtgaagagaagacattancaggggacgtgaaaaccagnnctccacgaactgcaccnangaaacngntgccttctattcccananantgcttngcccataagctnagcctacnntctncntgncccagcagnnacagtcaacaaannggnacgcatgcgtcctatggacccttctacctggaatactctcttcttgcagaatttaccttggttgtgaagcagaagctaccaggcgtctatgtgcagccatcttatcgctctgcattaatgtggttggagtantattcatacggcatggactttaccangatggcgtatttanngttacagttaacatccctgatanctatccagatggtgactgtccacgctngntgtcgatatncctgtntnnacccgtagttgatccnacctcaggtgagctggatgtgagagagcattcacaattagaggcggcaccataatcatatgggcggtataagtgttgcaggagagtgtacagatgatcggcacggccgtagccagagctggagtatgattgaaagattaggtgtaaggaagtgtgaagggtaagtgggggctggtgtgcacttaaaacgaagataaattgcatgagcatgcgaaggaaaagtgtaaagaaaggaagagatgggcacggacgagcgtaacaaggtataatgtacaaagaatggatagtaattgggttttttttttcagaat

SEQ ID NO: 607714 - DNA, 738 bp, Homo sapiens
agcgggattttttaccttataaaagagataactgttgctgcaaaggtagagatattggatatggattgagggggaacaaaactaaaaatgggaagtagcaggtgttgaaataatcttgacaagaaatgacaagagcatgaactaagcacctgggaagggtttcatgcttctttttatcagactctgaagtacctgtactttggtcagatccctcgaagcctaatgagcctgtggaggagctgagatactgggtcgagataaatggaaatattttcagactacgagttccagtcagagtaaatgctgaaaacgaacaagagtcttcaaattgacaatcttcagggtgagaaagaatatacttgaagggtgagatttcatttctactactccttagatttgcttcattttctctgacattttctcacagtctacagtgacatctggttgctgcagtggtaacaatggttcctgaactgatcagttaaattgagcaagccaggcattgctttcattcactttcaagtaacccagctggagtccggcggacctcatgagatcgctgctattacaattattattactgttactttatgttaaaagtcctatctttcaaatgctatgctatagaaaacacaaactgagtgtcatctggaccagaataacgtagaaggctttatttaattgattcatttattacatctaaacagtggctaagcatttacattttctggcatacag

SEQ ID NO: 607715 - DNA, 315 bp, Homo sapiens
tgaagtcttcaagtcatgtacagctgcggaggatctgggttctgctaccgaggtcgcccctaccgaaattttcacatgcaggttaggtagtgaaggacctgtgggtatgttcgatactgtatgcgtatatagtaaggctgcatagggtcgtcgcgtcgtgcgtcgtctgtcacgcgagaaactacgggcaggtcaatatcaatggttaaaagtaagagacagctgaaccctcgtggagccattcatacaggtccctaattgaggaacaagtgattatgctaccttagcacggttagggtaccgcggacgttaaac

SEQ ID NO: 607716 - DNA, 1166 bp, Homo sapiens
  misc_feature (856)..(856): n is a, c, g, or t
  misc_feature (922)..(922): n is a, c, g, or t
ctccgtctctcttctcagtagagcgacgaagctgcatcgacgggggacacgaagcggagcaggaggcgtacatcagtgtcgcgctgtcgtgcacttcatctcgacagggtccggagacccgtcggtgcatgcccccagagtgtcgcggatcccgatggaggacccactctgtttgtgaatccccgccccctaggcagtgataaaatgtgtgtaaacgcaatgtggtaaacccttatcgccgggttctccgctccagattgtcgccatggggaacgctggttaatgtgaggagccatgggctgcccccccccgggaaatccggcccagtgggaaccaagggacaggctgcccaccagccgcacacattgttgggaacgtaaaattttcgggagaagaaggaaagatctttacccgcaggactgttagacgccccgtgggaaatgtgtcacccgccagagagtgttggatggtacccgggctgcctggctgtaaagtgtgccccactgggaaaaggggtaaagccctttcaaacggtcacgggacccgcagccccgatgtaccgctgttaactttctttaagaatggtgcctaaagaccaccacgggtggttcccccggggtgaccttctgtgccccgcgttaaggagtgttttaaacttttacaagggggcccagggcactatactgggggaaagtaagttttccccaaccggcctctaatcacacttgggtggaacaaaagtggctccctctgttaagcctcttttgggttcttgagtgatattgacacgcacttccttcttccaccgcctcacgagaatgtttctggtgttggggaccacagcgcacttggtggncttcaccgccctcgtagtgccccacacacttaagggaggctcgaggcgggcggattcaccctcgangatcacggagtttcacagaaccacaccctcggcccaacactggcgaatttcccctgtgttctactaaaaataccacaaaaatgtgtggggtgttggttggcacggaagcctcgttattcctagctactccggaggctgagggccggagaaattccttgagccccggaggcggagattcccatgacaccgagatcgtggtccctgcactcccccctgggggaaccagagtgagactccctttccc

SEQ ID NO: 607717 - DNA, 157 bp, Homo sapiens
tagaggatcccgggcgacattctctcctcctttcattacagattcgtctaaagtatgcaatacattgatagcatgctaccacagcagaatttctcgcaaaataggattcagttctctcaaaccttactgctgctttatcactaagtttatgtaatac

SEQ ID NO: 607718 - DNA, 600 bp, Homo sapiens
gttgccagctctgaatccatgaacaaaatctggccgactaggaatcactaactgatcgccattttccagtttaagtgcaggcaatttatcaaaattctcatcatttgccgccaaaccgaacgaaatacgacccgtcgctttcaactcacgcatttttgccagcacgtgagcacttgcttcctgttccgccttcagttttaacgcaattacctgtgcatctactgcaccggattgattggctgcggctttagcattttctgtacgactttgcgattccagtctgcgtactgctttctccaggttgagctgctgcttctggcgggccttctcacgataaaactcagtaccaaacaaataagcattcgaagttgtgccgcccgctttcgcgattagagactgtatcgtttctcctggccccatctgatacacaccgggaacattcacctctcactcaacgcgcgcaaaaaccttacgtttcgcaactggcacctgaatatcgttttgagaaaaaaccgtcacggcatcacctgcctgcaaacgcagattatcttcgctttcgggattatccattgcccgaccaagattaagcggcaacggggt

SEQ ID NO: 607719 - DNA, 389 bp, Homo sapiens
ccctaataaacccgtccccggggatgtggggataaaatgccggagcctggctcgctagggcatccaggttcttccttcctttttgccctgctgtttccaggccccaagaatttcccacagttccccaaaaatgaaccccccattatttcaggtccctttgtttcccccgatctttaccaaattcctgactcagagttcctcccctttgcttttgactctccttttatttttacctctccttttatttttatgatgtttacccttttttttttccccagggtccccctttgagtggtaaaagtatgttaataaaccagttcttagaccggagccccaggcaactgctcaatgttggtcattgtccctgttttttaatgtaacttaaggga

SEQ ID NO: 607720 - DNA, 291 bp, Homo sapiens
ggtatcccgtggtcgatcactgtactccagcctggggatcgagcaagacttgtctacaaaacaaaaaagaaaagaacaacagaagaaaacacaagattaatagtaatttaatatattttttttttctatattaaaatgatccagccatggtagggcacaaaaaccaatttagagaccctccagagaatggaagtaaaaaccaaaaacatgccaccattcagagcgacagttaacactttctttggtatttccagggtggtgagacggaaaccagtccagtgatcgaccaag

SEQ ID NO: 607721 - DNA, 573 bp, Homo sapiens
  misc_feature (35)..(35): n is a, c, g, or t
  misc_feature (46)..(46): n is a, c, g, or t
  misc_feature (60)..(61): n is a, c, g, or t
  misc_feature (69)..(69): n is a, c, g, or t
  misc_feature (74)..(74): n is a, c, g, or t
  misc_feature (88)..(88): n is a, c, g, or t
  misc_feature (101)..(101): n is a, c, g, or t
  misc_feature (112)..(113): n is a, c, g, or t
  misc_feature (115)..(115): n is a, c, g, or t
  misc_feature (143)..(143): n is a, c, g, or t
  misc_feature (146)..(146): n is a, c, g, or t
  misc_feature (148)..(148): n is a, c, g, or t
  misc_feature (162)..(162): n is a, c, g, or t
  misc_feature (207)..(207): n is a, c, g, or t
  misc_feature (216)..(216): n is a, c, g, or t
aaagcagcctaggatgagcattctttgaaagcaantaggttattcncctggtattatttnnctgttaanaaatntgtgacttcatgangttgatttttaanggcagcatcannanctgaaaaggaagggaaaaaataggcagnttntntgcacttgtttggngctccccaaaacaggagccatggagaagtggcatcaagaccgggntgccctttngagaacaccctgtggcagttcaaagacacgttttttttacattggatgcagccccttttttcagcattggaaaaaagtggttttgagcccagttgaaaagcacttcccactccttttttttgttttgaaaggggtttgggtcagtttgcagctgggtatggtattatgttttataatccggcatcccttttatcctatccagtcatatttaatgtagaaaattagtttccagtgaaagtaatatgtaggggttttatgaaatttgggggcaaaatccccttttccattgaggatatttgatgtaaaggaaaaaaaaaactcagttccccaataaaatacaaaagtggcgaaagttta

SEQ ID NO: 607722 - DNA, 318 bp, Homo sapiens
ggtcagaggcgcccgtcttctcgtcctcgatgctgatgccttgggctgctccaggtcactcaggatctgctccaccagctctgtacacgtggtccgacaagtgacgatgggagatgccctgccacctcgtcttaattggggtgctgtgtcgtgcggcggtacagaacggtccatgtgaggtggtccgcggcatcctgcttgttctctctggtcttggtgacgatctcggcattgaagtgctcatgcatacggtggtcccggtgtgattctactggcaatgggtcatataagtacttcttgaagaactccttcttggcg

SEQ ID NO: 607723 - DNA, 342 bp, Homo sapiens
  misc_feature (246)..(246): n is a, c, g, or t
aggtttttttggccctttggggatttcccccccccccacccaaaaacatttcagcctggggtccccagtttttgcctttttcccgatgccccgaccaagccctttggcctgtccctttttccccggccccccctttccaagggcaggaaggggccgtttccttaagcccctcttttttggggctgttttaagggatggggagcccccccccccttttccctcaacaaccccccccccctgttctgntggatggtccggggtttggggccccctttttttttttttttttttgcccctgtttaaaaaaaataaaattttcccccccctttttggtttggtcca

SEQ ID NO: 607724 - DNA, 141 bp, Homo sapiens
gcacagtcatcatcccacccaaaaaaccacgcgtgagagcttcgttttctatttatttacattattggctttcttttgtgagcggcctttgtagcctcgtcaggaagttggaaagccacgttaaggggacttaaggcctct

SEQ ID NO: 607725 - DNA, 353 bp, Homo sapiens
atgtgctcgcagtcaggctttatatctcccttatcaccattttcgtgttatagttgggagtctaagagctcttgccatgcatagataatgtcctcagacctctaaaccaccagcaccagctctgtgcctgttatatggcaggctttcgatgaacgcttgctgaactggatctgggggtttgatcgagagaagagcttaaagatgctctcccctccccgttgacattatttgcctgacattctttgcccacacagtgtggccttatgacaacacttggcaggagagtgatggcttgggatgaaggaggagtaagctgtcttgtccggtgttgtctctgcccattccacctggct

SEQ ID NO: 607726 - DNA, 203 bp, Homo sapiens
  misc_feature (26)..(26): n is a, c, g, or t
  misc_feature (53)..(53): n is a, c, g, or t
  misc_feature (59)..(59): n is a, c, g, or t
  misc_feature (75)..(75): n is a, c, g, or t
  misc_feature (87)..(88): n is a, c, g, or t
ggttgccttacatctcttatatagangacctagcagccccgacaggatatgcntataanctttgagctcttgaancctgagaagcannagagatagcgtctctggtacagatggcaggctatgtggtctaccattgcgtcatagatcgacatactcaatctcgtacaagtcgctctgcgtgtactatgttaaggttcattttg

SEQ ID NO: 607727 - DNA, 867 bp, Homo sapiens
  misc_feature (67)..(67): n is a, c, g, or t
ggcgccaggcgcacgctgtgggccgcgcagacccgtcgtctgggttgcgccagcctactaagccagngcggccacgtcgcgggcctgcacgggcggtaagaacaccgctcaacggtggccgcccaacggtcggggggttccaagcgcgcgcggtgggttctccggccaggccggaaagttgggcaggagcgaagccgccgccgggggcgggccccccgggggacccttccttcggtgccccaagggctctccttcggggcaaggaaattcccgggattggcacccaaagggaagtgtggacgggcaagggttcccctacggggcggcggagcaccggagggggaagaaccccggggaccaaccgcagggggctcccgggcactcccgagaagggtcaggagggataccatcccgagggggggagatattaccccaccagaaagaaccaaaaatcaccgggaaagtacaccccccgggggggtggggggcggtgacaccatcgggcaggattccggagggcccccccgagaaaagggggaaccccccaagggggtaacaaaggggctccccataccacgtacatttgccgaggacaggaaggggaacccggcaaagaaacgaccgccctcgggaaaaactccacggggcgagctgcgagagggacaccaggcatgatccccccgcgcagcgggagacaaaccaccaaaccacggaggacaccttcacgcagggaagagagcccatctccaccagaggcagaggggaggagggccccacttaccacacggcgaccgcaggagacgaagagacacccgcctggtgatggagaacacaccgggacccttaattgggggcaccaccaacaag

SEQ ID NO: 607728 - DNA, 126 bp, Homo sapiens
ctgtcccttaggatgtcgcgggctgcacgctgcgctaccacatgacgtggactcagcagtggtgccattcgcctatcgactgcgcccgagtgacgcgataaaccttgcttaaatcccctagttgcg

SEQ ID NO: 607729 - DNA, 134 bp, Homo sapiens
tcagataatgtagttggtcagattacatgagtctggagccaggaggtgatgatgaggggaggatgcatggggctgtgggaaggagagagaagagtggggtcgaggtaggagctgtggagtagtcggggggtgta

SEQ ID NO: 607730 - DNA, 232 bp, Homo sapiens
tgtcgcccaggctggagtgcagtggtgtgatctcggctcactgcaagctctacctcccaggtcacaccattctcctgcctcagccttctgagtagctgggaccacaggcgcctgccaaccacgcacgggctaaatcttctttaataagtttttatttagtagagcgggtttcatcgtgttagccaggagatctagaccatcctggctaacacgatgaaaccccgtctctact

SEQ ID NO: 607731 - DNA, 384 bp, Homo sapiens
tcaatattggggcggcatgggcttcatgtgggacacccggtggcccgcgcctatcgcgacgtgcgcctggtgtcgattggcggcggtgccgatgaaatcatgctgggcatcatctgcaaactgatgggcaccctgcccggtaaaaagccatgaacaccttgctgctagaagcccacaacggcgtgctgcatatcaccctcaaccggcccgaatgccgcaatgcaatgagccttgaaatggtcaatgagctgcgtgcggtactggcgcagttggacagccaggtgcgcgccgtggtgatcagcggcgcgggcgggcatttttgcgcgggggccgatgtgaaggatctggtcggcgcgggggatcaactgcaagcgttgaaccgcg

SEQ ID NO: 607732 - DNA, 1144 bp, Homo sapiens
cttctcattaatcaatatcgacatcggaaccactgattaccgtacttcatttgcgagtgccttcgagcatggaagctcctacggcagcatgattcttatatcccgtccattataccagatgcctaagtgtgcggctcatgctcacggtcaaactcgtgtactacgatagaaccgagcctagcaattctaaacattagtgtgtactgtctagtagccacattgcgattgcgttcatcaaatctttctgtacaattaagtcaactaatgcacagtctatcatgtacagtagtgcttcgggccaatctgtacttacattccactctatataattcgagttgctcctccaagatgatgagacgattatccctggtagatataacaattagtaagacttcatgcactgctgtacctaccctcgtgctcctatacctggcgtcgcgatgcttctagtaggtgcgagcgaccgtgacacacggaacagggttgtgatgatttcataccactacccctatgaactatggatgctttagtttcgcccacgcctgggaaagcgcatcgcagttcaggatcctttatgccttgtcttgttcgtaccttctgacgggcctaggcggagttggtctcctcctcatgccttgatgcggtgtcgcgagtgccaacttatcaattcatccgatcacagtctagtcataattgatgaaatccccccctgaccaataccccgcgggtttcactgaaccggtcgcccgtcgtatcgatctggatcaggtgccttatttcgcgtgccgtgcctatcttactcctgtctcgtacccagtcctcatctgctggtatctatctatgcatagtatactagacctgctccctcaagatcatgcttcttcggagcaccgcgctggagtcggaggacccctctttgatagctaatgctgtcctctgatgttcacggtcacctgagttgtattctagatacttccgggtctgatgttcctcctgtgtgttcttgttgtcccggaaagtatggccgttggaatcccggttgtccgggggggctccggggtgccagggggggcgtggggccccgttttcgggagagagggggcaggttttgccccgaagggtccccacggggtatttacaccct

SEQ ID NO: 607733 - DNA, 143 bp, Homo sapiens
gttatgcaccattccgatgtgcctcctgagtagatagtgggggagtaagagcagcagcagagaactcattctcaaacatctactatctatcaggcgctcgatggcccggctctggcctttgttggctattctaccttctagga

SEQ ID NO: 607734 - DNA, 134 bp, Homo sapiens
tgagtgaacatcagacgagagcagagctctcacttggatattctgattcagtaggtgtgagttggagccaggaatctctatgaactcattccaagtgatcctttggtttatgttcccctcaggcaatcaagctt

SEQ ID NO: 607735 - DNA, 113 bp, Homo sapiens
atataaaaaagatccgcataataaaccaaatcagaaaataataccttgtaatacctctgtaagaagcagaatacaccatatgttattcacatgtataggagtgataagaaaat

SEQ ID NO: 607736 - DNA, 398 bp, Homo sapiens
  misc_feature (22)..(22): n is a, c, g, or t
attcccttcgggggactggtanagcatctatgaatgctttggccaccttcctcacgcatcgcggtcaaattaatccgcaaacacttcacctgaagaaggagcagcgatcagctcgtcgatgtaccagagaagatgttgtgatgctgtgctaaggcgtttgttgcgggtattaggactaacggcaagttttgcgactttattgctggtgggctgtggccggctcagttcttcaatcagactggtcaagtcagcctcagtaaattgtttcccagagcgaatacggtcgtaaatattcatacggcgcttgcgcgcccatcggtgaatgaccagcacttcgccgctattgcgcatcagagtttgaagtgcaaggtgacgacgacgaaggaaccagtcgacgc

SEQ ID NO: 607737 - DNA, 404 bp, Homo sapiens
ttagtagagacgaggtttcaccgtgttagccaggatggtctcgatctcctgacctcgtgatctgcccgcctcagcctcccaaagtgctgggattacaggcgtgacaccgtgcctggcctctagtttttattttttagacagagtctcactctattgcccaggctggagtgcagaggcatggtcacggctcatgcagcctggacctttggaatccagcgacgctcctacctcagagaccctcagcctctcaagtacctgggattacaggcgtgagacacagtgcctggccgaaccttagtttttaaaatataaatttaattcaaaatacaggctgggcgtggtggcttacgcctgtaatcccagcactttgggaggccgaggcaggcggaccacttgaggtcagg

SEQ ID NO: 607738 - DNA, 400 bp, Homo sapiens
cacgagggcgaagtagttggtgcgatcgtgcgcggtggtgccgttgaactgcatcccccggctggccatctgccggccgatggcgccatcgggaacgctcggcgttcccttgaacagcagatgctcgagcaggtgcgccatgccggtctcgccatagctttcgtgccggctaccgaccaggtaggtgatattgatcgtggtggtcggctgcgccgcatccggggcgagcagcacgcgcagtccgttgggcagccggtattccgtgatgccctcggcgctggcaaccggtgtgggcaagcccggcaccgcctcgccggccgatgtggccgcagtggtcgatggcgcaggagtttccatcgacgagcgcgcggcatggaccggaccagcgctgcacaacgcg

SEQ ID NO: 607739 - DNA, 275 bp, Homo sapiens
aaaaaaattcccccttaatttttgaatttttttttcccaatttttttaaagaaaaccagaacttttcttttttttaaaaataactttaatttttttccccccttttttttttttaaatttaaaatgggttttttgaattttaatttttccggaaaaggttttttgggttttaattttttttaaacccctccaatggttttccccttaaatttacaccccctttggggttgggttggtttaccccccccctaaagggaaaaagggaagggggggga

SEQ ID NO: 607740 - DNA, 947 bp, Homo sapiens
  misc_feature (298)..(298): n is a, c, g, or t
  misc_feature (301)..(301): n is a, c, g, or t
  misc_feature (316)..(316): n is a, c, g, or t
  misc_feature (322)..(322): n is a, c, g, or t
  misc_feature (338)..(338): n is a, c, g, or t
  misc_feature (358)..(358): n is a, c, g, or t
  misc_feature (392)..(392): n is a, c, g, or t
  misc_feature (404)..(404): n is a, c, g, or t
  misc_feature (421)..(421): n is a, c, g, or t
  misc_feature (436)..(436): n is a, c, g, or t
ggcgcctccagtcccgttccggagtctcgggcccgctgcggtgccgtcgctggatagctgggagtcaagtgactgcagacgctttgaatggcacgcgattggcaatgaatctactctttggcaagatgtatatcctgcgggatgcagaggccccatactgggttgagtgattgcctattgaagatccctgctgctgccattgaggcatgctgcaggacgtgtggagaagcccgatctgagtctgtgtacttgcgaggactttgtcgttacagacgggaccaggcagctggctagtgangcntgtttcactgctcgnagtgangaaactcactggtganaagccctttgctgccaaggnggaccagctgctctgtacagactgctattccaangagtactcatcnaagtgccaggaatgcangaagaccatcatgcnaggtacccgcaagatggagtacaagggcagcagctggcatgagacctgcttcatctgccagcgatgccagcagaccaattggaaccaagagtttcatccctcgaaagacaatcagaatttctgtgtgccctgctatgagaaacaacatgccatgcagtgcagttcagtgcaataaagcccatcacctcggggagcgggtcacttaccgggagcaagccctggacacaaaggagtgcttcgtgttgcacacgctgacaggaacgccagctgtctgggcaagcgcttcacagactcgcgatgactttagcctacgtgactgaattgttatctgtgaacttgtattgccaagcaagttgtgctgagtgcaccaaccccatcagcggacttgctggccccaacaattacattcttccttgaagaacgcgccgttgccatttaaggactgccttaactgttcagaagtgctccctctcatgatgaagcgtgacatcctccacacagatgtaccact

SEQ ID NO: 607741 - DNA, 418 bp, Homo sapiens
tgtagtagctccctaaaataataccctatcatctgctcctaatccctccaatctctctccactgagtggctggaatgcttttttttttttctttcacttatataagggataatttttcttttttttttttttttgagacggagtctcactcttccgcccaggtggaggttgcagtgagccgagatcgcaccactgcactccagcctgggcaacagagtgaggctctgtctcaaaaaacaaaacaaaacaaaacaaaacaaattagctgggcatggtggcacccagctatagtcccagctacttggggagctgtggcagaaggatcgcttgaatctgggagggtgaggctgcaatgagctaaggttgtccccctgtactccagcctgggtgacaaagtgagaccctgtctcaaaaaaaa

SEQ ID NO: 607742 - DNA, 187 bp, Homo sapiens
tgcatcctaccgcgggtgccctggtgatgacgtaatgcttcccatctgtgtacatgccactttgaatcttgatcgtgacaagaaataccttaggccttcagtcaattccgaagctccttcaggtgttgttataatgggcgttgtaccgtgcacatatgtgaatgacgagtatactacccatacagac

SEQ ID NO: 607743 - DNA, 291 bp, Homo sapiens
tattacttctgcacaacgagcccattcacttgtgcggccagagaggggcaggtgctgtgcgacggctgacggccgcaccaccctaggccctgtgtctggcaccagccccgcctccggcgccggccccgcagccagctctggccgtgcgacaatagagtccggaagtccaggcaaagcggctcccgggagcgccgcgcggtcctgctgcgggatcagcgaggcccgcgccccggcgggcgggcggcatgggtgcagtgctggctgaaaaaataatcgcggggttggcggccg

SEQ ID NO: 607744 - DNA, 336 bp, Homo sapiens
tagctgggattgcagtcgtcaacaccacgcccggctggatttgtaatttttttgtggagacggggtttcatcacgttagccaggctggtctcgaactcctgacctcaggtaatccacccacctcggcctcccaaagtgctgggattacaggcatgagccactgcacctggcctctctacggtaaatattgaaagttgctgcgacacagggtatgcacatttaaatttttgttttctttttaaagggacagagtcttgctctgttgcccaggctggagtacagtgacgcaatcttggctcaatgcaacctccgcctgccggattctggctcaatgca

SEQ ID NO: 607745 - DNA, 345 bp, Homo sapiens
gtcgactggaccgtctccccggagaacgcgcctgacaagccgcagtacctggaactgacctaccgcaacggcgatatcgtcgcgctggacggcgtcgaaatgaccccggccaccgtgctggcgaccctgaaccgtatcggtggcgaacacggtatcggtcgtctggacatcgtcgagaaccgttatgtgggcatgaagtcccgcggctgctacgaaaccccgggcggcaccatcatgctgcgcgcgcaccgggcaatcgagtcgatcaccctggaccgcgaagtcgctcacctgaaagacgagctgatgcccaagtacgccagcctgatctacaccgggtcgacg

SEQ ID NO: 607746 - DNA, 652 bp, Homo sapiens
  misc_feature (89)..(89): n is a, c, g, or t
  misc_feature (92)..(92): n is a, c, g, or t
  misc_feature (95)..(95): n is a, c, g, or t
  misc_feature (110)..(110): n is a, c, g, or t
  misc_feature (119)..(119): n is a, c, g, or t
  misc_feature (132)..(132): n is a, c, g, or t
  misc_feature (620)..(620): n is a, c, g, or t
tgtgtacagcaaaataaaattgcatactctggttagacaaataaaaaaattccacagtaataattttagtgttcatataattgcataanatnttntagtttcaaaacatnccatgtttntaatgtaaatgantaaaatgacagcatttactatttcaagcatatgggaattaaatttgtagcataaaccaagggctgacaaactatggtctcttggtcaaatctggtcagccacttgtttatttaaagaataattgatataggaattttacaccacaaaattatacaattaaaccatttaatgtgcattattcattggcgtttagcacatttgccagtaccactactatctagatccaaagtaattttttcacttcaaaagggagctttatacccattagacagtcatgtcacattctcccattctccatgccttgcaacctggcattatgtgttggcatcgttctatagcctattgggtaatgcttttaaaaaaatccaaataggtatataacttcaacaaagtgttttattttttcttacttctaacatgtcctatttgtttctaaatagtaattctatgatgtataaaattaaacttttgtttctaattgctctgtnattaaacatattcagaggtgttgtgatttaaa

SEQ ID NO: 607747 - DNA, 587 bp, Homo sapiens
agcggaggcagctggggtaaggagttcaatggcagcgcccacacccgggggctctccgcaaccgaccgctgtccgctcccccacttcacgaccaggtcatagcaaagcaattgagtgagtacacagtggagacaaaaagggatcggctggaggtgaagaaaaagagagatcagagagccgagagaccgcgagatatagtaggcatgcaaaaaacccaaaccagaatagttgcaacaggagaagcaagcaaatgcgtagcagaaaggaaacaccatacaacaaggtacacaaacataaaaccaacaagtgaaaagtacgcaaccaagcaaatgcagatggaaccaatgaagcaagtcgaggaactagaaagaataaagggacagcccagaaccatacacaaacagagcaaggagggcaaggcataggagaaagcaatacaaagcgaaacaaaacagaagaagtggtgaaccacagcaaaggagcgcgacacggaaaagcgcgaacaagaaaagaaagagcatagctcaagaagtcgaagagacacaagacaaagggacacaaaacaaacatagaggagacaacaaaag

SEQ ID NO: 607748 - DNA, 221 bp, Homo sapiens
cgtaatcgaggaaacacacagctcacctagatttcatggctaacgtaatgaagagtttgaataagaaaaaggacagatccattaatgaggtaacaacttattgcctttctgctgggacagaacagggccaggtcgcatacaatgaacgagaaagacagacagagacagagacagagacagagaccgagagaaagtgacctagtgaattggcccttatcgag

SEQ ID NO: 607749 - DNA, 478 bp, Homo sapiens
  misc_feature (41)..(41): n is a, c, g, or t
  misc_feature (91)..(91): n is a, c, g, or t
  misc_feature (207)..(207): n is a, c, g, or t
  misc_feature (240)..(240): n is a, c, g, or t
  misc_feature (252)..(252): n is a, c, g, or t
  misc_feature (270)..(270): n is a, c, g, or t
  misc_feature (295)..(295): n is a, c, g, or t
  misc_feature (337)..(337): n is a, c, g, or t
  misc_feature (371)..(372): n is a, c, g, or t
  misc_feature (379)..(379): n is a, c, g, or t
ccacccaaaaaaaaagaccaatttattataatacccccccnccacaaaccctgggggtgttcccccatgaagtgaagcgcgaacaagggangccgccaatagggagcccaggcccccaagcgccggtccgtccttcagccacaacggaagccgcagcgggcaccgaaaatgttctgcaactacctttttcacatctgcctttgtagntgctgaacaaaattcgttcccatttgtttccgnttggcaagttcntaggcttcggcggaagtntaaagtcaagggcaagtggcggagnctgcggccaccccggtctctgagcggcgcaccggacaggtgntcagtcccgggacgcggtgacccgacgcccgagnnccaaggntcggcccacgccgggttcgccccagtcccgctggtccctcagcagacgccgccgggctttgcaccgcccgccgaccccggacccccacccacgcggccg

SEQ ID NO: 607750 - DNA, 110 bp, Homo sapiens
gagaagcctaggactgctacgggagaagcacacctaggcttctctccctgtgccctgtgtcgacctggatcctccagtaaagtgaaattcagcactgtaaaaaaaaaaaa

SEQ ID NO: 607751 - DNA, 909 bp, Homo sapiens
ggtcatcggtcggttcccgtgaaaacaaaaacaatcggccgtgccgtcgcaggcaccctgaacgtcgctgatgcggggcctggggacgcggtggcctgagtgcagcgagcgaacgggagcagcggctgacttcgccagtggtgtgctagtgtgctgctcatgtgtgtgcatggtgctgtgtgctcctgtgcttgctgctggtggctccccctggctgcctgctggctagtgctgccctgcctgcctcggcctgcctcagcctcccgctgcctgccctgcttggggaacgaggagcatggacgcggcctctggctgtgtggccctgggccgaacggctgctggacacctgtggctgccgaggagccgatgcgcctgcactgcctcctggcatggatcagtgcgtgacggtggagcggcgatgcttggaggaacggtgctgcacaagttctcagggctacgggcagctgtgcgagcgcggcctggaggagctcatcgactacaccggctggtctcaatgcacgagatcctgcagagccacgggcaagatgctgaattatcagggacactttcacttgttttgacacagtgctgtaaacagaataaaggatactgttcacacaattggcctccgaccacaaaagacattcacagcagtgtttctcgggttggaaaagccattgaataggattcactttaagagattggaaactcttcccttggaattgctcttcccatcagagattcaatatatcactgtcgtggaacagcctgcctcagactgggcaagaagctgtctgtcatctgaattggacgtcaggatctatccaagcaggcctggaaggacacttaacccaaagggaaggtcttctgcactcaggtgctctccatcagatgttccttccagaaaca

SEQ ID NO: 607752 - DNA, 1606 bp, Homo sapiens
  misc_feature (215)..(215): n is a, c, g, or t
aatgtatgtctacaaggacggcatacattcaccgcttatcgataaacagagctttattcgaccatttacgatgatacgatggccgctcataaatacatttcactccttatactagctttcactaagctacctagatatagcacacttatacgcgtaacacactaccacaacaaacagagctaaacttaaactattagagaacattcttcgagacnacgtgctgcaagcgctacaatatgagctataaacgcgatctctgccaaccgtcatatccttgactcacggtcgcactaccatacacgtgagtatactctatcattagcggcacgctacgcacaaatgcgccctaacagggccagatacagcatttgtaaccaaggtaacacccgaggcaaccttgcactgatgctacgcaaaaacgtaggtcaccgcgttacccaccttgattaccgtcgagatacatagaggacttcgcaacctaggtaagagagccaccaccctcacagagaatgggggataaagccgtttgataggcacccccaatgctaccgatggaaacaatacaacccaaaaccccaggagcatacgtaaagacgcgagggccaaggtggccgacactactagcatttccgtagttcctacaacaatctttccctgcgcgtgagacccacaattatacaccttattaccacttccgactagcctgtatgggtacaatctgcactacggttcaacagcataaactccgcaggagcggctctcaagacgccttgtgggctgccgtctaacgcactgattcacaccatttttctgcccgattccttggatctacgtggtaaatccaagtatggctattcgcggcacagcgcagtttactgagctgattaagtgcccattcatactcccgtccaacggctcactgcttaacaccacggtcgaccccgcgcgccgtaacaagcaatatgcggccgctaacagacggttactgacaacgttcataacacctcgtattacacgcaaaaatatccacaaccccccgcacacaccgggccaccttcgtgcgcacccttactaggcatgcacaccgcacatctcacaagacttgaccacaccagcggcagccaaggacgagcgacacccactccaaccaggacgcacgggacgacactcaatcaacggacaggcacacccgcgcgtcatcaagaaagagacacaacagcactgcacagcaagaacacatctgacctacaacgccaacacagatgcaccccacaactatggcgagtcagagacgacggacacatcagcctacagacacacagcaggccaacacaacagtggaccgcaccgccacgcagacaaagacgtcgtcagtcagacagacaccggcgctccaggcacacactaaagtacgcaatgcaagcccgacagagtactacatgccagcaagtgaggaggaagaccgtagctgatacatcacataatatacggcgacattacaaacagccagcggccggccgtctcacactacacgacaacatgaacaggctacgtcaacatccagacggacccacaagacactccgtgcaccatcatggagggacag

SEQ ID NO: 607753 - DNA, 289 bp, Homo sapiens
aacatgtgaacggtacttgggagagatgagtgcagagaggaggcgcaggtgacgaacccaaatgacaggcggtagaagtcagcaaaaaccaggaaacgtatcagctggacgtaagtcgaggccaatccaccgctgcttacaccatgatccatctaggacatatccctcagcgatgatatatcccagaaaggagatcgtagagcggtggcacttacacttctcggctaccacgacagttagtactcgcggaggtgctgaagggactgtctgacatgacgaacgtgtcctt

SEQ ID NO: 607754 - DNA, 233 bp, Homo sapiens
cttgggttgaccaggctgaggcccgcaggtctaagaccaaggaagcatgcaagcgcggtgaagagcgcctccaggccaggaaggaggagatcatcaagaactttatccaagtgaggaagagaccaagaaaataaaacctcccactttgtgtctgtacatacggtgcctcggttgataacatagattcagcctttaaaattaaaacaaggcctaatctggcgggggtaccggag

SEQ ID NO: 607755 - DNA, 81 bp, Homo sapiens
accgcggacacggctgtatattactgtgcgagaggccgcgtgggtccctattattattacataaatgtctggggcacaggg

SEQ ID NO: 607756 - DNA, 1421 bp, Homo sapiens
tatttaacaaaaaaggtgttttggggctctcccctcccaccgggggggggggagggcccccccatctcggggggggggtggtgaaaccctcttctctcctcatgggggggagaataaaaaaaaaaaagggtgggtgtcttcttttaaaaaaaaacacctcgcggcagcgggggaggggtgtctggggaccacagagagagaaagcgcctatagcgcgcgcgggagaaacaacaacacccgcgcgcgcgggtaacacaagagagagaaacacacccccaccctaatttataaaattataaaaaagaaagaaaaaaaaaaggcgggggggggggtggtgctccacccgcggtgacaccaccacacaacacatgatgtgggaagagcgccgagagggagggtggggagaggccggccgagccccccgagagagatgtggaggacacaccgcacagcgcggtggcgacacacacagcgagcgtggagaaaacacgcgcgtgagtcttccacctatataccaacacaaacaaaaaatatctcgcgcgcgcgcggggtgggcgagacgcgcgtgagagacaacgtgtggagtagaccccaccgcataaccgccggaggcgaggcgagtggagcgcggcacacaacaacagaggggggaagcgacaccgcgcgcgagagagaggagtaacgagcggagtgtgtacacacaacacatagcagacgcagcacaacaagagagacgcactctcccacaacgagcgcggcgggtgagcggcaacaaccacgacgacacccaaacagcgaggtgttgtcgtctcctaccaacaaacaaaacaaacaccagacaaaacaaaaacaacaacaaacacacacacaaacaaagacagaacaaacacaaaacaaaagacaaaaacaccccccctctcctccacacacaaaccaagcagctgcggagccaaaccaacaacactctcaccgacagccgtacacacgtcatcgacacaaccccacacacacaccagccgtcggggggcgggtacaccgagagaaggagcgaccccacaaccccccctcgtcgacgtacagcacacaaccaaaagcaccacttagatcaggtgtgagacatacaaagcataagtaggaaagtcacagaaagggaagcgaacaacaatcacagccacgaagggaggcgcccaggcaacgcatataaaacaatgacaaacaccaaccgctggtcgggcagacccacaccacgagtgaggtaggacaaccaccccacggcgctacatcacaaaaacacaaacgagagagacgacgtcaccccgcacgtattaaatttccccacacgcccacaacctaccaaatggggagacagaattgagcccccccacacgaaaaacacaaactgatataaaacccccccggat

SEQ ID NO: 607757 - DNA, 980 bp, Homo sapiens
  misc_feature (110)..(110): n is a, c, g, or t
  misc_feature (135)..(135): n is a, c, g, or t
  misc_feature (138)..(138): n is a, c, g, or t
  misc_feature (155)..(155): n is a, c, g, or t
  misc_feature (167)..(167): n is a, c, g, or t
  misc_feature (196)..(196): n is a, c, g, or t
  misc_feature (223)..(223): n is a, c, g, or t
  misc_feature (235)..(235): n is a, c, g, or t
  misc_feature (237)..(237): n is a, c, g, or t
  misc_feature (244)..(244): n is a, c, g, or t
  misc_feature (252)..(252): n is a, c, g, or t
  misc_feature (393)..(393): n is a, c, g, or t
  misc_feature (441)..(441): n is a, c, g, or t
  misc_feature (492)..(492): n is a, c, g, or t
  misc_feature (498)..(498): n is a, c, g, or t
  misc_feature (527)..(527): n is a, c, g, or t
  misc_feature (547)..(547): n is a, c, g, or t
  misc_feature (571)..(571): n is a, c, g, or t
  misc_feature (573)..(573): n is a, c, g, or t
  misc_feature (654)..(654): n is a, c, g, or t
  misc_feature (689)..(689): n is a, c, g, or t
  misc_feature (697)..(697): n is a, c, g, or t
aagaattgagaacttgtggctgggcgtcgtggctcacgcctgtgatcccagcactttatgaggccaaggtgggcggaccacctgaggtcaggagttttagaccagcctgnccagcatggagaaacccagtctctnctnaaaatacaaaaaaattngccgggcatggnggtgcatgcctgtggtctcagctactcangaggctgaggcgggagaaacacttgancctgggaggcanangttgcantggggcangatgtgcgattgcactccagtctgggcaacaagagcaaaactctgtctcaaaaaaaaaaaagtttgttagattatttgtgaacttaattttattttatttttaccatggtaagactaccgtgcgtttaatgaaccattatngtgccactaactgtatcccactttactcaagggtgtaggtacaatatngtaggaatatactatttcatacattgtaaaataacatctttagtaatcacngtcagnggctttaaactgcaaatgagttaaatatngttcccatagattaaatttngactctttattatttaaattttantngtatcggggtatataatatgtgtatatatttatgccttatatggcatctttgactcaggcctacaatatgtagtaattacnttatggtaaataaggtatccatcacctctagcatntatctttngtattaccaatagtgtaattatatgctttattcattttaaaatgtacaattaaattgttattgactacagaattatgtctatgatcatattatttatcagagtgtaaataaatacggccaggccacgtgaaaaaaaaaaaaaaaaaaggggggggtaaagatcctggggggcaagttgggttacacgttttgaagggccaaggggggataaaggaggaggcgggatacagcggggaaggctggatggaggattttggggaatggaacccggtatagaggaaag

SEQ ID NO: 607758 - DNA, 626 bp, Homo sapiens
  misc_feature (21)..(21): n is a, c, g, or t
  misc_feature (508)..(508): n is a, c, g, or t
  misc_feature (586)..(586): n is a, c, g, or t
ggcggagccaggccggcctanagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcaccagtaccggcaccggcaccagtacccgcaccagtaccggcaccggcaccgagcgcaaggcggagggcccgcccgaagccgggggcacaactgcccaggtcccgaacccggactccagcttggacgacacctcctacagcctgtccgaatggagcgtccgttctgagtggcggtccgtctcggatccgctagccagttcccagtggagcacgtcctcaactgccgaggncgcctcctggagctccagcatacactccccaatcagcactaccggtcttagcgagagtactgacttccgacttcaaanagtgggcttccggggttttaagcggctttacaaaccccga

SEQ ID NO: 607759 - DNA, 963 bp, Homo sapiens
tggaaggcagaggagggagtttcggcttagtcttttctggcaagaacctgctgatcccacaactgtgcctggcccaccctgggggaacccaagaggctccaggccctgttgctgaggccagtataggggtggggtggaggctggcctggtcagacgtgcaaacaggatttcccccaaacagggaggctctcttgagccttgaaaccatccccgtttcctgaacagtattattcgtggtttttgtcttaaacattcatctcctttgccaggcctgtccattttccacacctgagtctgaacaggctaatgatgaggccccagctttcactgtgcagtcttctgcagggattgtgtgtgtgtctcagatagagctctccactttgggatttttttttttggtagagtctcatccagtaacaaagagaaaaatggagctacacccggggtgtcctgagatgggtgggccccacggggggttccattctctgagacgtgtgatggacgccctgtggtccctcactctctttatctcctctggccttccacggcagattagctcacgccactaatgtgggaacaccagttcccgcaccagttccgtatagaagatcattatactagctattgactcgacctgcacctggagaaacagccccctagaaacctcgcatccaatagcccacggggcacatgtaggcgaggggccgcgagaatgccgcaacccccacgagggacaaggggagtgcaggcaggtccccgtggaggaccccatacgggaacctgccccgaagggggggagggcaggcaaacgccaggggagcagataactaccggacgcaagtggccgaagcaagagtgacgaaaggacaaagggccccagcgaccgggcgacagaaggacacacaggcagggagaggacagacggaagaaaaaaggagtagaagaagagaacgacggtcaaac

SEQ ID NO: 607760 - DNA, 115 bp, Homo sapiens
ttggcctgaggacatagaaatgcttctctggctcctctgctggttgttataatccctgggaaacattggaaccaagaggacactcgagaaatactggattggggaaaagatctgg

SEQ ID NO: 607761 - DNA, 112 bp, Homo sapiens
ctcgtagttcccaacgcctaggttatcccctgccagtgtttgcttaactgcggtctccccaattcatctaagcccctgattattatgcatccggaaggatggctatacccaa

SEQ ID NO: 607762 - DNA, 1006 bp, Homo sapiens
gaagaaacagcccactggaagcctccaccttggaatgatgtggaccctccaaaggacacaacttgtgaagaacattaccctgaactttgggccccaacacccagcagcgcatggtgtcctgcgactagtgatggaattgagtggggagatggtgcggaagtgtgatcctcacatcgggcatccatgcacctgaggcacatgagaagctcattgaatacaaagacctatcttcaggaccttccataactttagaccggaatagacatatgtgatccatagatgtgtaacgaacaggacctattcatctagactgtggcagaaattgctacaacatccaggacatcactcctcagggcacagatggatccgagatgctgatatggagcaaatcacacagtaagtagaaccaagatcatggactgtgacacacacatgccctgagaccttggggaccatgaacccttacttctggcatgtatagaagaaagggagaagatgtttgagttctacgagacgagtgtctgagagaccagaatgcaatgctgattatatcacgagacaggaggagatgaaacaggaacataccacttggagattatggatgaaatatatcaaaatataagaatttatatctacgagatgaatgacattggaccgaagtggcagaccaaacaatacgaatctggccgaaaccgcaccagtgacataggagatgcaccagcagaaaaaccactaaaatctggatacacacccaatgaaacacacaggacacacgaaaccagagagaaacagaggaaagacacaacctaaaaccacacaacaaaaaaatagaagaccagaagaaaaacaagagaacagaataaaaaaccatcaagacgaaaataccacccgaaatttacaaattacacaaaacaataaacaaaataaaaaacaaataacaacaaaaaaacacacaaacaacccatttactcaaactacaaacatatataaaaaaaatactaaaaac

SEQ ID NO: 607763 - DNA, 273 bp, Homo sapiens
ggccggctgaggcaagatcagctctcaaatcaaacacttagcaggctgtggatgccaaggaaaagttcttgaaggaaattaaaagtgccactctataaacagatgaatggtaagaaagtgaaacaaccgtattgctgatatgaagaaagttttagtggcctggacagaagatcaaactagccacagtgacagatccttaagccaaagcctaacccagagcaaggccctaactctcttcaattctatgaaggctgacagaggcaagaaagctgc

SEQ ID NO: 607764 - DNA, 956 bp, Homo sapiens
  misc_feature (619)..(619): n is a, c, g, or t
gcaaacatttggaatattattctcaagctcacgtcttaataatacatcttattattctgcattagtagagaaactactcaatcatcctcttcaacattgatatacatgtttaataaggcctcttgcgaagatcacctgttctcgtcacctgaggtatttgtttgtcctcgcccaccattgcccctgttgcgctcccttccttcttcgtccctttgccagaggaaatatgaatacagtatttagggtccaactctcaataatgtaataattaatacattaagagcatttagcttcctttctagaaaaatgcactaggctaaggctgtagacgaaacaaagagaaattgctagagtaaatctggcactgggatgacacgcaatctgcaacagtaaatatttgccagaagttcttcgaatgtcatatagtgtcaggatttgaacgagctatttgtgtttaaatgttgcaactagcaagtcatcttcggacagacacagccaggagagatgaagtaacagtgaaaggtttataagtccatttgtacagcatttatcccatatattttagaccttcaaggaaatacttgtgtcgcatctttacagtctcggtatgccctacttntaatgtactattgtcgagtcatgctatctggcataaaattaggcaagccaaagtatgtactcctgtagacctgcgagtcacaccatatcatattacatatgttatctatgttcaccaaagactgggattgggccgaagtaatctcctcgaattggggtccgcgcctctaggcccgagaaaaaggtctttctgaaccccaggcgatggcccgcggggccccttgtgttagttaccacgggggccctagcggtgaggccctagcaacacacgccgatatgggcacttgcttggttttccaacaatacatggcccgggggaaaccagggtttggccacaa

SEQ ID NO: 607765 - DNA, 202 bp, Homo sapiens
gtcggtccaccacgtcatcggagaaggcctagaaaaggcaaagagattaaacaacaactacaaaaacaaagaaaagcagatgatgtctctaggtcctgttgcctggccctgatattcatttagaagatcaagaaaagtggccagaaaatggctctctaaattataacaccatcttgcaattggatccttctccggtggcgtg

SEQ ID NO: 607766 - DNA, 277 bp, Homo sapiens
  misc_feature (37)..(38): n is a, c, g, or t
gtacatttaacatggtgactatagttagtaatactgnnttgtttacttgaaatttgatgagagcagattttaagtgtcctcaccaccctcacacatatacacacacacacagtaactatgggtagtgacggttgtgttaattatttcgactttggaattcagtacacaatgtctatttataacaaatgatcatatataccttgaatatatataatttgtatttgtcaactaaatattctaaaatttaaaaatatgccttttctatttacccacattt

SEQ ID NO: 607767 - DNA, 311 bp, Homo sapiens
aagtggttcgtagttacatggaggatggacttatcccttgggagaagagtgaagttggtttgttcgccatgtgatgaagaccactgtgagttggtaaaaaagtagatgagtactgtaaaatggcgtaagtaattctgcacttgaagtggtactgttaacagcacatttggaagattttaaaactttttattgtcttataaatagcattcacttattattttggatatttaagggttccattaagttaacactgtatttggacaaagtgtgaccaaattagccagtctgttttcttccatgtttaattagaa

SEQ ID NO: 607768 - DNA, 145 bp, Homo sapiens
  misc_feature (45)..(45): n is a, c, g, or t
gcttgttcctatgatgtgacccctcgataactccggtcggatggntgggcatagggtacggcggaatgcatcaacactcgtaaagtcttggcctcccagtgcgcctttggtttcccagagatcttctaactaattctcaatatgt

SEQ ID NO: 607769 - DNA, 284 bp, Homo sapiens
ggaaaacctaacaaacagaaaggaatagcacatccacgtcaaagaccccatccgaagtcaccaacatcaaatacagaaggtagacacatccacaaagatggggagaaaccagcgcaaaaaggcctgaaaattccaaaagccagaatgcctgttgtcctccaaaggatcacagctccttgccagcaagggaacaaacctggatggagaatgagtttgacgaattgacagaagtaggcttcagaaggtgggtaataacaaactcctccaaactaaaggagcatggt

SEQ ID NO: 607770 - DNA, 195 bp, Homo sapiens
caaaaaaaaaaaaaaaaaaaaaaaattttttatgcctttcatgttcctggtgcccctctatccaaccatgtaaccatttccatcctcctaaaagcttttgcaattttcgcattgggtgggaggggttttcaaaaagtagtcatatctttaaaggggtttacccagcccaaagtaagggctttggggccaaattca

SEQ ID NO: 607771 - DNA, 776 bp, Homo sapiens
gtgcagacggcaggttcaaacctaagcaggcgggaaggaaccatggccaagtgtgagcgtaccttcatgcgatcaaatcagatggggtccagcggggtctagtgggaggagattatcaagcgtatggagcagaaaggattccgcctggtcggtctgagaattcatgtgaagcttccgcagagatcttctcaaggaatcactacgttgaccctgataggaccgtccattcttgtgcgcggcgctggttgaaatacatgcgactcagggtccaggtaggttcgccaatggtctggggacgcggtggctgaatcgtgtgtagaaggacggcgccgacgtcagtgctcgagtggagatcacaacctctgcaagactcctagaggcttggtgaccagtccgtggtagacgttctgcaatacatagcttcggcaaggtaaccattaatagcatgggcagatgattgctgtggcgagagtgctgagcacacgcgagatcgggcgtatgtaggtgtgcgacccatgacgcgacacaggtggcatctcactgctgagctgtgcctcgagcaacgggcatctatgaatgaccagcggagggcagaccagatagctttacacatccatgtccgctccttcccaggggcagaggaccaggctgtcaggacagtctagttatttagcaggaacttcatgcataattcggagggaagctcttggagctgtgaggttctccctgtacagtgttaccatccccgaaccatctgatttgagatgctttccttc

SEQ ID NO: 607772 - DNA, 432 bp, Homo sapiens
  misc_feature (221)..(221): n is a, c, g, or t
gacctggctgcctgagaatccctgttcggcgagtccagtgtcgctgcgctggacgcctggccgacctgctgcaagcggtggccgatgaaagtgggcaagtctcggatcgcctggccttgcgccattttgcccatgtggacgatgtcagccagcaaacggtgtctgtgtgatgagtgcccgctaccagattttccacgatacccattatcactacgacagcncggtgtccctggcccagacgtggcgcacctgtggccgcggccttcgcctggcagcgtgcagctcgcagcaactggagatcagccccgagccgacctcgcgccgggatgaactggatgtgttcggcaacccgatcacccggctggcattcgagcggccccatgatgaactgctggtgaacgccgggctgacagtggaggtgttgcgcggccc

SEQ ID NO: 607773 - DNA, 139 bp, Homo sapiens
gtgactgatagcaggtcatggccgggctcagtcgtcctgctgggccagcacagactcggctcctgctccaggctgccccagtcttcgtcgtcccatctgtcagcagtgctgctgtcctctgctgtgtccttgtcctcct

SEQ ID NO: 607774 - DNA, 440 bp, Homo sapiens
tcaactcatcatctctgcttgtcaacattcccatatattctttaagcccccgtttgcatgctacctcctccttgaaatttcttctactaaagagcagctagctctttttttctctagcttctgcttgttacttatagatcttacgcattgtgaaggaaatagtcactactaaatgaaattgagattggtgaagcagtgccatctaaaaaactttccttgtcagtccccaaggggtcaggtcataagagagtggctcacacctttgcgccagaatgacaaaatcagtttattaggctgaaccatttgatatcatcatcgactcaccaaaagtggcaatttcatatggtttgacataatgcaattgtaactgtcacaaggacaagatgatcagtgcattatctattcaggtcgacgcggccgcgaatttagtagtagtaggc

SEQ ID NO: 607775 - DNA, 161 bp, Homo sapiens
tgccgttgcgccgccctttactcgggtcagcgctgggctcggggcggctgtggttctctggtggtctggactttgaggcggcggtcgggctcgcctggggatctcctccgccccgtacccgccacgttccggcgtccatgtgcctctggaggccgggggcc

SEQ ID NO: 607776 - DNA, 3276 bp, Homo sapiens
ctggacttccccacatctcccctgcccctcccacgtttccatagtccaagggccagagtaaatgaaaatacagcagccgcccaagcaatggggcccatgctggggcttcagtcatcagcatcttcactggagtctgagttagctggcatcataggatcatcaatgagtgagaagtccctttctgagctatcatagaaatgagataagtcatcatcatcttcttcatcctcatcgtcatcctcctcaggttgcagtggtggcaaccgcaaggtagtaccagaggcggtagtcactggtgaagaggggtagccaggggctctcaagcctggatggtgatggtggtgatggtgggggtgggggtggtggtggtggtgatgaagcatggtgctggagtctacatgaggggatgatcggtgcaccacccatcacaaatgcataaaaggcaaagatgcagaagtggcactgctgtgacccaaagatgacacagactgtaggccactactgctgtgttggaacgtgttatgcagagatagagacccagtgcttccaccctgcatgaggccatcatcttagaaggtctggtcgcatctacgggcccgcttcttgctgctctctggcgcaataggccctggcaaaacccggttgaacaccgtttcagtgtgatgaccctttttcccgtttctagagttagctgtctgtactggttccattcccaaacagttcaattctgccttattattttttttttacatctttgccacttctgttttatgcgatcctccatatacgctagaaatcggggatcaacagaaactgtggatgaccctgtaagcacatctccagttcagcccggcgaggggcatcctcacccaccagcaaagtaccatccaccttattgatgacagggatccgggtctccaggtccacatcaaggtgattaggctcttccatgcactccacctccagctctactagcttctttctgttccccttcttcttatgaaacagtggatgtccatctcccattactccattcgccatcaacttgtgcttctggaatgttaacttcaatccttcctcatctttgatttgaactgtaaactccttttcatccatgcctcggcgaagtttggtgaactgggctgccgctgtgctgactgcagatgcttcctcctctgccatggaagctggactccttcgtggcgtggggactggagagtccccatcttctcctggggtcaaagagggactgtctaataaatggttgcctggggccaaaattcctcctgttaccatttcctggctcctacggctagaaggccacttccctgagagtacagcctggcagacgaggtcaatacggtttatcaggacacgatccttggccctgcagaacgtggggaccggcgaaggcgcgttgtgaagcagccttcaagctgaaagaaattgcacggcgggagaaacaacaacgatggacaaggcgtgaacaaactgatttttatcgagtggtgtctacgtttggtgtggaatatgaccctgacaccatgcagttccattgggatcgcttccgcacttttgctcgactagacaaaaagacagatgaaagccttaccaagtacttccatggctttgtggccatgtgccgccaagtatgccgccttcccccagcagctggagatgaaccccccgaccctaacctgttcattgagcccatcactgaggagagagcctcacggactctctaccgtatagaattgcttcggcgcttacgggaacaagttttatgccacccccttttggaagatcggctggcattgtgtcagcctcctggtcctgaattgcccaaatggtgggagcctgttcggcatgatggggagcttctaagaggggcagcccgccatggggcagcccgccatggggtgagccaaacagactgcaacatcatgcaggacccagacttctctttttctggctgcccgtatgaattatatgcagaaccatcaagcaggagcaccagctccatccttgtcacgctgctctactccactgctgcaccagcagtatacctcacgcactgcctcaccactgcccctgcgcccagatgctcctgttgaaaagtcacccgaggagacagctacccaggtccccagtctggagagtctgactttaaagctagagcacgaggtggtggccaggagccgaccaaccccacaagactatgagatgcgagtatccccctctgatactacccctctggtttcccggagtgttccaccagtcaaactggaggatcaggatgattccggactctgagctggacttgagcaagctgtcaccatcttcttcttcttcctcatcctcatccagctccagctccagcactgatgagagtgaggatgagaaggaagagaagctaactgaccagtcccgctcaaagctctatgatgaagagagtctcctgtccctcactatgtcccaagatggattcccaaatgaagatggagaacaaatgacccctgagcttctgctactgcagctgcagcctctatcttcatttgttctctcttgtagctgcgctgatacgctgttactagacgccgaagcctagctgttagggcagagcgaggccagaataaatggcctggctgttgggtcacctgggcttcatctccatcaatcactgagatctcctcatccatcatcatcaagggatcaccctcatcatcttggtcctttgggggaccttggagtggtttatatcaggatcttcacaatctttatcaagtcaacccttctactatgtcagagaagttatccaacactcgatgttctgctgcaattgctttgtcatctggtcggccagccttttctaggaaacataaggctgggtctgccctcatggtattatatttctcatagccatgtttaaagactccaatgagcagcgacttgtcagcctcatctgtcccaccaagttgttggaacctccagttgatccactactgggaaccatatgtcaatctcactggcaatcgcaccccctaacaccttttctgcttggtctccataacctcctgcctcaggtagatagcattcgtacccgcaacagtacctggttacactgatgtttcaagtgcttcttataactttcatcttggaacaaagtgtcagggttatatttccggatccaatctgccttatggatatcaaaagtgctttatgactttactttttttcctttgcgtccacgaggcacagggatagatagacctgaat

SEQ ID NO: 607777 - DNA, 181 bp, Homo sapiens
cccccccccccccccagtttttcaacaaacaaaaaggggcctgatttttttgggatttttttttttcaaaaaccacccttaggcaaagggccccggcagtctttgcccccgccttcaggggtattgtgaaagggggactttggggtcctttcaaaaaaaaaaaccccccccttttttttga

SEQ ID NO: 607778 - DNA, 1260 bp, Homo sapiens
  misc_feature (1106)..(1106): n is a, c, g, or t
tggactttggcagagctagctgaggttttatttgggaccaaaaaaaaaaaccaatgtgtgattgtgttttgtgttacctgtggaggcttgtggccagggggggcccccgaggttagttaaactctccccgaggtgtggccttgaggccttagggctgtgaccctctcgagggtgggttcctcctgtgttccccgaggtggtcttcaccctggtatattagcgcggccctctctcttctccacgaggcctctcgtggggcccaggcgccgaggaagaggtgttagggcgtgtggagagagggggtctgtgcgcgcacaggctgtgtctcacattttgggggcccgagagaaggttcagagaggaccctacaaaacacacagttttctccacattcagcgtgtgtctcttgcaactctttttttctcaaaacacacagcggcccgctgtggagggacggcgtggtggcgcgggtgtgaagagagagctgtgagacgccccggcgcgcaaaagccccaaaaacgctgtgagacgccccaaagcgctttgttacgctttaaaggcgcccggggcgctgtgtgtatagaggcggcccccaatatatatgcgccgagagcgctctaaaagacaccaactctgtggctaatataaccccgcgcgtgggtgtggtctccttcgcgatatgtgaaaatataccctcgatgtgttcccgtgacaatctcccccaagaatctctcccagcgcgcggacatttcttcccttcgcccccttcacgagagagttttctcccggttaagggggtggcgacaattcctctcgacagtttcttcccagggggccccccacgcttttggagggcgtttttccatctacaggctttccctgtgggtatccctctccagccgacatgtctttgccacgggtggccacagttgtctccctgtggctttgtgggcccccgctttgtacagggggcgacgaccccatccacaggctctcgggacacaaatctttggaggcttatggaggcactcccccctttaaaagggtggacccaagctactcctccccaacgttatggcaccacaggaaactctgtgcaaaggtgngcggaagcccacaggagggaaaaggccccgtgtggggccctgtagtaagcgcccctctaaaactcctaaggcctagggaaagccacggcgtgtaaaatgttcccgcacggatcacatcatcaaggaagagttttctacaggcttatatgtagcg

SEQ ID NO: 607779 - DNA, 112 bp, Homo sapiens
gcatttatgtgtgggttacttctctccaacaggcatcaattccttggtctacactttacttcaccttacgcatgcatagtgtggactacctctctgggcacacattatggag

SEQ ID NO: 607780 - DNA, 333 bp, Homo sapiens
tgagctggcctgggggcgctcaccatgtagatgagtatactggagaccctgttccaggctcagagatttgccagagcccagtgggcagagtggagatggtggggacaaactggatgggtccctcaggcagattcaggcagctcaacgaggaactggagaaaggcatgggaatctaggtcggttttctccagagcgcatctggccggagggtaggctcctggttgaacagcgcaggcagtggcaggcagggcagcggtggagcagtcgctcacgtggtcccactaggagactgccagtcaccacaggtgtcctgggctcccagggtaccgagct

SEQ ID NO: 607781 - DNA, 102 bp, Homo sapiens
gtctcatatgatatggtgacacccagaagcagctgctctccgggagcttgaagaagaaactggctacaagtgggacattgccgaatgttctccagcggtctg

SEQ ID NO: 607782 - DNA, 257 bp, Homo sapiens
cgcctccctcctgggttttgggagcctcaggtgttccttgggttttaaatgcatcattccagtcctccattttcacatggcattccctctgtgtgtttccccagtgttttccctctgtgcagatctatttttgtgtccaagtttcctctttttataaggaaaccagtcataatgggcccccctgaatgacctccttttaacttgattacctctgtaaaaaatgtatttcccaataaagtggccttatgaggttttga

SEQ ID NO: 607783 - DNA, 107 bp, Homo sapiens
  misc_feature (8)..(8): n is a, c, g, or t
  misc_feature (40)..(40): n is a, c, g, or t
ccaacccnaacatccactgggtttcggaaacccgcccccngatactgggcattttgtagatgtggtttgactatttctgtatgtctccatctattgatgagggtctt

SEQ ID NO: 607784 - DNA, 171 bp, Homo sapiens
ggtacaaatactattctataacagttccagaaaaatcctacaggtgttactgataagtggcaaaagtttcttttgatatatcttgtggttcctcttccaacaatgctctacactggtgtcacatgcaagtggcttcttcgcagcatgatactcctacaaaactcccctgcc

SEQ ID NO: 607785 - DNA, 258 bp, Homo sapiens
  misc_feature (189)..(189): n is a, c, g, or t
tggaaacaaaagttggtatcttctggccagttctggctatttgggtattcctggtaggccattttctcttcaaggaattcagttggagaccctgtagtatcgctcccttctactccatgaccaccattggctaggagtgttggtttagaagatggagtatcttcaatctggctagtttctgagcaccgnttcttctttgactctgagttcccggttttctcatcaaccatccagagaggaatatagtctgtttttcca

SEQ ID NO: 607786 - DNA, 237 bp, Homo sapiens
tctgggtcatggtaccgtacagcgtttatgggcacagcttgaaaggggggttttgtgtccccctggtcgggcagtgttttcaagaccaccttttttccggggccacttgggtatttaattatttatttattgtgggccagtgatggtgggtggggggtgggccttcccggccacctccacccctgttgtgacctgtccttccgtacttaataaagtgcgcgtgggagtgttcaaaaa

SEQ ID NO: 607787 - DNA, 716 bp, Homo sapiens
ttttaaggttaaaattaaatacccactttggattgggtacttaatcgaaaatttcaggtggttagaacgagcaaacttgaacaccgatggggtggcctcagggctttcccttaagagacaagttaactggcggctgggttcatttagggtgtaggctttggtctagaacccttgttggtcgctccaccttgcttaacggcagtgtttttcttgcagtcccacatgtgcgtggagccccatcttctctcccaagttacgaggtgttatgacctccaaattgaaaacagtctagttagcccccgaaaatctcttaaagcgcaaagggttgtgcctcccaatacaaagtcgaaaggtaagctgtggctctgtccaatagttccatgcatcgctttcgccttcaacttggcatatcccagttgaggggtgggtccagtcatcatataatttctgaccttttttaccaaagaataatcagttagaaaatatttgaacaccagggccgttaccctgctgttcgggcatgggaataaacgcttttcatgtattttgggatgttcttttttttctaccatgtcttttttaaggaccttggcctgtatgatgaaataacccgtggagactgtaaattttctgatcaacaatggccatgtccccaccgctcatgttgcagttcaccctatggcaagcgtttcccagcccaccaaaaaaaagcgatt

SEQ ID NO: 607788 - DNA, 245 bp, Homo sapiens
gggtaatgggctttgtaatgtgcggtgatgaggggtacactacagaaacaaactctgcagtctgttcttgaagaacatgctactcagatgtgagacatgctgagtctcagtgcctcgtttcccaacagatgtgactttggttccttctcagaatcaaatcctgcccatgcctataatggagactcctcagcagagctcacagctctgcattgcttgtacgggctagtctggggttgatgatcttt

SEQ ID NO: 607789 - DNA, 479 bp, Homo sapiens
atagatggataggttactaaattagtattctaggccatgttagattgatgagactagggaggaggaatttaaaatgaagagaggtgggcaaataagaaatagattggggataggtatggtgtaattcctgtaatcccagtgatttgggagactaaggaggatcagtggaggccaagagtttaagaccagcctgaaactgggcacagtggctcacgattgtaatcccagcactttgggaggccaaggcgttggatcacctgaggtcaggagttcgagaccagcgtgaacatggtgaaaccccctcccttctaaaaatacaaaatcagctgggcatggtggcgggtacctgtagtccaagctgctcaggaggctgaggcaggagaattgcttgaacccaggaggcggaggttgcagtgagccaagattgcaccactgcactctagcctgagtgacagagtgagactccatctcaaaaaaaa

SEQ ID NO: 607790 - DNA, 107 bp, Homo sapiens
gaagtggctgtcctgagtgctgtacagacacttattttatatgcccctgaaccaccatagggatgctagtctttgtgaccgattgctaatctttctgcactttaatt

SEQ ID NO: 607791 - DNA, 99 bp, Homo sapiens
cgtgtgttgggtcgagagatgtcaggccactgccggcaccataccactctgccacgaaggccaaccagcacagacaaccacacacacaccccagcaaca

SEQ ID NO: 607792 - DNA, 182 bp, Homo sapiens
atcatacctaccgatctctgactctcggtgctatgtgtcctggagctcttggggttctgattgacacgtgggatgaatgcctgatcgaaggaagggtcaggtgatttcaggccggtaggttgagataaagaaaggtcacacagaggttcctcttggccccctgataggtatgatgaaggacg

SEQ ID NO: 607793 - DNA, 127 bp, Homo sapiens
atcactactggaaacatccccatctccacctcactctccaccaggcttttttgcagggtcagagccaagtttagtggaacctatacattaccccagtgaaggactcaatcttaaaggaaaaatcctc

SEQ ID NO: 607794 - DNA, 788 bp, Homo sapiens
  misc_feature (559)..(559): n is a, c, g, or t
ttaactttcagtatgcatccttggccaggacttatacacacaaatgaccaggccaggactctacccaaagaatgggtttgtatttaagggcccaagcagatagaacatcctcagaaaagaagtgtttgaaagatgtatggtgatcttgttaacctccagacgcgggaccacatctagcaaattcaggggaagtttgtctacactcaggctgcagtattttcagcaaacttgattggacaaacgggcctgtgccttatcttttggtggagtgaaaaaattttagtgattgaagccaaatcgtaacttacagcaagcagcatggagcgcgcccccctctttgctgattgcaaataggcaaataagaagtgaatttggaatcagatgtctccattacttccagttaaagtggcatcataggtgtttcctaagttttaagtcttggataaaaactccaccagtgtctaccatctgcaccatgaactctggtagggaagctccacttttgtatattcccgctcttttctggttatatccctgtctgatgcataatgatgccttnttgctaagtaattcatgcattaagattttgccttaatgagacccgatgacgacgaaatagaagtagaggcgatatcttccccgcctattcggcctgtgatgagttgttatcatgaaggacaggtaactttcgggaccctgtgggtagtcggttgttgtatttggcgccgttgtacaccatacaaaactggagcggcgagctcgttgtatgcggggggatactcaagcga

SEQ ID NO: 607795 - DNA, 919 bp, Homo sapiens
gcatactattggtccagagggtatctctgttccctcatacggggttttggtaaccaccccggggttccaaaatatagggctaattgtgtccacagatgtttctcttgctgcgctcccagtgtccctgtcgccgtcggggggtccccacctggcgggtgacaataggcattttttgtcccgcccccccaactcaatttgagggctctgatttatccaccccaaggggttgcccaccaactgtgagtaagccccctgtgggcgccccccacatttgtggttccccctgtgacaggaggtatcacccctttttatcctgcgcttctgcaagaagaatctgcccggcgccccctgacccccgcaaacgatcctccccggtttcctctccactggattacatcccccggcggtagcgtagttgaactaacttttaattagactgggccgccaacctctacttggtacagcattgctgtcattcaatactccgtgacatctattgttcctccccccccttttatgagggagcttcatattctctgacgcggagcagtaacgctacacatatacatgcgatttcttactattttaatccccaggagggtgtgtggaatacatgggccccatggcatagtccccccatcatgagactcctgaacaaaacagcccacggacctcaacttttatggcgtaatttcgggcgcccactatttactccacacacccccgatgtccttgtgcgggaataagaccaaagacaatttccctccaacagtcaacaatccatagaatgtcttttcaccaacaaaggattctccttttctttggcagtaattacaccaagctactacaggattctacaaaacttcttcccctctcttctcacaacaaaaaagctcaccttttcccccccaacataaca

SEQ ID NO: 607796 - DNA, 94 bp, Homo sapiens
tctcttgtcgtggcgaatgtgtgtggagttccgatatcttgcgtatgtaggggttctgcatcgcatgaactagcgtgaacggctagattaactt

SEQ ID NO: 607797 - DNA, 115 bp, Homo sapiens
tcaagcttctaacgatgtacggggacatggagaaacctctgaatccaaagtggggcaagtggatcaaaccctcataccagccgggaaactggtagagtcaaggaaaaaaaaaaaa

SEQ ID NO: 607798 - DNA, 345 bp, Homo sapiens
ctttgtgatgcaagtgcgcatccatctgtaagaggttcatgatgggcgcgtcagtcagccagcatcaccatagggttcatgtagagagtcaaggttgcatggtgtgtcagctctgagggccaatacagatagttcatcctcaatagcagcacgatctactaatgcacacttatgaagattgtaagctcagtctatccacaacatgcccatgccatgttcaatctcactactcggataacagatgagcaacttcactggtgtgtgcatctctgggtgacgcgcccctgcaataagccgaggtacagagtaaaagaaggcctagaaaggataccctctccattgtgt

SEQ ID NO: 607799 - DNA, 521 bp, Homo sapiens
tggtttcgctacatttggctgggcacagtagctgacactgtaatcccagcattttgggaggccaaggtgggtggatcactttagctcaggagtttgggattagcctggcaacacggaaaaatcctattgacacacacacacactagccgagtgtggtggcacatgcctgtagtcacacacacacacacacacaaacacacacactctagccgagtgtggtggcacatgcctgtagtcccagccactcgggaagctgatgtgggaagaccgctggagcccaggagattgaggctgcaatgagccatgatcactcacgccactgcactcccaacctggccaacagaacaagactccatctcaagaaaagaagaaaaaaaaaaagctactactatcatgactttctcatataactctatatggcatatactctctgcgcggcattcagattcatgcatttaaataatactgtctcttaatctagagataaggggtctcatacagtcgctcaggtttatagtaca

SEQ ID NO: 607800 - DNA, 324 bp, Homo sapiens
  misc_feature (65)..(65): n is a, c, g, or t
ttagtagctttcttgcagtatttcttaggttaaatgtagctggccgggtgcggtggctcacaccntgtaatcccggcactttgggaaactgaggtggtcggatcacctgagcgcaggagtttgagaccagcgtggccagcatggtgaaacacattctctactaaaaatacaaaaattagttggccgtgatggcgagtgcctgtaatcccagctactcgggaggctgaggcaagagaattgcttgaacccaggaggtggaggttggagtgagccgagatcgcgccactgcactccagcttggcaacagagtgagaatttgtctca

SEQ ID NO: 607801 - DNA, 662 bp, Homo sapiens
ttctattagactcttagtaagattacacatgcaagcatccccggttccagtgagttcaccctctaaatcaccacgatcaaaacgggacaggcgtcatgctcgcagctaatgcctggctcaaaacagcttagactagacaaaccccacgggaaacccaggtagtgattaaccctttaggcaatcaaacgacaaagtttaagcttaacgcttattacttaaccccccaggggtttggtccaatttcgtgccaagcccaccgcggggtcacaccccggaattcaaccccaaggtcaatttaccgaccgccggggcggtacacaccgaggtcgctctctaggacttcaaccccagtcttttcccaccaatttagaagggcctacaaaagctccacccctgagttgggtacacaaacagccttccagtctgacaccacacggatcaggacgtacgcaaatggtggtttttacaccagtaattcttgaaccagagcaaacagtcttaatgaaccccaaaatcgtgggcaattagatacccccgatctattgcattagcccctaaaaagcttccaaaccggtctaaacattcgctcataaaatcttggctccgcgcagcacccacctcacggagccacaggtttaaaactcctaaggacctggagggga

SEQ ID NO: 607802 - DNA, 1577 bp, Homo sapiens
aatagatgtaaaaaaagtaacgttgagagtagacacatgcgaagacagatattggattctatgtgctgactgagacgtatgtcttccgttactcgtcgtatgtatagtttgcttgatgaggacctactgatgatggtctagtactagtgctgtagctgtgtactatgattgtcggacttctgtaggtgctataatactagtcttgcgggccctgtgttaggtggatgtcgcctcgcctgcgttgttggtggggtgggggccggccctccgcccccggccgcgtgttgtctgcggggggggtggttttctctggctaggccggcgccgcgccattgttggtgtgttggtcgcgcgcgcgttgtggttgagggtggtgggcggtgcgtcgcctttgtgttgtgttgtgggtgtcgtccgcccgcgcgcgtccgctctcgtatgttatgttgtaagtactgccgtcggtgctgctcactgcttgtatgtggtggatgcggtcgtcttgccggtcctgtctcgaacggatgggatgcgctcgcgctgctgggtttgtattgaggggcttcgcgtcttcgtgctcgctctcgatagggtatggtcgggaggggggagtctgacgcacgtatttcccgccgctgtcgtcgggtgagggtgttttgtctttgttcgccgccccccggccgtagttgttgggtagcgtcgccactctgtgttggggggggggttgtttttcggtgtaccgcttgggttggtttcgtcgtggcgttcttcttagttgcagcgtgttaggggggttgttgcgcagtcgcgtttggtggttgttgtccccgctctcgcgtgtgggggggagtgatttctgtcccgtgcctgtgtcgtcccggactggtggcgcagcggtgttgtgtcctggtgttatcgttctgtttgcgcacgtcggtggtgtctcccccgttggtgtggctgcggtcgctgccgcgccccgccgattttgtcttcttgtgtgagaaaggtcgtggtcgtcgagcggactccacttcgtgcttccgatctgtcttttctctcgtggagacgcgcggattttcttctctctctcgctggcgtctccacactctcgctccctcaggggggcgcacacaactctctgggggcgcgcctcacgtctctgggagcccgctcccttctgtgtatgagacgctcctcgcgtgcagcacactccctcgagtgggttgcctctgcgtcccacacaggatggtgccccccccgctggttttcacacatcgcgtggatattttcttgtgttctaattatacgcgctctctagtaattccccccccatgttgtaggcccaccactctcttttaaaagagcttctgttaataccgcccctcccaccctctcactttatacaaatcttttaagaatatatctttttccctctattcttataaatgttccattgtttccatgtgtttctcattgggatttcgcgcccatattcaccacggtgtgtctttggggtatccacaatgaatcaagagtaagatttcccccacccacgaaaacaataaacagaaaag

SEQ ID NO: 607803 - DNA, 151 bp, Homo sapiens
ccaagaacagggcccagcctccagggccccaaattccgccagcctctccccgctttgggtcctgccctttaacactcgactttgctggtcatgggaaaaacaaaattggtcccgcaagccactaattccataaaactgttttgtgagctga

SEQ ID NO: 607804 - DNA, 400 bp, Homo sapiens
tactactactactaaattcgcggccgcgtcgacataaatagtcaaggcaagtgtagatgcattatggtattcataaaatattctgctctgggccaggtgcagtggctcacgcctgtaatcccagcaccttgggaggccgaggcaggtggatcacgaggtcaggagattgagaccagcctggctaacatggtgaaatcccatctgtactaaaaaatacaaaaaattagccaggcatggtggcaggcgcctgtagtccagctacttgggaggctgaggcaggcgaatggcatgaacccaggaggtggagcttgcagtgagccaagatcatgccactgcactccagcctgggtgacagagtgagactctgtctcaaaaaagaaaaaaagtcgacgcggccgcg

SEQ ID NO: 607805 - DNA, 108 bp, Homo sapiens
cacgaggggacaggttcttcgttgtgcctttcttctgaacgctgcgcaggctggacgcctgcgccttgctacaggcttcggccagtggttctgcataaattggggaag

SEQ ID NO: 607806 - DNA, 1130 bp, Homo sapiens
gagtcgctgacgcgccgcggtgccgcgggctactcctctcctcacgaccgacgagcagtcattatggcgaacctttggctgctggatgctggtactctatggtggccaacatgggcagtgaccttgggcctctggcaagcaagcgcccgaagcctgcgcggactggaacactggggggcagccggataccccgggcgcaggcgaagccctggcacggcacaccgctaacccaacctcaggccgcgcgcatggcatgggcggccaacgcctcaactgggagcggcgggacagggagcgacaatgcactcaactggagtggcacaggaccatggcagagcacaagcccaccaatagggaagggctgcgcatgggcaaacaaaggcccatccacagggcaggatggaacacgcgagcgtccaacgggccaacgctgcgcacccccgacccactgccccagtggcgaacacaccacgcccggacgcataaacacccagcaaacacccccaaccacatggcaccgcaccatggcgcgaaccggcgtggccctggcaccgacacgcccgcggcgaccagaatgggtacgggaagcgagcccactactggccggacggaataccacgtccctgcggacgaaaacgtgttgcccactggacgcccacaggcccccaactccataacacactacacgcgcgacggcacgaacctcctgaacgaaacaccggcttacccacataggcaacgaacacacccacatggccacccgggcacaacccccccacaccccaaacggcggctaccacacaagggcgcgcccccaagccgcaaatgaaagatcaaaaggcaaacacccacacaacaacaactatcctgcgcgccaacgcagacggccccgtcacaccatcatcacacagacacacgccgccgacagccagcggaccacccacacaccgccaaccaaacgcgggcgacgccacctaccacacgtgacaccacgacaccaccgcctcatgcacggacacccccacgcggactcgcacccccccacgtggtacgacccccccacacccacactcagcgccacctcccacggcgcacaattaaccacgaacgacaacactcaccacggcccc

SEQ ID NO: 607807 - DNA, 115 bp, Homo sapiens
  misc_feature (44)..(44): n is a, c, g, or t
cactcgagccggtaccctcagtctgctcaagacgaccgataaancgttatttgagggagctgctgttcagtgcctatcatatcaaagacatcggtcgtctcatcaatgatcgcct

SEQ ID NO: 607808 - DNA, 194 bp, Homo sapiens
accgggcaggccggctacctgcgagccgatcagcgattcggcggatgtggacagacgagcaccgatctgacggcatgaggaatggacgagagggacagatgaatgggatgagacatcagatatgtgctaggcgacgagacgatcgagatgaagagtcgagaagagcgagacgagcgagaacatgaggcagagac

SEQ ID NO: 607809 - DNA, 965 bp, Homo sapiens
ctatatagcaccatacgttatggtgtcagcttgtctgcaaaccaggtgtatgtagaataatgatcatcctcgaaacgcaaggagtactcttggtctgtgcacataatttgctgggtaatctcatgcagtaacaaaatctgcggggtgatgcgatcatctggggccaactctggcttggtggtcactgctagtgctacactagaattaagtctaggcagtgtgtccaaaagaagagttaccgatatcaatctaaaaggcgtttgattgttgctttgggttggaattgagaggtgcagatagtcgtgcagtttggacagcacataagtccccaatgaggcatcccagagttgttggccagttgttctcgggcacaaagtgtccaacattacctcagtatctcaagcagaatatgctttctgattccttaacatcgtttttcaccactgagaactatgttttctacctgaaattaccaaacccattttcatttaaccctgcttatacggaatctggtctcgctaactggtgcttaaacttctccccaacgaggggttcctcacccttttactttggacacggctggtcggtacaccgttaacatttggcaattgtttctatgcacttactgacaacggctaacactcttgtgctttgaaagtggtacccactttcaacaacacacttagttcttgttactttctgcattgaaaatttcaaggttttgcatacctttacaaatacttgtactggttacggatcttgatcttcatttgcttcgcaatagcctctactgatttctgacactctttgctataaagattgttgttccactggtaattgtgccttcccgtttggcccattacgtttactatttatcacttcactgatgtgccgcattggtttgaccaaccttgccccaggtcacccgctttatgacctgttggccctattgtcaaatcccgagt

SEQ ID NO: 607810 - DNA, 718 bp, Homo sapiens
  misc_feature (650)..(650): n is a, c, g, or t
aattacatttgtggactactgtgagacagtatcgtctcccactgcatgcactacttgtgttctccacgaatgttcttccgccttgccagttctggctctcacagctccacttcccagaggtgaatctgactcagaagatgacgctagtgttgctgctcgcagaatgcagaatgttcttcttggttgaacaggagtgcacagatgttgtgaaatacttgaaaagagacttgagcaacaagtggttaggacaacgacaagatacgcagctctgaatgttcactataatatcttatcgttcatcttaagtgttcatcacaaggatgtctgggagtgactataaaacagtttgtgtgttgtcatcgtatcccatttcagtcgcatgaattgaggtccagtcgccatgttgtaggagttattgttgagacgagtaattttggtgacatgcatagttccacgagtttgcgctgagtggttatgcagtgtttcactccaagctttggcatgcaatcgacacaagctagcaatgtgtacccttctttgcaacgagcaagttctgctaataacgtcatgagttagtataagcttttgtgaccattgagatggagaaagtgagaacattatcggaagctataattgccgagagattgccncttgggtttaggtagaacactgtataccatatatactatatagcatatatagtatatagtagcatata

SEQ ID NO: 607811 - DNA, 182 bp, Homo sapiens
gttagcatacgtcaccagtcacagccacgatagcaccctgtctttggcagccttccacaatgatgagcttctgcttgaggggaggtcctgtgcaacacactacacccacgtgtggtactatcaagtggtacctgatgctctgaattactgtaatacattgtgtcatatgcttgtttaccttg

SEQ ID NO: 607812 - DNA, 353 bp, Homo sapiens
tagacattgagtttggataggcggagactgcgtggtcctgcaagcctggtaaccagtctggcaagcattgggacctaggctgctgaagactgacggggcccaggctccgctgcccccaccgccatcaccacctcggaacccagggtaacgctgtcagtctttcggtaagcccatgctcttccttttagatcgggggactagttactcagttttatcagaatattcttgaccctcctcagttcttctatctctattgtgagagtcaatggaatcccctctaggcacatactggtcccctattatgcaacctattcaatacccccttcatccactccttcttagttatcccttag

SEQ ID NO: 607813 - DNA, 175 bp, Homo sapiens
tcgagctggtacccttctcgcgaggatgtgcacgtgcagtggttgcgcacatcagcagcgtcatctcgagctcgatgcgcatgtgggcatgtcgctgaggatcacggcggtgatcgggggcgcgattttcaaagccgcgcgcgcatgtcaccgagaagtcatcggcaatgtcgga

SEQ ID NO: 607814 - DNA, 907 bp, Homo sapiens
cgcaagaggcctcagcggtggccgtccgagagccgagaggtgagggtgcccccgtcctcacctgcagagcgggccgttccgggctcgaacccggcaccttccggaaaatggcggctgccaggcccagcctgggccgagtcctcccaggatcctctgtcctgttcctgtgatgacatgcagtgagaagttccgcctacaaacatctgcctacttcccacagatggtctcagtggctgcccgctatgctcaaggtggcccggcgtgcttgaggtgccagatctatgctgtacggagtcagataccctacaaggtcctgggccccacggtgccccgagctgagtgactgagggccttcggccgcatggccaagacctgcttcagcatggtgcctgccctgtcaagcacggagctggatcggtcggcccctagctgcgctctgtgtctgctctgtggctattgaggactctaggcctggcatcttgaatcacgagcctggactctccttagaccgggggctgtcggtccatgtgtggtggtggacgcctgttcctcatcgcagccaaggtgtggaccggctggtggctctggcccggtgagacagagtggtgccttcctctacccacgagcgaagggctcattctgcagtctcgtgggcgatagccgtgcaacccccagtgtcaacgtaagatccagaaactcatcgatgtagcctggcccaagcacagcgggactgctggggctcttccaaaggcagaactcccttctcattgagatgccaacctgcttgagggaagacaccctccctgtaccggaacccatggaagccgttcccccatccttgtccctattgtggaacacccgatgcgccccttgtgggggggaggtttcctcccatggcatggtccga

SEQ ID NO: 607815 - DNA, 130 bp, Homo sapiens
tgtgcattttagagtacttaatgttggtacttttatgccttcactttacaattcagccttagataaagaaccgagccatttctgctaaaaagtccttgatttagcactatttacataacaggcactcaat

SEQ ID NO: 607816 - DNA, 256 bp, Homo sapiens
gggaccaatgaaattttatttatggaccctgaaatttgaatttcacctaattttcacgtggcacaaaaaaatttttttggtttttttccaaccatttaaaaaatgtaaagaacattcttagctcttagggtacacaaaaatatggttttactttgaaaaccatccctagaccctgaacagcctttttgaattagtaacccttagggtgtcctaaaaaacaggtttgggatagctgtgagttaaggagtccctaaaa

SEQ ID NO: 607817 - DNA, 514 bp, Homo sapiens
tggctttgctggactacattatcaccttaataatttgactttgccctcggctctctgacagctttgaagccactatcagatttaccgaggagaggacaagtactgactgtttgacccacttatccagaaataggtattcacattttgagagggcgtaacaaaacttgtctgattgcagatgacatgattgtatatttagatgacccaatggtgtcagcccaaaatcttctaacactgatcaatacttcaacgaagtctcaggcgacaaaatcaatgcgccaaaatcacaagcattcctatacaccaatagacacacagagggccaaatcatgagtgaactcctattcacaattgctacaaagagaataaaatacctaggaatacaacttacatgggatgtgaaggaccttttcaaggataactacaaaccactgctcaaggaaataagagaggacacaaatggaaaaacattgcatgctcacggataggaagaatcgatatcgtgaaaatggcc

SEQ ID NO: 607818 - DNA, 301 bp, Homo sapiens
aaaggagaagccagctgaatcgctgtaatcatattcatagctagctgtccatatgttacaacgacaggtacagagtacccggtgccatggtcttaactatcaccaagatataaacggcaggcgcttgaatcccatccactgagcacgtccccaggagctgctgatacagcttgcctcaatatcttatcagtaagtgcattcctggatgtgcttagagtcagctatgcactaagttatacccttaaagggagggggataaggagactgcaaataaagagggctaaaatgaagtctgtccgac

SEQ ID NO: 607819 - DNA, 715 bp, Homo sapiens
  misc_feature (308)..(308): n is a, c, g, or t
  misc_feature (438)..(438): n is a, c, g, or t
gggagtactggatgtgattaaatcctagtgtctaggagtgcagtctgggtagcagtacttttaaaaacttcaggtgatgctaacatgcagccaggattgagaaccattgcacctgctattctgctgtgctgaggcaggaagaaggaattgacaaggaagcggcatcgcataactagttgctcttgtggtctgctctctgctggctttcatccctttgaccatgctgaactgacctcaaaatcctctggcttctttgtagggtaccctgtgaactcttcagaggctcttagttctgctatgagagccantcccgctgaccctctcagttctcatgaccagtatttcatacctcttactattagattcccacaaccagaggtcctctcttgtgggtagagcaatagcctgaagactctagccagatgacacagtgatatnccttggcacagaggaaattcaagacaaacagtggatacatgggtttctccatttcaccttctctcttttccctgctatccctttctcatcctcttttgtcctgtcacgcaaaggacggataaaccaacaagtcctctgcctaagcccaatatccagctgggctctccctaaaacattctgatttctacactcatattaaaatcctgactacccacttagcttggcaaaatttgggtaggaaacaccaacaatgtccaccttttggttgggcagtggg

SEQ ID NO: 607820 - DNA, 986 bp, Homo sapiens
aagttcctcagcacgcagggctctctttgggagagactggcctatggcatcacgccagagaacgagcaccacctggtggctcagagggacatcagacagttccagatgaaaacgagacaagggagaaggagagctaccaactcttgccagatatcctgctgaacagaaatccctgaagctgccttaattctcaaaaggagttaccgctcagctgggagccagttcctgctatatgatctgttttctagcctcgctaatgtgagactgaagcattcttaccaaagaaatcatttcctagtaaagaagcccattgaactcactttatttgtttatttccttcgaaagccaccgaagagagaaaaacagagaaggtgtgtaagtgtggcggaaaaagcacagcatatagttttacagacttgggtctgcagctgactagctgggtggcctggggatagtggcttcatcttttggggcttcaagattctttgtctttaaaatcaggggttatatcaagatcatcaaagttcccattccattaaagaaaaccctgcatgtatccataatgatgcttcttcctgttaaatttacaatgaagggaaacccatcacttaactgtaggaatttcccaaaatgaactgatgaccagtgatctctctatcagaaaatggcagatttctagccttccagaactttgattttcttggacattcaatggttcctttttcccaaatatttttcaactgatgccaaaccttggatttggtttaatccacctttggtttaggtttggggacccttttcctggaccgtcccagttttgggttaaaccgatttggatgaccctgtgagtcgccactggataccgacagtctgctgtggtgcttagaagccactgaaacattggtgaatgtgaagtcacttttggggtgcctgccctcatccctctgtctctctgcttccgtgtaaaaaagactgtttcaattgtg

SEQ ID NO: 607821 - DNA, 1815 bp, Homo sapiens
  misc_feature (275)..(275): n is a, c, g, or t
  misc_feature (614)..(614): n is a, c, g, or t
  misc_feature (1396)..(1396): n is a, c, g, or t
ggcgtggtctgtctctcgtctcgaacagatggtgcgcgactgcgataccaggatcccgaggcggactgctctctaccgagctctaccggaccgctcctaccgtagtttccctacgtcgctggcgttgcgagccttccggggacctctgcgtgtcgtcgtggcatctcgctgctctctgggtacctgcccacgctgccgctattattagtaggtttcaggcttccattcgttggcgcaacgcgcaacgcctagtgtatgcctcgccagaagtacgnatcgagcaaagttgactatgcgcatctcgtgagcggtggtgaggggccagtgccggtgccaacgaggcgctggggtccaactattgcattaccgtggcagaggcgcctcacgtacctaactataacgcatctttcctcctgcggcgtatcttccatctgtcggcaccgcagccggcaatggcactagatatggcgtcactcggcacaaaggcctgtaggaacacgacactcttatcggtatccccgggcaattagactattggcagccggtagggcaccataaggcgggcagttagagagcagtcacccgtagggcagctcctcacatggcaacacacntcagctacaacacacccaaaggcaggtggtggcagggctccgggcttgccatacgattcgataatgcccgcaggaggcaccagtcgccaagcgaaacaaggctcgcaggcggtaggccacaagacgaaggagcaagattggcgagggggtacaaaataaccggcgcagagatcaacgagccccgagtggcgaagaccggcttggcatcggacttggggccgccacaatgggggacacgggaagcacagacaccgccttgggggacaaagccccaagggggctcccctttgaatatgggggcactagcgtgttccacactagggcccccactggcggagatatcccttcggtcggcgcagaacaatccggggaaaccgcccccccccagagtccattacatttgtgtggaaacgttttaccccctgggggaaaggaaatccttcacaggcttttgttcctttgaaggcaaacatgcacagccagaaaaggtttgggaccactgaccgattagacattcggacacgtacacaacgccagtgggggtgggtctgccacccccgaggcaccgcgtggaagacgccaaaaagtcgtgttccccaatcccaggaggacattggagggatggaaggcacccgggtgaacgcgggcagatagggagagccaaggggggccacggaccgagtgagtcacatgcagctaccaggcaacaaagagaagtgtcgagcctaccctcacccagagtgaacacggaacgtgaacacggaaaagataccgagtaccantgggaaagacagcccccagagagggacagctatcacagtggacacggtgtggccacccccacaatggggaccagtaaggacaaggacaaggcgaagagcgtaaagcgtggtccatagaaggaagcggtatgatccaccgatcccagattgcaacaagtacaggcgcaatggctagtgcctgattaatagcgaaatactcgacgtaaacagaaagaccgcttgatgaaccgaaccacatggtgtgcaccgcacaaggccgcgtcgtattggacaaacccgagcacgacgtacacaaacaccaagaaacaagacacgggggccactcaacacgataggaggcacagcggaagcaacaagcggcaatcaaaggacgacgacatgcagcccgcagaaggtgtgacatcatacgacgcaacaac

SEQ ID NO: 607822 - DNA, 229 bp, Homo sapiens
  misc_feature (66)..(66): n is a, c, g, or t
aggggcccagcccccaacccacaggcagggaggggcatccctccctcccggcctcagggagcgaangtggattaaacccacagggattccggatgccagcccccattttaaacttcccttttttctccagggttgttttggtggtggtggtttttattttttaaactttggccaacccccaaaggtaaattgcccaggtttggggtgaataaaccaaggtttttttcca

SEQ ID NO: 607823 - DNA, 301 bp, Homo sapiens
cccctcaccaagaccctcgcctcaccaagacctgacgaagcgatccgagcagtcctctgcccgcctcccgggcagaagcaggaagcaccactgcactccagcctgggcgacagagtgagactccatctcaaaaaaaaaaaaaaaaaactgggggctggcacaaagtgattgtggagtgcttctttgtggtttccacacaatttctcatctgaaacaaagtcttaagtttacagcagctctggtctctgggctataagggagttttttggcaaaaagaggattgggtggcagaagcaggaag

SEQ ID NO: 607824 - DNA, 148 bp, Homo sapiens
gatggtggcccggagatcgggtgtacggggcgtccacgggtgcgctatgaagtgtactgtgttcttcgctgatcgggtgccgtgaacggactggagcgaatggcgcaagtctgcggctgtagtcctgatggcgagagacgcgggcgtt

SEQ ID NO: 607825 - DNA, 378 bp, Homo sapiens
gctcgacaaacaattactaatgaggtacgctgatgcctgggagtctcttgactccactacttaattccgtttaagtgagaacccttccaatttcctttaatagaagggccagcttaatgttggtggcaaaattggcaacattagtttattggaaatttggcaaatttaaccccatttcctgtggtttgggctccaaattgcaatgttcaatgcaacgtgctgctgaaaccgaccggagtactagccagcacaaaaggcagggtagcctgaattgctttctgccctttacatttcttttaaaataagcatttagtgctcagtccctactgagtactcattctctcgcctcctctgaattcccccccccccccccccccc

SEQ ID NO: 607826 - DNA, 154 bp, Homo sapiens
gagcagaggtatcaaagcccttcaatttgtgagcggatagtccactactccgcctctcgggccaccttgaagtggaggtcgcagttataggtgtcactagcaacaagggtatcatcaaagtcatcttcatcctttctcgtacatagtcgagggg

SEQ ID NO: 607827 - DNA, 277 bp, Homo sapiens
cctacgtataataattccatcacaagacgtctagacactcatgagctgtcaccacattaggcttaccaaccgatgcaattcccggcacgtctaaaccaaaccacttacaccgatacacgaccgggggtatcctacggtctatgctctgcaatctagtggcagcaccacctactgtttcatgccaatcgtcctagaattatttcccctaacaatctttgaaatcagggcccgtatttacccctatagcacccccatctcacgcgtatgatgacggtga

SEQ ID NO: 607828 - DNA, 525 bp, Homo sapiens
  misc_feature (30)..(30): n is a, c, g, or t
  misc_feature (148)..(148): n is a, c, g, or t
  misc_feature (157)..(157): n is a, c, g, or t
  misc_feature (193)..(193): n is a, c, g, or t
  misc_feature (203)..(203): n is a, c, g, or t
  misc_feature (205)..(205): n is a, c, g, or t
  misc_feature (260)..(260): n is a, c, g, or t
  misc_feature (282)..(282): n is a, c, g, or t
  misc_feature (332)..(332): n is a, c, g, or t
  misc_feature (345)..(345): n is a, c, g, or t
  misc_feature (353)..(353): n is a, c, g, or t
  misc_feature (402)..(402): n is a, c, g, or t
  misc_feature (410)..(410): n is a, c, g, or t
  misc_feature (412)..(412): n is a, c, g, or t
  misc_feature (441)..(441): n is a, c, g, or t
  misc_feature (444)..(444): n is a, c, g, or t
  misc_feature (456)..(456): n is a, c, g, or t
  misc_feature (459)..(460): n is a, c, g, or t
  misc_feature (505)..(505): n is a, c, g, or t
tctctcaggaatatgtatcatttgattttnagcatgtggggttaaggtattagattactaccacaaaccgtagacccctgcatggcccacattttttttcaggagtagatgttacatggcaggtatcaaaatgtgatgatcaattctntgttttctnttgattaaacctcctcatttggttaaatagccagtntataccaaananttctacacaggtcaaaattatatcacttttaaagcagcaaaacgtgatccaaggntttcttgaaggaagtgcaaaanatgcagtccaaaatgttctcccgattcaagaacccttatgctgtgcctcncctgaggaaaganctgtaaancaaatggctttccaccccccaccaaaaaacccaaaaaaaaactggaatntgcaaaangnacattcccacccaggaaaccatgaaaaancanaaaacaatttanttnntaggggaacttttcggcttgcatggccacacaccccaagaaatanccctccccattccccccacg

SEQ ID NO: 607829 - DNA, 817 bp, Homo sapiens
  misc_feature (556)..(556): n is a, c, g, or t
acctctcggatgggccccccgcactcccgtctcgagcactctgcggtgcgcaacgacccacactggcgcggcgcccatcccccactatgggctctgcctgtggaccccccacgcccctttttggtgcaagccgcacgaccccccccccgggtgtgtggtcccccccacactgctcttgtgccataatcgccccacctcctctctcaccagaggagagagtggcgcgcccctcccttggcttataggtggtggaccccccccagccgcccagcatgcggtcttacctccttgatgatgtgccccgggggacgtcctctcattgtgctgagtggagagtaaccctctctcctcctccattaggtgccaaagatacacacactaaattctgctctcattctttaccccgctctataaatatactgtcgccaactcataccaatgctccctaaggactcttcgctctctgattgtcctcactcccacgcggtgaccacagtgcagtacccacccacttcccatcccacccccttacataaaaaatgtcactttttccacnctctccttccaccatgtccacgacaccactcactggtgggagatatttctaatcactgccagtgagacgacgacaccacacactgcatgtgtgccttgagtctatagaagacctcacacactctgtctctatttgtgtctgtcgccacgacgactgagagagagagtctgggctcctcctggttgctcattttagagaggaggagcctggtcggcagtaatagaagttgtccgggccctctaaaacgggcccacataacaa

SEQ ID NO: 607830 - DNA, 594 bp, Homo sapiens
gcggccgctatgaagcgatcgaccagcgtctgctcgaccggtgcgtcgacgaggaaatcagcctcggcgatttcgtgctgtcgggcggcgagctgccggcgatggcgatgatggatgcggtcgtgcggttactgcccggcgtgctgaacgattcgctgtcggccgtgcaggacagtttcgccgatggcctgctcgattgtccgcactacacgcgcccggaggagtatgacggcgtgcgtgtgccggacgtgctgctcggcgggcatcatgccgagatcgagcggtggcggcggcaggaagcactgaggaatacgttgcggaagcggccggacctgatcgtccgggcgcgccgcgagaagttgctgagccgggccgacgaggcgtggcttgcgaacctcgcacgcgaagcgaagaacgcctcctgaggcggctgcgcgagcgggaattggcggtgtcgtgcatgcgtgcgcggcgcctgatgtgaatccatcctctatcggggccaggcctggaagcaggcgggtgccaacgccgacaagatggcaaaaggagtcagtaatgaatctgatcgcaaaacttgagcaggaagaaatc

SEQ ID NO: 607831 - DNA, 1024 bp, Homo sapiens
  misc_feature (327)..(327): n is a, c, g, or t
  misc_feature (393)..(393): n is a, c, g, or t
  misc_feature (414)..(414): n is a, c, g, or t
  misc_feature (429)..(430): n is a, c, g, or t
  misc_feature (434)..(434): n is a, c, g, or t
  misc_feature (437)..(437): n is a, c, g, or t
  misc_feature (480)..(480): n is a, c, g, or t
agaggaatacggcacgagcgcgctactacgccaacactagaggaccccgagagctcctattaggaacctagcacagcccggcgacctagttgccacctagcaccgcaccggctaggaccatagcacgcctactgcctacctagcgatagctagtaccacagacctaggacctgaagggtaccccagcgtagactcgactagcgacgtggtacaccctataacagaccgacccgagcacagagaacggctagaagtgctacacctatggcactagaactagtaggaactatagtagcctactactacctagtccacccgatagagggnaacatagtgcatgctccagtatgcccaacggtctaggcgtacgcggcacggttagacccccaaggncaacctattactagcggcaancgacctatactacgnnccgnggnctagcgtgaaacaataaagatagcaagcccatagtactactangcataacaaccaaaacaaataacgaaagaagaagaagaaaagacaaaacaacaacaacacgaataaataagtcgaaagagctgtggatcctgtgatacccctaaatacgagccctttctcgctcagtcatcctcatgatcgcgctctcacttctgtggacgtcaccgttatttacactgtcgttcctgttgatctttgttgttatactcgcgctgggcgtgtatcctccctatagatttatatttgctgcactctattggccagtatgagtcgcaccccttatggttgcagcttggtcggttattagtcgacgcaacgttcttgtatacgacacggcgcttctcgagatcctatttgagcgctccacgacatgtacctattgtccttactctttactgcgttaccgtatgttctgttctatttttgttgtgtcattcttcggtgactatcagactacctattttacctcatttttgctcgtttctgtgtactttttttttttcttctcccacactcgtgcggcgttctgtttttcactctttgg

SEQ ID NO: 607832 - DNA, 735 bp, Homo sapiens
agtaagaccggcccttgggtttgtgtgggagctgggtgaggcctgtgactgccagctttcccccacttccctgacaacctgcatgactcagcagaggcagccataactctcctaggtacacgactccagtgacctgggaatctcacccacattccctacagcagccgcagcaagacccgcccaaggagagtctgagctcagacacgcctagctccacccccacctgatggtccttccctatgcaccctggcaggaagacaaagggcaaataaatcttgggagttctagggccccgcccactgctggttcctccccatattaccacagctgatgctttctggaaaggaccacctcctggcaggaggccaaccagcaaaaaaaaatagaccattaacccaccaaagctccattgtaccctctgccacctccaccgaacaggcactggtagccatggctgagagacccatagatggttcacatcacaggactctgcagataacctccagtaccagcctggaactgggaagattcgctgggtggctagacccagaagagagacaacaatcactgcaagttgtggctcataggaagccacatccataggaaaagggggcagagtactacatgaagagaacaccccatgggaccaaaagaatctgaacagccttcagccctagacctttccctctgacagagctacccaatgaacaaaccctggtaatatgacaaaacaga

SEQ ID NO: 607833 - DNA, 534 bp, Homo sapiens
  misc_feature (230)..(230): n is a, c, g, or t
  misc_feature (297)..(297): n is a, c, g, or t
aatgatccccaccctctctttcttctattttaacaaaaaatctatacacacaaatcttttaattccaaattgatacagataagtttattttattattattttttgagacggagtctcgctctgtcgcccagggaatgcagtggtgcaattttggctcactgcagcctttgcctcccaggttcaagcaattctcctgcctcagcctcccaagtagctgggattacaggcgngtaccaccaagcccagctaattttttgtatttttagtagagagatggtttcatcatgttggctaggntggtctcaaactcctgacctcaggtgatccacccgccttggcctctcaaaatgctgggatcacaggcatgagccaccgtgcctggccattttctgcatattttctatgtaatcattttggccaacactgtggctcactcctgtaatcttagcactttgggaggtggaggtgggagaattgcttgagcacaggagtttgataccagtgtgggcaacatagcaagaccctgtctcccgg

SEQ ID NO: 607834 - DNA, 227 bp, Homo sapiens
ggaacgcggcggggcagcacagtcgcaggagatgatggaggttgacagacggttcgagtctcagagtccgccgatgaagaggggagaacacagcagtcgcatcgtggcgacctcagtgacagagcctcaggatggcgaggagcgcgggaggaggcccccacgaggacataagctgcctctggacatgaaaccatcacctggacagagatgcagcaggatgttgattt

SEQ ID NO: 607835 - DNA, 113 bp, Homo sapiens
gctcggtaccccacttctgcttcccaggctcgcctgggtcctgctggttgctactggaatcttgagaggctccttgggcatcctgctcagacttgggcactgtttggactctg

SEQ ID NO: 607836 - DNA, 778 bp, Homo sapiens
ggacgggcgcctcctccgcgggcataaccaggttagcctacgacggcaaggattacatcgccctgaacgaggacctgagctcctggaccgcggcggacaccgcggctcagatcacccagctcaagtgggaggcggcccgtgtggcggagcagctgagagcctacctggagggcgagtgcgtggcagtgggctccgccagatacctggagaaccgggacagcgagacgctgcagccgcgcggaacccccccaaatgaccacactgtgaacccaacaaccccaatctcttgaaccatggaaggccaaccctgaaggttgctgggccccctggggcctttcttacccctgccgggagaattcacaacttgaccctggggcacgcgggggattcgcggacgggaaccccaaaacttccagggaccacttgaggctttgtggaggacccagtacccagcaagggagataagaaacctttccaagaagtgttgggggcaaggcctgtggcgctggggtggccctttccttggcaggaaatgaacggccatgactaacttaatcggtcaattgccccaatggttaacaggggcacagcaacgggggttcttggccggagatgcccccttacatccccattgaacgatttgcggacgcccaatctttccccacggtacacaaacggtccacacaagtacgctggaggccacttgggttcgctgggtccttggcactgttcccttagccaagctggtggctacatccgaacgcaccggggggtccga

SEQ ID NO: 607837 - DNA, 1737 bp, Homo sapiens
  misc_feature (512)..(512): n is a, c, g, or t
gtgctcctcgatggccttgcaggagcatcgacttggctatgggttggatgcgcagtccgaatcaccacgatggtctcggaattctttgctattgacctacaatacctcacgtgttccttagcgcatgttgatctcacgaagtcgacagcaactgagtgagatatccttggtatctacgctatcctacccgctgttcatcgagtgtattgctcgttgatgtactaaactaggttctgcgaagagagcgcagagagggacatacgctattgcatacctggcagtacctcgtctggagtcatcgtttcgtcaaggatgcatttgtctagccagtagaagaggatggatcgtcggactagcgggcattcaagggcgcgagtactagtgcatagccgcggagatcgatgcgcaatgctaacaataggtgtgcggaagaaccaaattccgaatcgcgtctgggcgcgagcaatctgtgcccgttagagaggatcggagcgaggattgctattcgtganttgcgaccgcagccttctatagaggcggtcccttaaactatgattgaacactggtgcccatccacgataggaggagctggtccacgagcatcttagatttagcccactaattccgcgccgagagatacttgttcgaaggctggggccgggaagcgtactttagaagcgagccgcagtagtggcgaaacactgcgagacgttgaaccgtagcaacttaggggggacttggcgagagaatccgagccaaagcaaactcccgtccttggcaagtatttttcccccagagtccccagcaaggggccattatcataaagccatttcagaaaagccctggatccccagatctccccggcaagggcaatgtggccacaagagggagcaagtccttacaacggaggtcagttgctttgggccttgggcagcaaccccgccttacaactgatggccacgtgcctataggcacccctccgaggaccccggtgaagggcaaacgcggatacttaacatcgaagtcgaaaaggagtccacgcttcaaacgacctccttgtctcgaacgccgattgtgccacgcacaggagctgttcctttcgggaacaccccgtggatctttcgaaggtgggtgggaacaaacgtacgccggcaaagcttggatcggccctgaagaagctacggagggaagaacgcataagggagcacacgcgttccaaccgtggtcaacacgagctgacaacaccccatgataggcccccatgggggacacaccccggcggaaatgcaacggcagcggacaaaatgggccattatacttgggagacagcaccagagacaacaaaaccagaaaagagacgtcgaaacaaacagatatacgggtgagaaaataggcagctgaacccactaaagatgttgccaggcggctgatctcggccaccgggagccactcagccaccactgtgctagaaatccgaccccaactaatcccatatacctgatccatacacaccaataattaaaacccaatcagaaagtcacagagatcttaaaactaaccgagttaggtatcacacccccaaacaaactatacctaggaacatatagcacaaccaaaccagacatactaacatctcaaacacagaaacaggctgatcacacacttctaatacatattacacttataatagctaactatacgatatgtcctaattatacatactagaacacgcaaaag

SEQ ID NO: 607838 - DNA, 720 bp, Homo sapiens
tgaggatgagttgtggaaaaataaaatgttttagccttggtaaaacctttcaaaggggaccccccccaacccaaaatttcttccaggcgttttttttccaggcactttacctatgcccttttttttaaatattttttgtacccttttttgtatttttcccttttaacacgggtgtgggggaattggcccgaaataaatccccgttttaaacggcctgtagctttgtaatccaaataagggggttttttgtcctggtaaccgccattccaccggcagctggagctggaatcccattgtttttttacctcccatccttttttttccctgtcacaaaaaagaagggtgaaattcagtgaatgctgttactaatcctgttacgagatgaatctcctttcaccaaaattaaaatatgtgtttccgctcaaatgatggccacagttgaagccccaccccttttaatttgcaagccccccccccttaaggctccccagcgccttccacccttttactctagggtaccacccttctccttgtcccccccttggggggtgccgttttcttaaaaggtttgcaaattgcccctccccccaccggttaatgtctcttttttgggaaggtctcacaaaggtgtgcatatttctgcatgtaaggggcgtgtctatccataaaacttttgggacgtctctttccctctgcctcgtgccgaattcctgcagcccg

SEQ ID NO: 607839 - DNA, 972 bp, Homo sapiens
aatcccaattttggttccttactattgtagtattgatttcctatcagttcatgcagtataccagagtaagccatttggtcccaaaatgttcggtgtctcagaactttagttttcgaggattggaattttcggtaaggctaataattggccagtattattatcgatctatgcaacaagtcattggtagttgacgtggcttattaaacttgtgtacctcctgaactttagagagttcttgcattggtaatctggcaccgcttttctgaccatcgctgctgttgctctgtgagtcctagatttttgtaccctagcagagttgtagaggctgtgatttaatagagacaagaaattcggcactgtatattacagctgtccttgaacaagctatcaatgtcgcttcatgaaaggaagatctaaatcagacaggagttggtctacatagtagtaatccattgttggaatggaacccgttgctatagtagtgacaaagctgaaaggaaatttaggaggcactaggccactattcaggcagcactaagctaagtcatcgcatgtcgctttggtcagaagcatcctttagacttgggagtagacttcacagaatgaaagtaattctagataattacggatgaatgactttaactgttaatgagagcctgagaacacggattatccccaaacccttgtcactcttccacgccagtgagctctgatttttacgatctgctggtgaaaaatgctgtatgtcaattcctgctaatcttagtatcttagggtaccctgatctttggctgttcttattatggagcccattctcagtcaagtatagcccggatgtctttcggttaccatacgcccatcagtgttgtccttacaaagcgcgcacacaactgctaagagagtgtataaaaataatgttacttggttaatgtgttatttacttgagtaattgtttgtgctaagcattgtgtt

SEQ ID NO: 607840 - DNA, 856 bp, Homo sapiens
ctctctccccggctcacacgatccccaagaccgcctagccgtattgctactgaagtccgttgcgagagcctgtgcttaggtaaaagtccggcctcattgggaatattcaatccaaggtgggacaactatttttccggaccagaatggaaactcgttgcatcgagaaaatcggtcgaacgtaagtacacccgtgtaccgagaaagaactcatggactgctagcgaagagtagcagacactcgtgaatcagcaatacgaacaggtgtaagggatttctgtgggagcctacaataagacttaccagcagcacctgcgttatgtaggcatctgtcgtttgacagacttaccacagactagagaaagattgagaaccctgatacgaagactcgacctgcttacaagaaacatatgcgtatgaccgaacctatttacagagatgatcgacacatgaagtatccatgagatatatcaggaaatatcatattcatgcagaatgaaccccgggtgagccaaagcaggactccttggactaatgcaccgatagtagaagtcctgatgtgatgaactttcgattgaaagattgccatagagctgcttgtattgtgaaaagtgaggactcgaatctggatagaatcccctgaaagcagtagccaccatgttcaatcatctgtcagtgactgtttggcaaatggaaaccgtggagaaacaaaatgtgtatttaccaggaataatcacaatagaaggtcttgtgtcagtgaaataataagatgcagatttgttgaggcttatgattcagcagctggtccttggatttgaaaataaacccttgtttcttcaaacaaagagtaaacacgggg

SEQ ID NO: 607841 - DNA, 571 bp, Homo sapiens
ggtggggagggaagctggcagagctcggtgtcaggatccggcgcccctgtggaaagaccgcagagggaagccgtgtcaccgagcctctcgcccttctggggtctcgggaaacacgcggccagtaagaactacaaatcgcgccaggcaggcagccgcgacgtccaggctctctcattcgcccccatcgtgtagtgggcctgagcggcttgaccagaggctgctgcaactgcagcaagaggaggacagtacaggagatgagtcctggtgagggacccgaggagcaggacagaagaagacggaccactgaatcacctattctggccacctttgcatggtctaggaggtgtgtgaatagagcacgtcggtgtgcatggcagtcttcggggacctggttttgggaataagggtgtcactagttccaggcgtctgctgaaagatttggaacagaagatgatggtcactccgaaccagatcggctgtaatgcagagtcaccagtggccctggaggaggccaagacctctggtgccccggggagcccccaaacacccctgagcgtcatgactctggtgg

SEQ ID NO: 607842 - DNA, 901 bp, Homo sapiens
agcggaggggagagcacgcggaggagcgtgcgcgggggccccgggagacggcggcggtggcggcgcgggcagagcaaggactgcgggtgatcccactctgcacagcagctgcacttcgtgtgcccgcgcagtggtcgctggattgctgcccggtttggcactgctcctgcttgtgttgtctggacggttctgtggctgcttggagggtaccccactgatggtaatggcttggccttgcttgggcttgaaaccccagatttgccattgtttctgtggcacgagcttgaacattgcatcactgtaattgtccaacgaaatgggggacacgttggggacttcacgattccattcagtgtaacctatatgattctgacagttggataccaaggcatagggctttccttggccagtctctttgtgccaaaggaaacggttgttaccccttgaatcttggacaggattcagccacacagtggttgtgttacgcaaaaggcctaacttcaagccaatgtggaatccaattcccactgaacaccttgtgctggcacaggcggggtgccctgcacaagccgacggtggctcatgaactccccaattcctcgccacgttttgggtgtccatctcccgcattagacccggcttggtcttaagttttgggtttggagtgtttctgtgtaaaatgtttgactttggtctccttttcctcgggttttaccctgggatcaaaaggttttggcagtaatttttctttaacaaatagaagcgatgatgaaggtgatttgtgattgtgtttttgggtggtatacgtttcaaattctattactatcgtctggtggataatctgcgtctgtttcagactcacaatacttgatgacatttggcagtgatggagtgacatgac

SEQ ID NO: 607843 - DNA, 224 bp, Homo sapiens
tggaacatagtgaaaacctgtctccaccaaaaaatacaaaatttagccaggcgtggtagtgtgtgcctgtagttccagctacctgggaggctgaggtggaaggatagttatgagcctggacagggttgaggctgacactgagaccaaagatcatagccactgacactccacgcctacggtgacacgagtgacgacccctgctacagacaaaaaaaaaacaaaca

SEQ ID NO: 607844 - DNA, 390 bp, Homo sapiens
atatttttatctccctgtatcccctctatgtttaacacagagggcatacatacccacccgaggcaggagaatcgcttgaatgcgggaggcagaggttgcattgagctgagatcacgccactgcactccaacctgggtgacagagccagaatatgtgctctcaaagagaagaaaaaaaagggtataaaaggcagaatttactcttggactttgggaataagagtggatgaagtcaaagatctcttggccctctgggttaagccactgagtgaagggtaatacctttactgagttaaacagtattggaggaaaatttggggtgatggtgctaggtaagaaggtgaagatataatgaaataaattttagtcatgctcagtttgagatttctat

SEQ ID NO: 607845 - DNA, 382 bp, Homo sapiens
tgaatgaaagggagctggggctgggcagagtccgatgattgagggccctgtcttggctgagcccgggctcacatcgacatggctccggccctgtggacatccttcctgtaccagctctcctgtggccatcagcgctctctgcattccgttggcatgtgtgactcttttctccctgagcttgtgtcatagcactgggggacttgcttccccagatgccaggcacttccaagtacaccctcgccaggttcagagagatccctaaatcatcaaggtccaggtgtttgaagccttgaacgaacagaaagtagaaacatggtggggaaaagggctcaggcaagcacttcctgggtaaaaggcacagtaagaacttgggggtgacaga

SEQ ID NO: 607846 - DNA, 348 bp, Homo sapiens
tcgacttttaagactactcaagtgcaatagtgacaagggcgaaaagagtagaataggggaataagggccaggcacgatggctcacacctataatcccagcattttgggaggccaatgagggcagaccacctgaggtcaggagttagagaccagcctggccaacatggtgaaaccccatctctactgaaaatacaaaaattagccaggcatggtggcatgtgcctgtagtcccagctacttgggaggctaaggcaggagaattgcttgaaaccaggaggtgaaggttacagtgagccgagatcgcgccactgtactgcagcctgggtgacagagtgagactctgtctca

SEQ ID NO: 607847 - DNA, 164 bp, Homo sapiens
atggcaagaggttcagtgtgtggtcaggggtcacagcacccacgtctcaatgggaagagggtcagtgtgggtacaggggtagagcacccacctctcaatgggaagcgggtcagtgtggggtaaggggtagagaccccacctctcgatgggcagagggtcactgt

SEQ ID NO: 607848 - DNA, 131 bp, Homo sapiens
gcccacgcgtccggatcatggcttactgctgcctccacctgtcactcaagagatcttccaacctcagcctcccgagtagctcggactacaggcacatgccaccatgcttggcagaatgagacgctgtctca

SEQ ID NO: 607849 - DNA, 110 bp, Homo sapiens
cttccatagacatatgcctatagatgtggctgcagtgattgtccacatttgtgatggctgagtgggaagacataccctagtgacagcatctagtctctctgacttctcta

SEQ ID NO: 607850 - DNA, 122 bp, Homo sapiens
ggctgtctagaggatcccgtgatgtatcgcccaacaactggagaataaaggagatggaatctgcttatagtgtatccagggcgattatgaaggtggttatgagttatgctatgtcaccgtta

SEQ ID NO: 607851 - DNA, 255 bp, Homo sapiens
ttcgattggcgggcacttagtgaaaccaatccctactaaaaatacaaaaattagccaggcttggtggtgtgcactgtagtcccagctactcaggagcttgaggcaggaggatcacttgaacctgggaggcggagggttgcagtgagccaagatcgtgccactgaattccagcctgggtgacagagtgggactctgtttcaagaacaaaacaaaacaaaaatcaagtccctgttaagttgcccgccacaatcgaag

SEQ ID NO: 607852 - DNA, 748 bp, Homo sapiens
  misc_feature (83)..(83): n is a, c, g, or t
  misc_feature (88)..(88): n is a, c, g, or t
  misc_feature (110)..(110): n is a, c, g, or t
  misc_feature (137)..(137): n is a, c, g, or t
  misc_feature (140)..(140): n is a, c, g, or t
  misc_feature (156)..(156): n is a, c, g, or t
  misc_feature (158)..(159): n is a, c, g, or t
  misc_feature (167)..(167): n is a, c, g, or t
  misc_feature (170)..(170): n is a, c, g, or t
ggcagtaagatcgagcgaggagcccaagagcgagcgcgcagcagaagctcgagccgcctccgccgcgcgacccacctcggcgncgcgnctgcgccggagatccgcccggnctccccgagagcgagccccggcgccgngancaccagccgcgctaancnncgaccaancgncacgaggcgcctgagcgagagcagaggaggaggaggcatgagtgaggcgggcgaggccacgacaacagcaaacaaaacctcccgcaggctccgacggaggcggccgccgcgtgtccaccaggaccccggcgcccaacgaagccccgggtgggcaaggcgggtgcgcccccgagggcccgcggccccctgggggaccggccgtccaacggtcggaaggggaaaacccacgaggtgggcgaccagcgggcccccggatatgcgaggggggcaccgcacggaccggcacacgacgttcacgtgtgtagcccctggcctggcccggccgcgcagcgcgccacggagactgctggggagcacattacatatggttctcttcgggtgcaacaccaaactaagttcccttgtgaggacacagtggttaaagagtgggggtttcaacgcggttccagaaaagttggggaaatattggggacggttgtattatgaattccggaaagagtgagcaacccaaaaggaaacggatgtaattttgtagaagcatttcaggatgtttggccaagtagaatgaaagtgaattc

SEQ ID NO: 607853 - DNA, 328 bp, Homo sapiens
gtagtggtcctcggtaaatggactactaaaaagcaacccacgaagttttaaacgtaattgtccctaaagatgcctctgaccagtctggccgtccttgacttgctaactgtgtttcatacaagtattttgtcagtttgtgaatgtcccttcctttcgcttccttccactagacttcgggttgtcagaccccggacccccgttagaggtcattcggcccacggccacgacccacgtatttaccatttgccagcccgtgggaatcttgtaagctttcaataaagcgaaccgtgctagacctaaaggaccgcctctgtccgacagacttctg

SEQ ID NO: 607854 - DNA, 112 bp, Homo sapiens
aagagaacctcagacaaatgaccccatccatgggggtataagagcagtagcagcagcatctctgaacatttctctggatttgcaaccccgatcatcctcaggcctctctaca

SEQ ID NO: 607855 - DNA, 122 bp, Homo sapiens
gtaccgaaaatgcgtagcgcccggaaatacttcggtgcacggcagcagcgcgcacatgtcgggcgtggtggccaggttcgcaggcagttccgcctcgtatgcacctgcgtgcgcccgcggca

SEQ ID NO: 607856 - DNA, 242 bp, Homo sapiens
ggataagcatatggcggccagattggcatcagtattgcatatataacacgtgtcactgattttccttcaacttgtggatgcaggcaagtgtggatgatgccagagctctcctacagagatgtggtgcaatggctgaacaaaccccgattttgttgtcgttcctccttaggaattctaggaaacgaggaaaggcatcaactgtgaaatctgtgttagaattgattcctgaatcagctccaacg

SEQ ID NO: 607857 - DNA, 406 bp, Homo sapiens
gtggtgggcgagagacgacctctctgctcttttccacactaatcgctctggacagcttctcactactcaccctgtatactttcccagatacagaactcaggcaaagagagatgcagcccattaatcactctactgtacccaatcatattacggaaagtcagacccaggagacaggactcaacagccacgtttttagggcagattccgtttgctgcctccagcccatcattcccgccttaactgtagggctctgcattatagccgcataattcatgcctccctaattatggctgtcaacagccccattgtaacgctgtaaaatgtacagcacctgctctccaggaaccctgtgccatggatcggtagaggggagtgccaggtgtggctgggggctacgccaaagggt

SEQ ID NO: 607858 - DNA, 345 bp, Homo sapiens
ttcttatgtgaacgccacccgcgcacaatatatctataccacaccagataatctatctagtggtggcgcgcacgcaagttgctgcacgccccccgcacgccacgtgtggtcgtccccgagcagtgtgagtgctacccctgtgggcgccaccacgccgagctgcggcaactcaacacccgctctctctcaacactctcttattctcttcttcaccaccaccctcgctcaactaccaccacctgtcttcagaacacgctttaacaactaattctttctcgtgcccgcaacaacaatcaccaacaagctgctttctaaaccaccggctcaacaaataacaaacaaaat

SEQ ID NO: 607859 - DNA, 255 bp, Homo sapiens
tatttcggtcacgagtgataatattacaaatagtttaggcgttgggtaggtgcggtgccttgttaggttccaagccttattcccgggagcttgtagggtgagaggattttgtgaggtcccaggaagtcaaggcttgcagtgagccagtgagaccctctctcaaaaaaaataagaagaaagaaatagtaaatagtattgttactattcagtgagggaagggattgattagtattaatttcctcctgtgctacaggt

SEQ ID NO: 607860 - DNA, 288 bp, Homo sapiens
tcgaattcaagcttctaacgatgtacggggacatggctcactgcagcctcaacttccgggctcaagcaatcctcccacctcagcctctcaagtagctgggactacaggcacacatcaccaggcccagataattttttgtagagatggggtctccctacattgcccaggctggtctcaaactcgcgggctcaagcaatcctcctcccacctcagcctcccaaactgctgggattacaggagtgagccaccatggaaataaagcacccagcgctgccctgggcccctgca

SEQ ID NO: 607861 - DNA, 1346 bp, Homo sapiens
gctgaccatcagttaacttatcgatctcgctccacacttttccaataactacctgttgtccttctggtgctctgtctgagtgtgcccaggtactcgcgtcccggtgcgagttcctcagtggtcgagacagctgctatatagcgattgcgtctaggcgagtgcttcttgcgtttccgctgcgaatcatcctttgttcaccgcttcacaactctagccgtatcacgaggcgtctggctagtgagggtgttccagagagggagtcgcttggagcgaccctgcggaattaagacctcgtagcgatctgtgtccgtgcaaattgtggaagggcgatctcgagaatctgatggccagtaggatacaatgtcagagagtccgtgaaccgtactggttcgttggaatcgtccgtataactcttggaccacgcattgtacattgagcctcttggacgtctctgcagtgaatccggggagggtcttcggtgagcttaaactccgggtcgaagactatgtgtggggatcataggcataagaggtcctttccaaaggctccattccatgattcttggtgaagctcgggtaaactttcccttgaactctaatctggtaaggcatcgtgaaggagggtcttgcgagaaatcttttagcaaaacatacttgttgcgtacctatggggcacggtaattccgtttcatagcaaagcatttagagctacataggctcccgctctgtaaggttgcattgaatggaacatcttccgcatatccgctgctagcttgacgcaccgttgagtccatagtggccatggacgccctagggtctggttggaaggacacccggaacagctccacaattggggggtcgttccccgaccaaaaaggggtacatcttttggcacttggtaacgtacccagaattagttcataggagaccgtgaatcttggtcgcagtcttggggcaggaactaggaagacttccggcagggtgcgtcttccaacggggcagcggatggccgtggcttcctttcccaattgcaacagaacagaaaaacccaccgaaaacattgaggggacacgcttcagcaggagtgctctcaccaacaggcgccccgctgactttggcgcaaggtctttcttgaggggttctgaccctggtgcgaagtgttaagattggccccccggcaacttgttccagggaccttcggtcgagaggatcctttggcctagaccattccgtggggcaattatgcatcggaggtcgcttctggaatgaaagccgaggaaggaggttagaccatggtatctgggtctcatcaagcattgaaggagtagtagccacaatggttcaccc

SEQ ID NO: 607862 - DNA, 590 bp, Homo sapiens
  misc_feature (578)..(578): n is a, c, g, or t
ggagctcggtaccagggttgcttggttgttggaaagaactctatattgcatcagaggacgtgggtttcgtatacacattaacatggacagatgtgaaaaactttatgttgaacagaaaaagtcagacacaaagagtgtgcatactatagtgattcaagatataggtaaatttaatatgtgtgggatagaaatcagaacattggttgcctataaaatggtggagattgactggaaggggaactggatggagggaactttggagggttataaaaatattctatttctttttcctttttatgagatggagtttcgctcttgttgcccaggctggaatgcagtggcgcgatctcggctcactgcaacctccggctcccgggttcaagcgatactcccgtctcagcttccccagtagcggggattacaggcgtgcgccaccatgctcggctaatttttgtattttcagtagagatggggtttcaccacgttagccaggctggtctcgaactcctgacctcgtgatcagcccaactcggcctcccgaattgctaggattataggcgtgagccaccacacccaancaagcaacccct

SEQ ID NO: 607863 - DNA, 1327 bp, Homo sapiens
  misc_feature (551)..(551): n is a, c, g, or t
taatttacaaaaggtaggctccgtttattagagtcacacacaacgtgactattcttcaggggtgacctcaagaccacaaaaaacccattttcctcctttcactttcgtgagtctccgtggggtttaatacctagaaccagcaaggtgtacgtgctgggggctccattcacaggttttacaagttttttcattgtgagtgtgcaacttgtggtgacgtggtgtgtgaggttgtggccaggtataggtctcaccatctcaaaaggctcatgtgagtgttgtgcgtgttgtgagcatgtgggtctctcaagaggctcatctcgtggagaactatatatttctcgggatactgtgtggtataaccacgggcgctcatctcagagagaaggcgggcgccaccagatatgtgtgctcaggctgtgacaccacctttctccagaagaaagaggtacatctctctctcgtggcatatatgtgtgacacaacacgcgtgtgtacctctcaggggagacatctctctgtgcagatgtcgcagaaagtctgtgaatgtcgcncccctctctctataactgtgtggcgtagacaaaggtctcacctgtgtgagaaaaggttcccaatctcagccttccgtgtgtggggggcccatatagagaccacgaggttcttctacagtgagatctccaggggctcacacctctcgcgagatatggcgtttatcaaggtgtgcttcgcatagaataacagcgcgtatatttttctcacacgtggtgctcagaaaggggccgtttgaaaccatttcaaactctcccgccaaggggtctctctttccccaagggggagatctctcccccatatataaaacagtgtgctgtaggaacgtaatagagacaatttgtggaagtcgcctctcaaattgacgcaggacacgggattcggtggggacaacacctttgtgttggttccccccaggtgttgaaaggtgtgggaacttggggggggatttggggcgggggacccatcccctcggaggctgtggataaagattaccattccagttgggcactctcacaaccacacaaggaagcattgcactccaggagtaggaaaatggctccagtgtgtccccccgtgatgagcaggataatccccaggccccccaaggatagtgagccccaaccttggggaacaaaaaactttctgcttattggcaagtctccaatccattatttcttgaaggagaaaatttcttgttgttaaaaaggagccacatatccatcattcgtggaccccatgtgttcggtcacacttgaaagccgacttggtgtgcacc

SEQ ID NO: 607864 - DNA, 340 bp, Homo sapiens
attcgcggccgcgtcaacagcctctcaaagtgctggaattacaaacatgcaccaccacgcccagcctatgtgggtttttaaaatccattcaagggcgggtgcagtggctcacacctgtaatcccagcattttgggaagccaaggtgggaggatcacttgagcccacgagttcgagaccagcctgggcaacatagtgagaccacatctctacataaaatctaaaaatgagccatgcatggtggtgcacacctgtagtctctgctattcatgacgctgaggcgggatcattgcttgagcccacgagacagattgctgtgagctatgatggcaccactgcatg

SEQ ID NO: 607865 - DNA, 175 bp, Homo sapiens
  misc_feature (15)..(15): n is a, c, g, or t
agcagtggagccttngcccaacagggctgctgctatcatgcgaagaggagatgtgtggcgaagagccaaatttgtgtgagtggtttgtggctgtgtgtgtgaactgtgagtgtgaagtgacacagataacataagttatcattggtaattttatatatatattaacaataaagta

SEQ ID NO: 607866 - DNA, 752 bp, Homo sapiens
catgccaagcaggaggaggaggagccgggactggtctagggttgacccggggcgacggcgccattgcacgtgtcccggacgctggaagtcgtatctaaagctcgagtcacgcgtcagatggcacgtgcaagaagctgtagaacgctaaaggagctacagaacgaggtagagaagcagatgaatatgagtccaccttccaggcgaatgctggcccggtgatcatgtccattggaggagaagactgtgaggcctgattgcccgttccatcgtatgttggcaattgtggactactggtgcagacagcagaatgagctggaatgctcactttcactggctgtgtgttcagtcaaccgttgttacccgtactgtgtgacaaactttagtggccatcccaaagggtatgcgtagtatagagttctcagacaaagaagtcagtgaggacttccttggccttagattgaatccccttatttaccaggaagcgcaatttcaacggtgatcccaataacgaaccaacagaccaggcatcagcacaacagaccggggttttccacgagcccgctacctggcccggagcaccaactacaacagctcccgctctcgattctacagtggtttcaacagcaggccccgggggtcgcgtctacaggggcccgggctagagcgacatcatggtattccccttactaaataaaagtgtgtataggaggagacagaggaacaaacgaggaacgcaggcaacacgacgaatt

SEQ ID NO: 607867 - DNA, 197 bp, Homo sapiens
ggggttttccttttttttaaaatgggggctttccagattaaaaaaaagattgtcccccctaatttgggcccccacttcaaaaggttcccggtttccatggggacttttcccaaaaaactgggcccggggcatttttcctttgggggattaacctttaaattttggggacttttaaaaacccggttggggttttttta

SEQ ID NO: 607868 - DNA, 444 bp, Homo sapiens
ctgtaagcagtccgtggagactccgtgaggcctgatcagggctttaggtggtttttactcactgcagtgtcaacacttctttccccttagccactgcggggtgggcatccggttttgttgcctttagaaaatgctgctctcttcaacatggagaatgactttcttcagtggcctttctagcatcatgtgcaggcttcttccccttttccttaatccttcatcatgatgaaacatgcatataatcactgggtctggctcaacatgatgctgtccgttctgtccatcttctacgggtatcgtaattccattctttttctgacaagatgaaatctccttgtgtatcctttccgcatccttatccatgcatgtgttgatggacgtgtgggctgctcccataatgtacctgttctgagtagtgtttcaataaacatcagtttgcagaca

SEQ ID NO: 607869 - DNA, 445 bp, Homo sapiens
  misc_feature (328)..(328): n is a, c, g, or t
  misc_feature (370)..(370): n is a, c, g, or t
  misc_feature (418)..(418): n is a, c, g, or t
  misc_feature (423)..(423): n is a, c, g, or t
aaaatgctaagaaaaagacaagaatgagctgagagaaggcatgtagccttggtcacctcaactaggaatctgtgtgttgggtgactcaaattttttgccactttgtacacactcatgtcagcgaaataaccatgaaagtgccacgagtgtccattttggggttacaaataaattttagcaagtaggactggactcggtggctcacacctgtaatcccagcactctgggaggccaaggcaggaggatcacttgagcgtggggagttgggagaccagcctgggcagtatgggctttaaccccatctctgttttattttaggaaatacatnttattatgtttaaaaataattttaggcaggtcgggcaagttntgccaaatataggaacccggggggttaattgagggttccagctgttanttttntcccggggtagttaaagggccg

SEQ ID NO: 607870 - DNA, 256 bp, Homo sapiens
aacctggagaggctagaacaccaggaattgaattgaatttgtaggtcaaatgaacctctttcaatgacaagagtaatactcatgaatttgtacaaccctagtgaacgaactagccttacctggcagaactgactcagagcagaagttatgatttggaatttactgcaacgtttgacacagccattatgacatcttacatcgggtgccaaatgtccgcttgaggtatttctcttaaacgtgacactagtgacgaagg

SEQ ID NO: 607871 - DNA, 154 bp, Homo sapiens
  misc_feature (13)..(13): n is a, c, g, or t
ccgtcgcccggancgtggctgactgcgccgcgccgacgccgtgatggctgggctgaagagcccgcgccgctcgacgccctcccggtcgcgggcctgcggatcggcgtgccccggggcctgctgttcaccgagaccgagccgattgtggccgagg

SEQ ID NO: 607872 - DNA, 90 bp, Homo sapiens
tctctagtggaatttttggggaagagcatggcccaggcaagataaatgatgtaagtggagaaacctgtcagcagtgaaggttttaaagga

SEQ ID NO: 607873 - DNA, 297 bp, Homo sapiens
ggaatgtgtttctgtatttgtagacaaccatgtacccatgcaagtaggtgaacattccacagtggctgggtgaccacagcagctgcatgcagacaggactgcccgtgctttgtggggaatcagagaatttccaaacttgtttgtcagacttcggcagatctcatcactgtgatttgtaatccatgctggatgggtgattttgtttatcggtcctgtaccctgttcagcatgcctgagtattttcggctttatgttaataattagggccatccctgtccattgattggattggggaac

SEQ ID NO: 607874 - DNA, 251 bp, Homo sapiens
  misc_feature (1)..(1): n is a, c, g, or t
nagatgccccatacaccttacgcgggctcttgctttgtgggcgagactgaccatgcactgggcggtgtaggctcactgcagcctgcgcctggagggttcggggaattttcctgcctaagcctcccaggtccgctgggataaccagagtgcacaaccacacccccagcattacggcgttgtacatggacacaggatagcaccttgcttttctggctgtggccgaggtggacggggctgaaggaaccctgcca

SEQ ID NO: 607875 - DNA, 102 bp, Homo sapiens
ctgcctgccggcccctcgctctaccccaggcacctgtgcgctcgttttcctgctcggcctgtgctccccctagggctctgatcctgccattgggccagcggg

SEQ ID NO: 607876 - DNA, 906 bp, Homo sapiens
gcctcagtagacactaagtccacaaagagctcaagtgagcctctttgtagatattactcctttgtcatgcactcttgcaggctgtgagtataccacgtcttatagggatgccagaggtatgatttgaatcctgaagatgttgctggcgtatttattctggggctgtagtcgtcgtaatgtgtatttaaacgggctactaggggtgattgaggcatgcgtagtttactagccgtttgaagctgagatacatctggggatagagattcaaggaaaaggtgctgtgggtactaagattttcaatgaggtcttctggaattgtttagcgtggaaatattggtggaatttgcactagatggtggtagccatttatgtggacactggatggcagggtaggaaggaagggggaaggttggataggaagattaaccggatacctgtattctaggaaggaagtgcagtctcaattttctagatggattgaagaattcggggccccaatactcgaaatgcagttttgggcccagtaggttgggaagacattttggggacagtattcttacaaggtcatatatggggcgggtgatacaacgcagtgtaaaatctggagacactatctgggaggtaccagagggagatggtaggccacagagatcggagaagatcgaggaccattcctggagtacctgtggtgaaagggctggctctacttaaaaatgcacataattacagcagagggttgtgggagcgctgtggaccatggaacttagggggtggcacgcgggagcattggtacaccctggaccccacgttcactcgctcaatggaactggtcaactggagaaggcagacacctccagaaaaacgaaaacaaaataggttgcgcccaaaagcagacctcttggccaa

SEQ ID NO: 607877 - DNA, 215 bp, Homo sapiens
cagtgtacacttgctgcgctccctggcttctgtgtgggcccctcaccttacttaccctaggtggtgtcccggtctctgtgggtgatggggaggggcatttgcgtgactgtgtatattggataattgatcataagcagttctaggatggtgtgccttcccggatcctctctggtggtctgtgataccgcatgcagcaaggtttgcctgcctggttt

SEQ ID NO: 607878 - DNA, 138 bp, Homo sapiens
tttattcgagaggagggagcatcagtgccctccaggatatgacttttccctagcctacttttggcattgacttcttcccaagattcaagtcccagtaaaacaacgtttcagcctttagtgtcagtacaggtgctcatt

SEQ ID NO: 607879 - DNA, 1278 bp, Homo sapiens
  misc_feature (421)..(421): n is a, c, g, or t
gttcagcattcgtggtccactacggcgtttgtgctgcattcccgctcgttctttaacatgtaagctttcataatgtacgtgagcccttgatgtcactgacactactgaaggaagatgatgtccttaatattccttgctggcacgtgacctctacttaagatggcaccaagtctttgacgttccagaatgtggataacagctatattcctagtaaggcaggatagatggtgactggcgatcgtatatctactaacatctcatcaacggacctggagacgaaatgcgtacttgcttgggctagcactgttgcacacattgttgccagtttggcaaatgcgcacgtatgcgtgtatgtcgaggagttaattatcgcttctcgagagaatagtacttggcgcatcagggtctggtgcttgaatgnttggcatgctttgcccacgttgggagcccacgtcaccaatagtctggcacgcgttcacctcctggaacgcttcacgtaatcgcatgatcgcaccgcgcatgcctttcctgtggaacgccagctggcttgctgtggttcgtgttgactagatccccgagagggtctagaacaccgaagcctgctcaacagtgaagagcagtcttatttgttaatcgctaaccctacgcatttgcagctgagtgtaacgacagatttctaccttctagcgcttagtagtaggacattgcctagtccccatgtcgtagcaacagaagggatgctcgacgtccaggtggcgtattacatagttggtcgggctgctgggcgttcggggaaaggttctgcgacatgctttggtaacccattttcccgttggaacactccatgggggagggtccatgcccttagaattcctgctaactttcctatcgggaaagatgtcgcttgaaccgaccgactttgtgcccagacacggacacactatgtccaggggcttcgccttggcttggaggtcacatcgcgccagcgtggaccccagacgggagggcgccatattttcaaggcgggttgcacacatttgtgagcgtggtcgttcgcccggacattcccttgaagtttacacgtttccttaactcaagtgcgtagaagacggtttgccagaccttgggttccttgagaggcgctgtttaccgagggtggcccttcttggtgcgctaatttttcagcacaatttcccctaactcgcacagaacttgggagcggctccaggaccttggtcgaccaggaacacacttggggctatggagctccccccaatg

SEQ ID NO: 607880 - DNA, 440 bp, Homo sapiens
acatgccagtcggacccaacaggcatctatacaacactacaaaccaatcagagccaacaggcatctatacaacactacaaaccaacctctgacccaacaggcatctatacaacactacaaaccaatcagacccaacaggcatctatacaacactacaaaccaacctctgacccaacaggtgtctatacaacactacaaaccaatcagacccaacaggcatctatacaacactccacccaacaagagcaggatagatattcttcaacactctgagacagaaaatacggcatgccaataaaataactctcaatacatataaaagacgagaaatcatacaatctatgttttttagccataatggagtgaaataagatatcagtaacaggccaggtatggtagctcatgcttgtaatcccagcactgtgggaggcaaaagtggc

SEQ ID NO: 607881 - DNA, 715 bp, Homo sapiens
gctctaattaaaaaaaaaaaaaaaaaaaattcaagttcagctgatttgttggtaacccgcactaaaaaggtatccatagtatgtttattttttactactgaagtcctaaatttttttgaaaaatgtaaataatcgggggtaaacatttttggaacgatttattcttttgggtgtggctgggggtgtatacattttactgtcttggctgaaactacacggggtggtgtccttcttacaaaacttttgaaattaaaaaaaaaaactcaaattcttcacgtgtcgtggtgaaatcccctttcagtctttctcagatgggctttgacgtggtcctctgtgatttttcatatttacttgtcaaatttactttgggctatcataaataagctccaaagttcccccatttaattttttttaaatttgggtgtatgaggggttccagaatcgtggctttggtcaccactttgggggctttttaatctttccaatcgggcgtattggctgttggcacctttggccaggtcacttaatggcgcctttggtcaatacgggtatgcgactcctgtgtccagaccttgatggtcgggggtttcaacagagcattggtgtcctggttttcacaatcctgtatgattccagagaagggcccatttttgcactgtcttacccatggcatttcccttgtcaccgaattcgggtccttatgggtccccctatc

SEQ ID NO: 607882 - DNA, 896 bp, Homo sapiens
agcggggggcgttcttcgccgccgccagggtagcggtgtagctgcgcagcgtcgcggcgcgctaccgcacccaggttcggcccgctaggcgtctggcagcccggcgccatcttcatcgcagcgccatggccgcagccctgcgcggccgggcagcggcccgggtactgcttgctcctcggccttgccatttgtcccatgctgaccgcgggcccctgccctgggcctggaacgaccctgacagaatgttgctgcgcggatgtaaaagctcttaccctccactatgaccgctatacccactcccgcaggctggatcccatcccacagcttgaaactgtgctcggcagcgcaccagatgcgctctgtgcattcttataccccaaaagctccatcaccagctgtcagcaacaacaaggcccgcgcatgcggtatgcatgctacaagccgggcaatgctaagcacggcaccttaaccactactcgccatacaacacttcggcgaacacacctgtggtgacgcctgtgaaacggctactgagctccctctgacagaccagtactgtactaacgaaggtctcttgctggcctctggagtactaatttacgacttaataccagaacctttgggccctgcacgacaacctgacacgggaggtcctgggaaaaggcagccaccggcctttggccctcttttccctctgacttcatcacttactacacgctggagatccatccgcgccgggcaattccctacgctacccaatgcacgttggcgacctctgacttaacccactcgctgagcaccctccctatgggacaactccgccctcactgcacgcccctactacaacgccacgcccccctgaactggaccacggccacccacattcctcacccccc

SEQ ID NO: 607883 - DNA, 199 bp, Homo sapiens
  misc_feature (83)..(83): n is a, c, g, or t
  misc_feature (196)..(196): n is a, c, g, or t
gggggggggggtaccctcggacagggcgggcggacggagaagaaccacggctacgccggccctaaccttcttcttcttttttntcttgtccctcgtctagttcttcaataccgcttttgcttgaaagtgttccccctttgactctataaccctttcgatttcttttgactagccagtcttctacttgtttaacggngaa

SEQ ID NO: 607884 - DNA, 468 bp, Homo sapiens
gaggatcccctctaacacattaccttactattgatgcttgacgacaggaatcttgctctgtcacccaggctggagatacagtgagcaccatcatgtgcctcacgtagcatccttgacctcctgggattcgatgatcttcctcctcagcctccctgagtgctgggattacaggtgttgaagaactttatttttgtgttctattctgggcatcaatattttaagaaatacgatgctaaccagctagggtgtactcagaggaaggcaccaagtggatctcgagactgaaaactgctcctgcgaggatgaatcagaataactgggcaaagacataagtaaaagtatagctcttgcttctgggagaagaaagcctgagagattatttgatctgaaatcctgactttcaagttgaggaagcaggctcagagagatgtgtcttgggtcacatgaagagagaggagcagactacag

SEQ ID NO: 607885 - DNA, 179 bp, Homo sapiens
gcaacatagtgagccgcctatctaacaaacaaatttttcctacttagacgagtgtgatggtgtgcagctccttgggaggctgaggtgggaggatcaatttagctagggagatcaaggctgcagtgagccataatcatgccactgcactccagcctgggtgacaaagagagaccctgtct

SEQ ID NO: 607886 - DNA, 911 bp, Homo sapiens
tttgggaggctgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaaaaacgcggatgtctaggccaaggaacaataattctggaggcaggggggaatgagtcctttgggtaaaccccacggtctgggggaaagtgagtcccagcggggaaaattggagctttctggccgtgaaacatgtgggagccctttcccgggcattttaaccggggtccctatggaacagaatttgggaaccatttgagaacaacaccgacaaacagctcacccgttgacacaacttgtgacacccagcgccgcgctgcgaacgggggccaccacaccataacatcgaacgcggggacacaaaaggcgcacacaagccgcatagagtgagagaagatcacactccccacaacgagctcaaaaagagagagccgcctcgaccaagaaccgcagtacaccactccgcctacaacccaccaccctaacaccgggccgcgcaccacgccaccacgctaacaatcgcgtcccccaaaacagcgaacaagggcaccacagagacagacgacgccacgagtggctccccccacaacgaccgccccaaccaccacacaaacccgtgacaaacacccacagcgaccaccaccccacaacccagcaacaccatcggggcacaaccccaagcgccccaacttagcgggccaccccaacaacaccg

SEQ ID NO: 607887 - DNA, 337 bp, Homo sapiens
actgatatctctcaaattacaaagactcatcatttccagaagaccctacctcttatattagagtttcagtacctcacccagtgttatgaactaacttggcatgacctctacattatcctctctgccaccctctccccagtaagacgaggaccgtatctagaccccagctcaggtgcatgccaatacaattcatcaccaggctcctgcccagcctactggtgcacaggcagttcccaaccaggaccccactagaaggtccaggtatgccggcatacctggaccttctacccgtcacaaccaccactgcaggcttctgatgctctgttttcctcctctg

SEQ ID NO: 607888 - DNA, 154 bp, Homo sapiens
ccgaggtccccactgctctcaatcgcgctagcgctctgataatttacctgagtaggcctagaaataaacatgctagctatatattccagtactaaccaaaaaaataacccctcgtacaccacagaagctgacatcaagtctttcctcacgcacg

SEQ ID NO: 607889 - DNA, 110 bp, Homo sapiens
tctgcactcatacatcctctctcacggacgttcaaactctactcccactaatagctttttagatgactatctagcaaaccatcgctaaaccggggtatcctctacgagtc

SEQ ID NO: 607890 - DNA, 214 bp, Homo sapiens
ccaggccgaacagatggccgtcgaaggacgcgtcggtgacgttgccgacctgttgctggtcgtggcggatgtcggtgtaggcgctgcgctggatcaggccgctggccggttgccaggtgtagttctcggcgtcgcggtagtcgcggtcgctgccgatgtaatagacgcggctgcgcaccagcgtggccgggttcggcgaccattccgccttcag

SEQ ID NO: 607891 - DNA, 271 bp, Homo sapiens
agatcgtactggagatggggttcaccgggatgccgactgataagttcattgcgagcaccgtctggaagaatgacgccctctgcaaaccccaacatcacccaacccgtgaccagcacgacaccttattcaatcgagaaccaacggaggccctgcagctcccaatggccactgtccagcgggtcaagcggacccactctcagggcggggacgggtcacaggggtacaagtataagtggaagttagacgaggaccggaaaaacgtatgcggccg

SEQ ID NO: 607892 - DNA, 193 bp, Homo sapiens
ggcacgagtacgtggccatccaggagtgctatccctgtatgcttctggccgtaccacaggcattgttctggactctggggatgtgtgtaactcacaatgtgcccatctatgagggctacgtttgccccatgccatcatgcgtctggatctggctggtagggacatcactgactacatcatgaagatcctcact

SEQ ID NO: 607893 - DNA, 292 bp, Homo sapiens
ccgtgtcatgcacacccacagtacgtacacactgcacacaccacatcatgtgcacatgcaccccccacatgcagaagcacacacacggcacacacactatgtacacatgcacacacaccacacaccatgcacgtgcacacaacacacccctcagaacaccacactgcacacacgaccaagacaccacacgcactgcacacaccccacacacactgcacacacaccatgtggcacacgtacacacacaccacacactgcatcacaccatgtccacacgtacacacacaccagg

SEQ ID NO: 607894 - DNA, 459 bp, Homo sapiens
agcacaaggatcaggagagacctagccacctagttgtggccatgtgggggtgaggggcttctaggaaaaccggtgtctggtactctggtctgtgttgattggtgtcatctgtgcggtgcatgctgggcctccatctcccaacctcctccgggacagatacaggcttcgcggggacaaggtcgtgagctgggcatgctggatgagaccgggatccctgtggttttgtgggcaggtgctggttgcatgccggacagacagaaagcagtcccagctcaaggcagaaggccagagggtgtggagtgaaagggacaggcgaagccaggttcggagagatggagggaacaggccaccaagctcagaagcgagaaaggtctgaggaagcacaagacacacacacacacacacacacacacacacacacacacagagagagagagagagagagagagagagaggagg

SEQ ID NO: 607895 - DNA, 818 bp, Homo sapiens
  misc_feature (99)..(99): n is a, c, g, or t
agagagatggggtttcaccatgttggtcaggctggtttgaactcctgaccttgtgatctgctggtcttggcctcccaaagtgctggtgtgtctggaatnggttacttctggtgcgttcttcgtctcactgacttcaagaatgaagccacggaccctcgcgatgcctgggcagatttctgaagtggagcaagagaaatcttctcttcttcacctgcttcagggaggcatcaaagtgccaaaaaggattctcagacggctgatggaaaacgccccggaccctccgtagtgccgcggggaagtccccggaaagggtgtgaaaaagtatcgaatttgggtgatgcctcctcctcgtccagcgcctgacagggcccagctcctggcccaggtgcccaggaggcaccgatccccgcagcggctcctcccgcgcgggctccaatcccatttcggcctcgcccccagagcccatagtctttcatccgtgagtcctgcaggcaggacgggtcggaggtctgcaaacaggaacctctctgggaagccgcgacagcggctgagctcggggtacgggggcgcaggtcgggctagaagcaaaccccttctctccgcgtccgggcatcgtcccagcggcccctcctctgtgcccaggatgctcgggcggcggctgcagtgggacctccaccttctcctgcaagcagaagcggaggaacctgtccgacctcccatccaagcggcgcactgagcggctcttttggctctaaacgaatttccataccgctgcctgaggcaaggctaccgtgggggccaaaccccaactgggagaa

SEQ ID NO: 607896 - DNA, 1238 bp, Homo sapiens
tggggggtactgtggtagatgattaactgactgttttaatattttgtaaataaactcggattccttgtgatccattgtgctagttgttaacccgggtactggaatgtaaagtgaagttcggagctctgaggcacgggctcttcccgccgggatcctccctcctccaggacgcccagaaggggagacggcacgcaaacagcggaccacgactgcagtagtcccgtgcccgggcgacacggagcaagtaccatggagcaggtggagccaaggggaagcactatggcagaaccatcactgcgtgggctgcataatcgtaactgtgagaatcagtgcaacacggtattgacgttgactgcgtgaacactggcaacgtacgtggtagtcacatactcgtgatctcacatggctgtacgacatgctgcctgcatggcaagactctcgcccaagggaccgctcgtcaaaagtcacatccaacatacaagtggcagcttgttgaacgtggacgacgcacgagcagcgagaaggacccccaagggcgtaccgggcgcaactacgcaggcacaggacggaggaccgaggtgcactggcagcgcgacgacaacgcatggacaccacctgggatacagccgggacaccgatggtagccaaccgtggtgtacaaccgagacccttgggctacacacgcgggggcaacgcaccgggctcatcgcccagagcaagggtgaacacgcaaagcgctatcaggccacacccaaatggaccgtcgcccagtgcgaccaaccacaagttacaagacctgcccgggattacaaacggacgcgtaaagctcacaacccgaccaacagacagcccgaccaacggccatcagaggagaaccacacaaacgaattggaccgcacgggagcaatgcgcgcaccaaggaataccaacagtctgtcgagcgctagatccaaaggacacgcagaagaacgttaatgtagggatacccccgataccacagtatggacgccgtggatgggcttagtggctagtacagggaatcgcacaccacaggtaaacttcactccgccaacaagactcctctttaaactcggcggcgcgccaagcaaggcgtttgtcgttgtcttccccgcttcatattcagcttggcactttgcggcatatgatctggtcatcgtacatagcatcggaagtcgcacatattcgggaggatcccctggcaatattctcaccctacc

SEQ ID NO: 607897 - DNA, 858 bp, Homo sapiens
gtgcaccaaaatctcagaaatcaccactgaagaacttttccatgcaaccaaacactacttgttccccaaacactactgaaataaaagtttaaaaaaaatacgtaagaacagacatagggaaaaagaaaaaaaaattcaatgttgaaaaaggtctggagtagtgaatactacagaaactccatagctaactttgactatgaaaaaaaaaaaagggctttcttacccagggtgacctcattttcaaagaattctggctgagtatattcctagggtgggttctctcaggcccagggttctgggatcccttccatgcctccataggagatatacacagccgaattcaccagggtgtcacttagctcctgaggaaacaacacccctttctcaaaacacattggcctcagaaacaaaagtgcctctctaattgcctgagttcagggcaaggtgacacaacagaagaaattgaaacaggtgattatttgggcttttaaattgcaatcaagcgggcagggaggagacagaaaaggaaacaagctggactttatgcactggagccaaaaggcttctcaagatttggcccagagttacacaggcaaggtccaggggtatgggctggggaatttcaactcaagggctgtgggactctgaagctttggggtttgggttttttttcctccattacacagtactgcatgccatgtgagcaagatcccgacacagaattgaagtacccagtatctttaaggcaaacaagcagatcagtagaatctgatgattccaggcccaaagacaagaataatttaatggcaatccctcattaccacagcattggccactggcctcatatgggtaaggaca

SEQ ID NO: 607898 - DNA, 603 bp, Homo sapiens
  misc_feature (476)..(476): n is a, c, g, or t
gtgcgtccaatacgtggatctgcctggtgatttttcgaggaatgaatcatggtcatgttcaatacgaggcttccagtagccgaaattttcggcacgatgggttcaaggacctggcagataaagtcgacaaattcactcgccgtggggttgccatacgctcgagaaattctcagggggaatgggggggacgtcaggacgagttcaatcggctcatagagcccggccaatgcgtctggagacgttcccgacaaggccagtccgaggttggtgctgaacccaagcagggtgacgccgggcgagggcgtgttcaggccctttttagccttttcggtaagctgccatacccctctggcaccttcgacccgctcaagcactccaagtgctttgagcgactgctgttgccagcggatcgaccgccgagttgtggagtgcaaatcgccggcggcgccgatcgggctccgagcgttcatcacatngtcaggaatctcggtaaccggccagcaaacacacctttctgaccccaccgccaaaggcgatggtgtccacctatttaagtggacaccacttctagccttttaagagggtctttcatgcagccacaag

SEQ ID NO: 607899 - DNA, 200 bp, Homo sapiens
cgtggtatagctgctggaatgtcggcaggtcaacgagcacagatggaggggcgcagtcaggccccgtgcccaatgtccctgcagaatgcagaggcgggatgctggagcgcctggtcagcgagctgagtccaatgaactacatcgggctggatgactttgtggagatcactaagaagtaggccaagggggtaccgagctcg

SEQ ID NO: 607900 - DNA, 171 bp, Homo sapiens
ccgtggtggacaggggctgggcgctgggggcagacgtggcatccccactcctgtccagttcacgctgttttgtaaccactttctaagcatttttatattcacaacttggaaaccaacaaatgttaattggcgcctcaacaagggcacaacaaagtttcacacaccaaccaa

SEQ ID NO: 607901 - DNA, 257 bp, Homo sapiens
agagagttgaaggtgagacatggcatagatcctactatagtccgctcgccgtacatgagcgcgtgttgagcgagaggcgcgctcgggccgaacagctctagctctctcggatccgctgaggctactggcatgacagagcttagaagacatgaggcaagagagagcccagatgccatgagagtatcgactgcactcaagagatactctatgaggaagaggcgttctcacacatcaccggtgacgcgcatgaagacccg

SEQ ID NO: 607902 - DNA, 533 bp, Homo sapiens
attttctccgcgttccgcaatttttggccccgccctctcgcttacccggtctccaatagcgctccatcccctttcttaagctccatggcgtatgcccgccctgtggatctcaggcccattggccctcccttctgtggccccatctgttctcccccagatttcctcccccgctcagagggagggttgtcaccaagcgcaccacccctgttgcccagataagagaagcctttataggaactgatcccacgaaggagctctcaccctatggcgtctgaaactcgccaggatgctgaaattgcaaagcttgatggaagaccttggacccggcaccaggaccgccggaggtgaacattcccacggagtatgtccacccttccctgggcggcccttggcctttgatcttcaaccaaggaccctcaagggctgtaaattaattgggaaaatggagaaccaccctttgggggtcctttttgagtcacaaacccatggggggtaattgtcaccaaaaaattttttttgggtcagaaatttta

SEQ ID NO: 607903 - DNA, 101 bp, Homo sapiens
cactctttcttcagcttcatccgtcatcccctcttcgtcaatatcttctaatccgttcctcctcttcagtcatcgatcatcatcttcttctccttctcctt

SEQ ID NO: 607904 - DNA, 318 bp, Homo sapiens
gtcccaatggatgacatacagattcgcgtagtcgcagtacccagagattttccatctcgttgttctctggatccttagatcctgatggcctgcggctctgtgttttctgagggatcaccacttattgagcaagaggatagcagtccatcccatgacagaagcagaccggtttcagcctccagtactggggatttgccaaaagcaaaaacccgggcagctgacttgttggtgaatcccctggatccgcggaatgcagataaaattagagtaaaaattgctgacctgggaaatgcttgttgggtgcataaacacttcacg

SEQ ID NO: 607905 - DNA, 228 bp, Homo sapiens
ctgcggaatagctgggtgatcttgacccagtcgatgggcaggtggcgcagatttcaggctggaatagccgcagccgaagtcgtccagcgccacgccgatcccttggcacgcagcgtgttcaggatcttcacgtgccgctcgtagtgcaggatgaagatcgactcggtgatctccagcaccagcttgcgcggcgccagcttggtcgaggccagcacgtcggaaaccagt

SEQ ID NO: 607906 - DNA, 141 bp, Homo sapiens
gccggccgccaaagtggctttccatatccgggtgcgctccaccccttccacgtcatccgcatcacacatgttgtcctgtgcagggctgacagtcaacagcatgcagtgcttgaagccagcactgtgtcagtatgcagtata

SEQ ID NO: 607907 - DNA, 227 bp, Homo sapiens
catcgagccggtaccacagattttgccttattctgtaggttgtctgttcactctgtgattgtttcctttgctgtgcagaagcagctttttcatttgatgccatgtttgtttatttttgcttttgttgcctgagctttgtgggtcatatttttaaaaaaattaagatatagtttacattcagtaagtttcacaccatttatgtatattattttgggaactttgacaga

SEQ ID NO: 607908 - DNA, 100 bp, Homo sapiens
  misc_feature (79)..(79): n is a, c, g, or t
  misc_feature (85)..(85): n is a, c, g, or t
gcaaacccactccaccttactatcagacacccttagacaaaccatatagccagatagtgtataggcgataagagattgnaacctnacacattagatatag

SEQ ID NO: 607909 - DNA, 104 bp, Homo sapiens
tctatgatggtcaggaaatccaaaaaagaagtagaccatatcaaacaacttctttggattcccgcctccttatgctgctctttaggtgaaactataaatatgtg

SEQ ID NO: 607910 - DNA, 335 bp, Homo sapiens
ggattataggtgtgagttatggtgttgggttaaaaatagtattaaaggttatttctatgaataaatgggtagactgtatatgtgtaggtttattaatcttattaactttaatataaggtctaatataagtaacttgacttgaatatagcttctagctctttagaaatagtagcttaagagttttaatagatacttactttgtggctcttgttttaagaaaggacaactaactctgtcaagacagactcaccaacaaagttgaaccaccattactacagagctgtccagggcacacaactctgaaggtgacatgaccctccaaatccaaatttact

SEQ ID NO: 607911 - DNA, 326 bp, Homo sapiens
  misc_feature (315)..(315): n is a, c, g, or t
  misc_feature (323)..(323): n is a, c, g, or t
tgggcttcacgggctttttcttccgccgcacgctgtgagggcagcttaataccgtaagacgccagttcacgacgagttggcacgcggatacgtttcggtcgtggcaactgcggaccaatcccctctttgacctgaggacgcggtccaccgctatttgccagactgaagactggcgcggcaacggttgcggcagccccgtcgccagtgtcgcttttttcacgccagatgccagcggggaaacagcggcagggcttctactggaggtactgctgcaacagaaggtgctttcagcgaagttttgatcggttctggttntttaaccngtt

SEQ ID NO: 607912 - DNA, 240 bp, Homo sapiens
gagggtcagtgtctgagcgaggtctttctaggtcaccactctgtgacgagagggtataacgaggtttggtaacgcctggacttattcttcaaagagccgaagaaaacgggctgagtgtggaaacaaacagggtagcccgctaagaactgcaatgtgtcattattgttcattagtttgtatctgagccattttcagtgtgccgctggcaaaatctcttggaccaaggagggtcgacacatg

SEQ ID NO: 607913 - DNA, 426 bp, Homo sapiens
gacaccgcacgctatccggtcaatttctacatgtcacagatactgacaaccttcataaatcttttaatatgccagtttctaccttaaaaagctccttctgggccaagcgcagtcgctcacgcctgtaatcccagcactttgggaggccaaagtgggcgaatcaccagaggttgggagtttgagaccagcctcaccaacatggagaaaccctgtctctactaaaaatgcaaaattagctgggcgtggtggcgcatgcctgtagtcccagctacttgggaggctgaggcaggagaatcgcctgaacccgggaggcggaggttgcgttgagctgaaattgcaccattgccctccagcctgggcagcaagagtgaaagtctgtctcaaaaaaagaaaaggctaagatagttcattgaaccggatagcttg

SEQ ID NO: 607914 - DNA, 1175 bp, Homo sapiens
  misc_feature (338)..(338): n is a, c, g, or t
gctgtggctgttgaagtaggggttctggatagcagaggttgatctcttgactagaccggggtaggccacgtggaggtaatctgtgacgtttggctcgtcatagaacacggaccatcctggacagctgcggcacgtcatgtgcatgtactgatctatcggtggcctggcctcgaaccgaaaaagcaaatgcggcgctaaggaagaggccgggtgctaagcagtgtgcacagagcgggtggtgggcagctcgtagtgtgagcttcttgggatttacgtgcatatgctcgtaggcagatgcatgtgttctgtgagtacccacagtatgcagtgagtccccntgtttgtcgaggaaatcagggggacacggaccatcaatctactcgtggacttgaggcgagaccatggacgactccttcaatcgaacaagactatgatagagacagttgtgtcactctggcggtagaaccctttactgcatgtactgagtgctgacgctagtatcccaagcggtggaaccaggagatttatcgaagttgtctgacattgaggatggtcgcccgaatatgagggccccattctggttgaatgcaaatgagacgggtcttgtgtcatgtcctttgacattgagggtgatcgatgacaagaatgagatgggatcgcattgtgtcaacgaagacattggaatttcccaacgtggaattcaacgctgtaaagagacctagacacgacgactacttgggaaagaaaaatttgttgacatggaaaagttgcatccacaacttttaacgtgttaaaacgaaaaacaatttggagctaagccacgatcccaagaaacccacggaaaacgacggcgaagaattgatgtgcacaacattttcctgagatttggaccacatgaggtcgaaccaaactcgagttgtggctggagaacgccatacaagtaggactagacccatttgaacctagtggtggtactaaaccggagcatcgcaacaatgatgcagcactcgatacagtgtctcgggatcatagtagcccgcagagggtaatccacacgccaagactgcgtcagaatatggagagatagaaaatacaaaaccacgcaacaggtcgagtcaaagcctgaatagcggccctttgactacaatacgctattaccaatacatgtgtacgag

SEQ ID NO: 607915 - DNA, 168 bp, Homo sapiens
  misc_feature (136)..(136): n is a, c, g, or t
gaggatcctgtaggtctcttcctcaacatcccaagcagctgggaccacaggtgcacaccatcacgcccagtactttttttattttttatttttactatttgtagagacgggcgtctccctatgttacccaggctgntcttgaagtcctgggctcaagcaatgctcctg

SEQ ID NO: 607916 - DNA, 288 bp, Homo sapiens
agattctgggggtcagaggggagaactaaggggactggggtggtcagagcggctgggtttctcctcctgaagccatgtggagactcagatctgggagacctgggcccctaagcgagcggggtgatgtccaacatccttccccaattaccttaagacaggcacacaggtaggggtggggataagtacctgacacttgggacaatgttggcccagagcagagttcccagggggtgggcagcaggtggggagggaaagggctcttgccttgatcccagtttgctcagaggg

SEQ ID NO: 607917 - DNA, 124 bp, Homo sapiens
aaaaagttttgttttttaaaaaaaatgaattacctgtttcctgaaaaattttgagggtaaaatgttagttttcataaaacattgaaaggcccccgcccctttcaataaaaacctggcttggaga

SEQ ID NO: 607918 - DNA, 343 bp, Homo sapiens
tcaggtgtgatgaggcaggatgagaagctcaggtggtgtctccattgaggcagggggctgtgaggggctaggggttgactccgagacccccgcgatccttggagaaagctgcaggctctggacagcatccctcagctgagcctgagttctctccatctcatttaggcggtgctccaggtttttcagactgtgcccttcattgcttgttaggttgtgctctgaatcaaactctgagctcccagcacggagcctggagtccagatcctgcagctggccccgcagctgctcctgctgctccgtcgaggcccggatttgggtgctcagcgactccaacgagggcgat

SEQ ID NO: 607919 - DNA, 232 bp, Homo sapiens
ggaaaccccgggttttatatttttttttcttttagccacacaggacaaaaaaaaaggggccaattcgtgggatttttgtttagggatttatttcctccccgtttgatttattttaattgttgaaacttaagttgtcaaccagtaaccctaacgggttttttttttaaaatatttccgcttaaagttatgtttttaaatggggaagggtaaaaaaaaatttggtgttttccca

SEQ ID NO: 607920 - DNA, 615 bp, Homo sapiens
gctcagagctgactcttgagtatccccggtagttgagcaatacaaggaacaggagttatagatgaggatgtagagaaactgtaaccctcctatactgggaacctagatggacgctggtactaaccactttggaagacagtctgataggacctcaaaaagttaaagatagcaataactgtatgactcagcaatttcattgctaagtatatctgccagggaaatgcacatgtatgtccatgcaaaaacctgtacatggttcacagaggcgtacaagtaatagtcacaaaaagtagaaaggacccaaatgtctacttactgatgaatggaaaaactaaaatgtggtatatctatacaatgaaatatcatttggtaataaaaatgaagtactgatacatgttgcaatatgtatgaaccttgacattatgctaagtgacagaagccagtcacaaaagaccacgttatcatttcctttatatgacctatccaaataggtcaactgtatgcaacagaaagtagatcagtagttacttaggactagggtagttggaggggtgctagcttacaggtaccggtttacttaacgaggtgaccaaacatgtttaaactcaactgtgt

SEQ ID NO: 607921 - DNA, 946 bp, Homo sapiens
  misc_feature (125)..(125): n is a, c, g, or t
ataccagctacttgagaggctgaggcaggagaatcgcttgaacccgagagatggaagttgcggtaagctgagatcacgccactgcactccagcctgggcaaacaagaacgaagactcccatctcnaaaaaaaaaaaaaaaaggaattaatatgggcgtttacacttttaattttttaatggattactacaccttggtgtaattatcaacacctttaaaatatccaaaacccctttttatcttaaacatctggccccttttccttattaaattagagttcatcaagacagatgggttttaatatcatatacctcccacggtgggtccaatttggcaccttaatcttaatcgggaattggaattccagcaaaaaaggtccggcccccaaggatgattgatgggacaaggttcacgcggggcacatactcacccaggaactatttcatggcgggtgcggtaaacccctttatatgggctattataaatccccttaagataaacctcctttggtattttccttaaatcaagtcattccctaaaattatcactctcatatctagcaagtagtggcccagtgccaggcttgtggcccacacgtgcgggttaaaagaatactctcttccacagggggggcaacaggctcagctctccttaaaagtttccacataaaactttgcacacctttaaatagttaaaaggtcccaaagaaatccaagaatcggaacaattgtgtgtctccctccattggcggccactaaaccctgcaaatactttaattttaaaattattcctccgagctaattcacaggtgcgactaaacaaggggattctaaaccagccccggtctggtcccatggttgccgtcactatgaggacggttccacacaggttacgcatgtcgacgcagcacaataccggttgaagatcgagcgttaaagcgaaagcgc

SEQ ID NO: 607922 - DNA, 1248 bp, Homo sapiens
  misc_feature (389)..(389): n is a, c, g, or t
gcaggctggagtgcagtggcacgatctcggctcactgcaagctccgcttcccgggttcacgccattctcctgcttctgcctcccaagtggctgggactgcaggcgcatgccaccacgcccagctaatttttttttttttttggttttttaaggggtgatgaggtttccccgtgtgggccaggatggtcttgactctccgtgacttgtggtgactccgcccgccttcggccttcccaaagtgtgcgtgggatttacagacgttgagcccatgtgcgcacgagccttacttagtctttactttggagttttctaccacgaggcgtgactcatctctgctgagaagtgctagtggatttttaaggacccttaatttcaaataattcctcgtntccactagagctatttactgccagtcacagggagggtctacactagacccccagcgtgctaattacccccaatttttctgactagcacgctacacctcttccataattagcgcgggcatagatttaaaaggctcccctatcttgcgagacattacttccggggggaccccaccacgtggatctttaccatttcattctctaaagcattgcgcaccgcgacgacgcgctttatatttccccaccacgacaggggccccccgatataacgctcgggaaccgcctgtgctccgcctttaaacagcgaacatccacctctgctgtccacacaacagcgtccagttaacaacctattacccgggaaagagcaccccccacttcccattaggacccggatgggaaccacaaaccacctctccgaggccacaaacactgtcggtcaaccaccggggggtggcgacacacttcacgagcggcaacgttgcttccactagacgcagccgcggcgtacccctctgcgtccgccagcctgagtcaacggcgctacacacgcatctgcacacacaatattactccagcaccttcccgcccatatatatcgccccccacagtgtgcatctacccccactcttgtgcccccctacaactgttttacgccacaatacggggcaaccatcgcgacgggacggctcactaatgagcaacattgtgccacctcgttatggaagtcagaccacgaacctccctatctatctcagcaatacaatcatatccaccacagacacctcccccgcagcacggtcccatcagcgaccctgcacccgacgcgcgcatcccgccggtctctcgaccaccacgtgca

SEQ ID NO: 607923 - DNA, 1723 bp, Homo sapiens
  misc_feature (869)..(870): n is a, c, g, or t
tgcggtggcttatgcctgtaatcccagcactttgggaggctgaggtggggtggatcacttgaggtcaggagttcgagaccagcctggccaacatggtgaaaccctgtttccactaaaaatacaaaaaaaaaaaaaaaaacgcgggggtgcgggggggcatggccggtaaccgcagctactggggaggctgaggcgggagaactcccttggacccggggaggggcgggtggcagggatctggagactcacacaatgggcgaccccagccgtggggcagacaggagtggaacctcaaaaaacaaaagggaggcccacgtcaaggggcgattcacggtccttggaccctggtggtgcgcacccgatcaaccaacaaatcaatctccaaaaatttcaatcacacaaaatcttggaaccggggtgcccccctattataaacggtaaacctctccattgttcccctccaccagccctgggtgagcccttatccaatacggggctctattaataccctcagggaaatctcacataagtgaaactcatacagatatgtaatccacgcggggggacgggtaaatacaactaaggaatgattcctcaagtgccctccaaggttgcagcctagtgttcagacttccgtcccgttggaaggcgggacaaaattcacgggtgtgtgtgcacacattttgcgcatacggtcacagaagggcacccgatggtcccctcgggcatggccaacgtggggcagcgggtacacaacacttagccggcccacagtgggttcagacggacaaaaaggagggcgcagcgacgcagcaacacaaacatggggcggaacaagatggcaacatatcaacaatcatgcactcgcnnagccagcgcatgtagtcgatcgtgcaggtgccctggcgtgactgcagtgttctctcgtggacgcaaggcgtatggtagccaggcgcgtcgacgagtgtcctagctcaacgcgcgagagtaaggcgtcggcagtgagaggcagtagagttaagtgcgagcacaggacagaagcagtcgaactcatcagataaggtaccgatgatcaaccagcggaggaggcaagagaacgcgcgagcgatgagcgcgagcgtcactcgtagcgtcgaccaagcggcgtcagtagccgtcacaggcgatgacgccgcgagaccgcgcagcgtgggctgtcggcggcgcagaccacgggcagtcggcagacgcgcacgcccggcggcgagagacgaacgagtaaacagagagaagagagcgtgacgtgagggcgacggcggcacgaggtagcgacgagaacaggtacagtgggcgaacggacaagggagcggacagacgacgcggcgaggcgacggcgggcggcgtggcgactacacaccgctgcagcgcgcaccgatgaagccagccgcagtcgacgtagaatctacggactgcgcggtaacgcgagctggagagcgtgcgcctacagcgcgatgacggacggcagtcgaccggggcaggacgaccgacgaacgcagccgcagcgagcgctgcgacgtgatgagctgtagtcggcggaggtacagcgcagagatagccacctagcacgcaacctaggcaaacagacacgacaaccaaaacacgaacacgtctgccagcactgaaacacacgcgaactagtgagaggagggaaccaggtgcgaccgggaggaggcaggtacgcgct

SEQ ID NO: 607924 - DNA, 257 bp, Homo sapiens
ctgacgtccttacggtggcgtgacccgatctacatgtgtgagatgactgagatggaagcaggcggtgctggaggtgctggtggcctgttgagtgggccaggcctgtagcattccaggcaagcatccttctgcccgggttttacttggaatgccccatgcctgtgggcgggcagccgattaagcagcaggcgaatgagctgaacccagcaggtcatcgtgctccagcctgtactctctttagcctttctcttccagaa

SEQ ID NO: 607925 - DNA, 1750 bp, Homo sapiens
  misc_feature (88)..(88): n is a, c, g, or t
ggtcagaagaaagggatgaccgaattctacttcaccagaatgtaggatcgcagcttatactaattgtcgcacgcgctccgttgctctncgaggtaccaccacgaagaacacagaatgactgacgagcagactcgagacttatactcctaaggacaggtcttcataccatcgcaggtgcccgtacattctcacacgctttaactaatatagctgcatatggcgtctctcccagattatgctttcccgagtatcgtccatgctttcttcgacctagttatacaatcctgtccgttaccctgtgtgttctacgcgtatagtttcttgcgtcggttcttgtctcatacgtgaggagcagggctacaagtagtggtaaagagtcaagagtgtaaggtactcaagtgagagcggccgtgctgcatacacaccaagcacgcgtccttttgtgccaacttaggtactcgtgtggtacctattgcgaaggagaagatctaatcgatagttaggagactagttagtgggggtgtcgacaaataatcgcgttagataaagacaacggggcattcgaccattgggacacggctatgtggtttgatctttaagaagaaccaacaagtctctcttgcaccaaaaggatcttccttcgaaagaacctacattggggaccttgtgcctattgatactatagagaagacacaagataattgcgcaaatggaaatatgagtaaacttgaacctaagcactgcggatttggcattgttgcctctatccattcgctcaggttgagtctccttgtagacccttagttagtgtataagcctgtaccatattgacgaatagcctggggatcattctcctacatatggctccggtcctttagtggaaaagcataatccgtctttgaccaaggggtgccactaattacacttattgggtgttggccattgttaccccagagggattacatcgtgccgataaaaaagattcattggaagccctggggaacggaaataggttccccttaagaaatttgcggggtttacgtacgcaacaaattctttacctgtcgaatgaaatgtccaaggcggacgcagtgtggaaacacagaactccgttcggcatgaatgcctttctggccgaagacattttccccacgtgtgggattggactcacacccggcgtacactcacccattggcatctacttcagttttgtggggagtcggaacaactcttggggggggccggacatgggcgcaaattacagttggggcgcgcagagtgtgtggagaagcgaacaaccgtggacattgtggtggtggggaccaaacacaacactcgggtcaccgcacagattactacgggcgcaagaaagtgggccgctggaaccccagcaaaaactaccgagaatgctcgggggtggaaaccaaggggggaccaaagtgtgggggatcaagccccccgggggtggccacacacgcgggggggtattcccaccagagaaaaatggggaaacatgcaacgatgtagccccactgaggaggaagggggggaggagacaaccccgcgacgggagccataacaccactggccagtcatgaggaggcataaaaaaaccaacgacacacgacacatcgcgatgaaacaacagcgaggaggaccacagcagaccgcaaaggtcaacaacaagcgagcggagaaaatccaccggacgaggatgtgatagatacaacatgaacacgcacaacagaga

SEQ ID NO: 607926 - DNA, 149 bp, Homo sapiens
gtgcagttatcattaaggataacctcctgaacaagagcttagtgacacaatcctacctatatctgaagaatcaagagtgagtgcctggtgtccttagatttgcaaggagtgtttctagaacaccaccctatgctcactccatacaaaga

SEQ ID NO: 607927 - DNA, 162 bp, Homo sapiens
aggcggtctagaggatcccgcgtgatccgtacaaatcgacgggacagatactcagctacaagatgggcaagaaatgcagaatgcttaaaggctgaatgtaggattcttttttaaacagtaaaatgtcattaggatagatcactctctcaccaacattaaatg

SEQ ID NO: 607928 - DNA, 230 bp, Homo sapiens
tctgtgtcgagactattgcctaatatgggcgagtttgcggctcatcagcgcctttacgacctacggggaagctgggacctagacagatgacagagtcttggaggccatcaccaggaccaggcacccagagtgtgccagagtacctactgaagagtaggactttatggacacatgtggagaacggttattacaacaatttactttgtggtgagagtagcgagtagattact

SEQ ID NO: 607929 - DNA, 168 bp, Homo sapiens
tatagtcttacacgctgggaatccatagtactagcaaatattaactcattcctttttttctgagacgggtctcactctttttagcccaggctggaaggcagtggcgcaatcggctcactgcaacctccgcctgctgggttcaagcgattctcctggatgaggccctgg

SEQ ID NO: 607930 - DNA, 712 bp, Homo sapiens
  misc_feature (18)..(19): n is a, c, g, or t
  misc_feature (64)..(64): n is a, c, g, or t
  misc_feature (119)..(119): n is a, c, g, or t
  misc_feature (127)..(127): n is a, c, g, or t
gcgttctagaggatcccnnatatgcgtctcaaaaaccctctatttttactagttcactagcagngtagtgtcggggccactttttctttaattttttttggtgacagttttaggctacngagatccnggaggtcatggtcatcacagtgaagctaagactggttttttttcagacagtatgtattttttagttggtagtttcttgaactcactgggcactgtgtgggttgacttaagattgagtaattcatgccatggctgtttaatttggtgacaagctggctatgatcagagaacaaactgttaggaagtggtccagttttaagtttgcgtgagtatataagtggagtattttgggttcattcatctcttgccagtcttagttgttaagtaatcttcttgcattcatatttacatcatcctcagaatcttgtgtttctgccactctcataaaaactgactctggtttttaaggtagagcttcatgcttggaattaaccaggaaaaacctcatttatatctccagcaagagggacagagggcctgcactgtgtacttgctgccagaagtttttatagtaatactttgtatctaggctctggctcttaccattaaatgtgctttttatagagtaccaagttataaatgtagtgcagctacggcatattaatcttactgcagagatttaatgatacagcatttcaggtccgcc

SEQ ID NO: 607931 - DNA, 494 bp, Homo sapiens
  misc_feature (9)..(9): n is a, c, g, or t
  misc_feature (22)..(22): n is a, c, g, or t
  misc_feature (31)..(31): n is a, c, g, or t
  misc_feature (117)..(117): n is a, c, g, or t
  misc_feature (478)..(478): n is a, c, g, or t
actgacctnccacaatggttgnaattaatgntacacttaccatgcaagagtgtatttgtgttccctttctctgcaacctcaccagcatatgttattttttggcttttaaataatggnccattctgactggtgtgggatggttatctcattgtgggtttgatttgcatttctctaatgatcactgatattgtgcttttttcatatgcttgttggtctgcatgtatgtcttcttttgagaagtgtctgttcatgtcctttgcccactttttgatggggttgtttttctcttgtaaatttaaattctttataggtgctggatattagacctttgtcacatgcatagtttgcaaaaatttactcccattctgtaagttgtcttgtttactctgttgaaagtttcttttcctgtgcagatgctcttaagttaattagatcccacttgtcaattttgctttcggagcgattcttttggtgctgncatgaaatttttgcct

SEQ ID NO: 607932 - DNA, 318 bp, Homo sapiens
  misc_feature (130)..(130): n is a, c, g, or t
  misc_feature (140)..(140): n is a, c, g, or t
gtacccccccccccccgcacggggctggttagggaaaggggcccgataaaattttgggaaaaaaaggaggggtcctccccagggtttttgaaaaaaaacccccgacccaagcccttttttttgccccccnggccccccangggggttatttttgggggggaaaaaagttttttcctggtttttccaaaaacccccttcccccccccagccaagggggggttttaaaattggggggcggccccccccggtcccccaaaaagtcttttttagggggtttttgtgggtggggaaaaaaaccccgggtttctttcctgggga

SEQ ID NO: 607933 - DNA, 254 bp, Homo sapiens
ggatcttctgtcaggaaggtagactaaggggcacgtccacctggaccaggaagtcgtctcgtgtacagtactacattatcgtacaaatacttcaagcataggagtactgtgattagatgggttaaccctgtaaataaaattctatacattccatatttgggttcagtgtctatatttaattagttttagtctgaaccaaagcaagttctactattctcatccgctacgtaccctgaaagtatcacatacggatc

SEQ ID NO: 607934 - DNA, 377 bp, Homo sapiens
cacccgttatgtgctgaaccaccggcgcagtattctgggagattaatgaaaagtttcagtctaccaggacaaaagctctgtatccgccatattactacaataggcatagcgggccctatgtttgctctgtgcgtaacttagccactggcaaggaaagctccaaatccatgacaggcgaagtctctgactggacagtgcccggaattctactagtgcctccaattccattttctcccatggaatcactaagagcaagacccactctgttccagaagccctataagctggaggtggacaactcaatgtaaatttcatgggaaaacccttgtacgtgaagcatgagccactcagaacataagggtgggtcagaacagaag

SEQ ID NO: 607935 - DNA, 377 bp, Homo sapiens
aatcattacgcattgctgatcatagctccacttcgaaattgtacgggttactgtattataaatgttggatacgtgtaattccagcatactgggaggctgaggtgggaggaagcagcactaaaagcactctgaatcaagatgagtgagaaaccatctcaataaacacattttggattacaaaaaaaattaaaacaattagccgggcatggtggcatgcacctgtcgtcccagctactctggaggctaaggtgggaggatcgcttgaacctcggagctcaaggttccagtgcgctatgatcacttcactgcattccagcctgggtgcccatagccctatcctgtcggtcgtcacttttctctgcattttacaaatgaac

SEQ ID NO: 607936 - DNA, 172 bp, Homo sapiens
ctttgggcaaggtggacttttaatgtttattatttttttttcccccccaagttaagggcctaattttgggtattctgggggctgctttcctggggtggttaaattttaaccaaaacttttgtcaccgttggaagggtttactttgctggaaaactttttagggcccttggga

SEQ ID NO: 607937 - DNA, 319 bp, Homo sapiens
gaacaaatacagcgcagcacagactgacgatgaactgcggaaatgcgcggtagtacaacagagcgagggcgggtctcacatcatccagaggatgtatggctgcgacctggggcccgacgggcgcctcctccgcgggcatgaccagttagcctacgacggcaaggattacatcgccctgaacgaggacctgcgctcctggaccgccgcggacacggcggctcagatcacccagcgcaagtgggaggcggcccgtgaggcggagcagctgagagcctacctggagggcacgtgcgtggagtggctccgcagatacctggag

SEQ ID NO: 607938 - DNA, 161 bp, Homo sapiens
gcctcagaccacaccagacgtgtttctagctgtactagagaagatctgggctgtttataaatatagcatctcacatagcccagttcatcaccatttctccttaccttcagtcagttttttcacattgggctgtggtccaactttgggacacggacttcagt

SEQ ID NO: 607939 - DNA, 824 bp, Homo sapiens
  misc_feature (208)..(208): n is a, c, g, or t
  misc_feature (217)..(217): n is a, c, g, or t
  misc_feature (219)..(219): n is a, c, g, or t
  misc_feature (223)..(223): n is a, c, g, or t
  misc_feature (225)..(225): n is a, c, g, or t
  misc_feature (229)..(229): n is a, c, g, or t
  misc_feature (232)..(232): n is a, c, g, or t
  misc_feature (234)..(234): n is a, c, g, or t
  misc_feature (284)..(284): n is a, c, g, or t
  misc_feature (287)..(287): n is a, c, g, or t
  misc_feature (289)..(289): n is a, c, g, or t
  misc_feature (291)..(291): n is a, c, g, or t
  misc_feature (294)..(294): n is a, c, g, or t
  misc_feature (300)..(300): n is a, c, g, or t
  misc_feature (307)..(309): n is a, c, g, or t
  misc_feature (311)..(311): n is a, c, g, or t
  misc_feature (317)..(317): n is a, c, g, or t
  misc_feature (319)..(319): n is a, c, g, or t
  misc_feature (324)..(324): n is a, c, g, or t
  misc_feature (326)..(328): n is a, c, g, or t
  misc_feature (334)..(334): n is a, c, g, or t
  misc_feature (340)..(340): n is a, c, g, or t
  misc_feature (345)..(345): n is a, c, g, or t
  misc_feature (347)..(347): n is a, c, g, or t
  misc_feature (350)..(350): n is a, c, g, or t
  misc_feature (355)..(355): n is a, c, g, or t
  misc_feature (361)..(361): n is a, c, g, or t
  misc_feature (372)..(372): n is a, c, g, or t
  misc_feature (384)..(384): n is a, c, g, or t
  misc_feature (386)..(386): n is a, c, g, or t
  misc_feature (391)..(392): n is a, c, g, or t
  misc_feature (401)..(401): n is a, c, g, or t
  misc_feature (403)..(403): n is a, c, g, or t
  misc_feature (407)..(407): n is a, c, g, or t
  misc_feature (418)..(418): n is a, c, g, or t
  misc_feature (429)..(430): n is a, c, g, or t
  misc_feature (432)..(432): n is a, c, g, or t
  misc_feature (442)..(442): n is a, c, g, or t
  misc_feature (450)..(450): n is a, c, g, or t
  misc_feature (456)..(456): n is a, c, g, or t
  misc_feature (471)..(471): n is a, c, g, or t
  misc_feature (475)..(475): n is a, c, g, or t
  misc_feature (490)..(490): n is a, c, g, or t
  misc_feature (493)..(493): n is a, c, g, or t
  misc_feature (751)..(751): n is a, c, g, or t
  misc_feature (757)..(757): n is a, c, g, or t
  misc_feature (767)..(767): n is a, c, g, or t
caaaaattagaaggcgagtgctgagaagacttgtcacaggtttctcaaatcagaatatactcagtcatagtggttccctgggaagccccagaccctttgacttgtgacattactggtttgcagacataataactacactcagaggaccatggaggcagagggatcatggtttcagggcactgaaaactctacgatccaagaggactantgcatggantnaaantnaggnatncnctcaaataggctgtattttctttccaggaacgtaacctttcccctttttnttntnanctnagccangattggnnntnagaaantntcctntnnntggagntgaagntgggntnctnttttncgaatnttttccatttnataggcgccacntnctttnncggggtttntnttgntaagacacccnaattttcattnntnagaaaggcanctgaattntttttngtgaaatttttttanattntttttaagttatttnttntttttgtattaagttttcagttgtttctctcttttctccctcatttcatggaggtgttaatgatcatggctggccgtgatgtacacatgggctgattttcattttttcagtttcatagctgagaaattcagctttgttttagttgaatcatcatattggaaagcagacattgaaagttttcttttctatctttgttatgaatgtgctatggccccttttggagacttctattgggtaatattctatgtgagagaaggnaacttngtattaaatnttgtggaaaataataatgatgataataataaagtatatgctgcaatggtgtactgcc

SEQ ID NO: 607940 - DNA, 444 bp, Homo sapiens
aatgagtttgctggatgtttaaagaactaagagaatgaattgaaaacatgcacagagagtaagaaatctaaaattttgaaacttaaagtttaaaagttcagcctaaagatttctctgtatacagtgaactgtaacctaactggatgtgtaaacaggccataatgtactcttatgccaatcactgagtttcaaccatcaaaggtggccaactgttaaaagccatattcaaataaggcaaatgctaaactataaccaataggctgtttctgtacctcacttccattttctatatgtcaattctctttttctgtctgccacttctctttttctgtccgtaaatcttctttgagcatgcagcaggattggagcctctctgaacctattctggtttgggggctgcccaattcatgaattgttttctgctcaattaaactctgttaaaat

SEQ ID NO: 607941 - DNA, 622 bp, Homo sapiens
  misc_feature (115)..(115): n is a, c, g, or t
  misc_feature (171)..(171): n is a, c, g, or t
  misc_feature (208)..(208): n is a, c, g, or t
  misc_feature (235)..(235): n is a, c, g, or t
atctaggatccttcaatctactcaagttgacacctatatttaacacacaaagcccaccgcttgtcaacttggcattcacacacatctcctgaaatcatacttaatctacaaatanatacataagggtcataattacgcctaacataatgcaactatccttcgtacagccgnaagcgcacccgtctttaacctaaatattattacatanagtagcaacacttaaatgctgatatanagtccttagtaaaggtgtgtacatgcacaaacatattcttaacaaaataaggaggaaatattcatgacaattacagtcattttttctgcaaccagtcacgtgatcatagttggtcttgataactaccttcttctaatatccattctgtattccctttgccttcaacaagcccctcggctggtcatgttttttcgcctggtggacccaaaccttcattcctgacgggtcagccatttgtagtcctgcctggattgggttgttgtactttcccgttgaccttaatcacagggcatggtaatactaagagacaccctaagggatctcctgtattccacgcatactcttccttacctccattgtggggtagtagtctgatttcatcctgat

SEQ ID NO: 607942 - DNA, 736 bp, Homo sapiens
ggctcgcatgatggctgcggtgccgccgggctggagccgtggaaccgtgtgagaatccctaaggcgggaaccgcagcgcagtgacagtgcagaaccccggcgcggccttggttgagcaatgtttaaagcgttgaaaaacatgaattgggagggctcaattcaagacctgttgtgagttgttttcttccaagttatggaaattcggccttatactatacacaagtgtgtgtgttgtccagagtcagaccagtgggtggaggtggtgatgatgacaggtgtgtggggagccctgcaaagttgtttgctccgcctttgtgggactggtggctgcaaagacttttcgtttgtgacgtgtgaaaccatctacggttgtgcaaagagcttcattacttttaaacccttgttgatggttggggctggtgagcagggttatgggttctctataaaggtgtcttaacaaaggttgatttggttatatgagcctttgttgtggattgcttcaagaggtcgctaggattcaacaatgccttacttcaaagattttacctttccttctgatatcactgaattttaggacagcatattgtgaagctttaagaaaaaaaatgctataggtttggaagtaagggattactaatggctaaataacagtgtgtttataaatggcagtcaccagagcagtgagaaacctggtggaattcaaaaaagtaacaatggcggtccatgtcagatatgg

SEQ ID NO: 607943 - DNA, 294 bp, Homo sapiens
caagtggctcccagagcatggagtagcacggtcgcgctctagacgagcgccctctggccttgcaccacagagacgcaggcgtgggtcaaggctgcgtgctgccgaggcccttctcatccctgctcaagcatagcccactactggcctcgacggtccccactgtctcaaatcggcgtgaccgggatacccatttcatcaaaggtccaggacagacaagcaggttttgaaggcaaagttcactcagcccacctgcacccctgcctaatgcagatcaggtggtgcggtaccgagctc

SEQ ID NO: 607944 - DNA, 692 bp, Homo sapiens
ttggcaagaacaagcgccttacgaaaggcggcaaatcgggagcctagaagaatagtggttgatccattcttctatgacagattggtatgatgtgaaagtcacctgctatgttcaactattaagaaatattgtgcaatagtacgctcggtcgcactcagcaacccaaggaacctcatccattgcatcttgatggtctctgagggtcggtgctgtcttcgaacgctgagtctttggactgcatctctgcgagcatatgatgaagtgggcgattctatgaaacattctaaatgcttgcatctaccctagaagatgtgacaagtggctccaagagatcgtggcgcgtgtatcttaactctctcaatggacgagtgggatcgttcagcccgtgaccaacacatggtgttccctactggagtcatacataacagtggcagtaccagaatgagttgaacgcctcacgtgtggactgtcaaagagctagccgattggttaccttgccttcgttctgtcctggtgttgagttttacctgataacccgcgcgagcgagtcacgatacggatgacctcttatcgctcagctaccaatcagtgtccgccaagatctcgtgactggaagattgatggcaaatcatcgatcccgagaggttgcctgacgagatgacttgaactgaagtcggtcaataaagttcgat

SEQ ID NO: 607945 - DNA, 469 bp, Homo sapiens
  misc_feature (24)..(24): n is a, c, g, or t
  misc_feature (76)..(76): n is a, c, g, or t
  misc_feature (445)..(445): n is a, c, g, or t
  misc_feature (465)..(465): n is a, c, g, or t
gtcctagaatgatatcaacccccnacttactgtcccctttcctagcaggcagaccttaaataacctatcctcaggnaactgattccctcccatccctgaaaacacccttaaacaaccgggaaaatagcccaagacccagacaaagtctgctgtggggacaattagataaaaggaggctgcacagtggctcacacctgtaaaccccagtgctctgggaggccaaggtggaaggactgcttgagccccaggagtttgagaccagccctgggtaacacagcaagaccccatctctacaaaacatttttaaaaattagttgggcatggtggtatgtgcctatagtcctggctactcaagaatctgaggcaggaggatcactggagcccaggagtttgaagttgcagtgaactataatcatgccactgtactttagcctggacgacaaangggagactctgtctctttanagaa

SEQ ID NO: 607946 - DNA, 678 bp, Homo sapiens
gaaaggacattgactgacttgacgggatgcaacgtctgtgttattccacctgaccagtggttaggaggacgtggtgagtagcattatggcgctctggtcaggactccccacccgtgagcctctgaaagctgactttagtctgtaatcagggaggtctggctcagcttctcaattgagctgtgtctttggatgagatgagtatcttctgttcagagaacacgatgttcatgacctcattgtctaaggcccctcatctgagaaagtcttgtctgaccctctagcccagcaggaccaaggtgtggtgcctggtcccagctgtcctctgctcccctgggctgcagttggccagttgcctgcctccattagatacggagttgctctggggctgagatgcccatctcaagtgcattctgtcggaagggttctcatgctggaaggcctttggtttagttgggattccatgagctttagcccaaaggtggcctcccatactagcatatttgtttctcagcaaatggacctgatccaccatttgatgtttgtcgcagtgaaggtcgtcttgggcagtcactgccctgagtttgtcctactggctgaccactgtcctcttgacttttagctgtgagatccaaggtggcccagccaaagaagtctatcaggcagcagcaggtatggtcg

SEQ ID NO: 607947 - DNA, 905 bp, Homo sapiens
  misc_feature (225)..(227): n is a, c, g, or t
  misc_feature (618)..(618): n is a, c, g, or t
cgcccgacgccaacgcaggcgcacgctccgattcggcgcggctcatggtccggttcgggctcgcgagtctccgtctggggtagggcaggttcttagactctgtgagtaaagacagcttcatcttcccagttcatcatggcttcaacatccagagatgtcattgctgggagaggtatccactcaaaggtgaagtctgcaaagctgcttgaggttctgaatgctatnnnggaggaagagtccaacaacaacagggaagagattttcattgcacctcccgacaatgctgcgggggaattcactgatgaggactcaggggatgaagacagccagcgaggtgctcacctacctggcagtgtgctgcatgcttcagtcctgtgtgaggactctggcaccggggaggataatcacgacctggagctgcagccagccaagaagaggcagaaagcagttgtgaaacctcagcgcatttggaccaaaagagatattcgtccagactttggcagttggactgcatcagatcctcatattgaggatctgaaaagccaagagctgagtcccgtgggcctttttgagttgttttttgatgaaggaacaattaatttcattgttaatgaaacnaatcgttatgcttggcagaaaaatgtcaatttgagtcttacggctcaggaattgaagtgtgttttgggcattttgattttaagtgggtacatctcttatccaaggagaaggatgttctgggaaacctctcccgattcacatcatcatcttgtggctgatgcaattagaagggacagatttgaactaatcttctcatacttacattttgcagataacaacgaacttgatgcaagtgataggtttgcaaggtcagacctctcatcatccggatgaactgcaatttccag

SEQ ID NO: 607948 - DNA, 115 bp, Homo sapiens
gtagatctctacacggatccccttcgtcgaaaaacaacggcattcatatatacataagaccctctaatttcataatacactaattacataaattagctcgtcatacaaaatatta

SEQ ID NO: 607949 - DNA, 606 bp, Homo sapiens
tgctgggcaaagggaacattatcatcagcagcttcaggtctgtgctggtctcgcctgtcaggagtaccacctgtcttgttgatgaccagcatagacctgaagctgcgtgggcagaagggaacattatcatcgaggcaccccatggagaagtgggatcatacttgcccggcgcatggaaaggcagcgtcgaataacgtgcaagaatagtcgaacctcctatcgctggtgggactgagagtcgcaccgtctattcgcggggtcgcagagatgcggccggcattgtcctgtaccaagtggatcgtggctcgccgaagtgcgccttatcatcattcctacccagtagtatgtaccaggtgccagtgtctgcacgttgtgccgtagcgtcaagctgttcttacgtcctacgtgcgcaaatgacacaaggtgagtgtagcgagcacatccatgaggcctgggccgtggcacgctgaccgaggctcccacgctgtcaaatacgtctactcgaatcaccctaatgatggcgatctctcgtccacccttagggaccgtgtgccacagttccatggggtgttcagaacattcagacgcaataacacaaaacctcgg

SEQ ID NO: 607950 - DNA, 261 bp, Homo sapiens
  misc_feature (3)..(3): n is a, c, g, or t
atnaggtgtgtgtgctgtgctcgtgtgtgtgctgtgtacatgcgtgtgctgtgtgtgtgtgtgtgtgtctattttatttccagctacagggatatctgtcgtactttgttcaggacagaagacattcttgtcttacctcgtttactacatgtatccactgcacctagaacaatgccagcatgtcatgaatgaagcctggctacttaccaaagcattcattcatatatgccccagttttgcttttctacaaacttactcgta

SEQ ID NO: 607951 - DNA, 285 bp, Homo sapiens
  misc_feature (76)..(79): n is a, c, g, or t
ggcctatatccaagatgtggaaaaggaaaatattgggctaaggaatgtctttctaaattataatgaaattggacannnnattgtcgggaaatgggaagaggggccagcccaggccccgcaacaaagtggggcattcccgattcagccatttgttcctcagggttttcagggacaacaacccccacagtaaataccaccatttcaggaatcagccaattacaacattacaacaactatcccctgccacagcagcagcgtgcagtagatttatgttctgctcaaatg

SEQ ID NO: 607952 - DNA, 354 bp, Homo sapiens
tctgaaacagaatctggcttgtggtcacccaagctagagtgcaggggcgccatctcggctcactcccgggttcaagcgattctccggcctcagctggggagatagagatggcagtgagccaagatggtgccacggcactccagccggactaattttggtatttttagtacggcacagggtttcaccatggtgggccaggcgggtcgggaactccggacttcgagtgatccaggtgcctcggcctcccaaaaggcggggataaaagacgtgagccaccatgctgggccccacggttacttttattactacctagactacactggtcgaatgggtcgccaatcgggggtaccgagc

SEQ ID NO: 607953 - DNA, 220 bp, Homo sapiens
attcgcggccgcgtcgactttattttgttttatttttttgacctaacaccaaaattataactttttaaaaacaaaagattttcctcactggtgatggaatgatacacacatccggtgtacattcattcccaaactgtggtcttgatccaaagatacctcctactgtatgagaccgctttgggttcctttgaatccaccggtggcttttgtgatgagggtt

SEQ ID NO: 607954 - DNA, 619 bp, Homo sapiens
catggggacctgaggcagtatgacatgctctgacccacagagaccccgcctcacacggacagctcttcactcggacggcagcactagataaagggaggcctggagcaagatgctggaggacgaggaactaagacgtcccagccagagcccaatagtggtcaagggaaaacgggtggctggaggccctcaagatgatccagctcagcctggatgggaagcgcctcgtacatcaccacgtcgctgtacagtgcatgggacaagcagttttaccctgatctcatcagggaaggctctgtgatgctgcaggttgatgtagacacagtaaaaggagggctgaagcttgaaccccaacttcctggtggacttcgggataggagcccacttggcccagcccttgcaccatgagctccgctaacctgggggcggactagtagcatttgacatctggattcgaactccaccgctcagtcacccacacgtccctatttttgggccctcacttccatggggacctggcttcattctgctctctacttggcaccacgaccattggcagcaccgaccacacagccaaagctagactgtggcaaatgtgttgagtataacatttactgacaac

SEQ ID NO: 607955 - DNA, 387 bp, Homo sapiens
gggcacgaggttcatgtaccctcattggagggcattgccccggaaaatcaattggtgtttttggcaggggggcccttggaggatgaggccattttgggccagtggggggtggaggccctgattcccttgaaagtaccagcccgcatgtttggaggtaaagtccatggttccttggcccgtgttggaaaagtaaaaggtcaaattcttaaggtggccaaccaggaaaaaaaaaaaaaaaagccaggtggggttaagcgggggatgcagtacaaccggggttttgtcaacgttgtgcccccctttggaaaaaaaaagggccccaaggccaatttttaagttttttgtaatttgggctttttttaaaaaaaaagccctttagttcggtca

SEQ ID NO: 607956 - DNA, 107 bp, Homo sapiens
cagtgattagaggatccggaggagatgtcggagagggagaggactgtggaggggaggaggatgcggagagggaggatgtggagagggagaggatgttggagagggag

SEQ ID NO: 607957 - DNA, 268 bp, Homo sapiens
caagggctgttgttcagattcttttgtaccacgttggtggtcccttgatgtgatgcactccccgttagtgatggggcttccagcaagccacactgcagtgattgttattgctctactgggcctaaccaccccgtggggttaccacgactctgatgctggtactttgcaaagtgtcttgcatagatgtccgtgtgatacacatcttgtcttcagggtctcccgagcttgtggatacccagcaccgtgttcttggttggacgatggtacg

SEQ ID NO: 607958 - DNA, 605 bp, Homo sapiens
  misc_feature (47)..(47): n is a, c, g, or t
atatcgtcgacccacgcgtccgaaaaagttggcttttctgaaacttntgataggtaatctcaaataagtcttttagacttttaaagacctctcaaggctgtgaagcccaacccagggctcaccattaaacgtcacctatagtacttatagattatggtgattcctctctgaggtccaaaatatcctgagttcctgggcctgcaggaagtgcatttttcacccgctatagaccaccggctgggctgttgtatcaaggtacaaggcagtttttccatggtgcagttggggagagggtgacagagtgtttatggcgcccacaaagtcaacttaaattccttgaagttgtctggtcatatctgaaaatacgagattccagtcaaagcttggtactagtgtttccaactgtgtccttttacaaggagaacagattcttaagaaactttcataaatgattatattgccataaaattaagaatactcactaatagtttccaaaatctggagggatcagatgggatgaaaaagtaaaggcttcaaattttgctcacaaaagtgaactttaccacactgccataagctatagattaaaaacaaaaaaaaagggc

SEQ ID NO: 607959 - DNA, 474 bp, Homo sapiens
tctagagaatccccggtcgatctagaggaatccgagaaagtaaagcttgtgagtcacaaaattagcaatagaagcggggtcccgccatatagaattctgctcattaatacaatattgaggagcaggtcggacgggccatccgaagcaggattgcagatggcagtgtgaagagaggagacatatcctacacttcaaagcttgggtccactttccatcgaccagagttggtccgaccagccttgaaaaactcactgaaaaaagctcatttgggcctatgttgacctctatcttattcattctccattgtctctaaagccaggtgaggaactttcaccaccagatgaaattggcccctgtattatttgccttatgtggatctctgtaccacctggaaggccatggagaagtgtactggttgcaggattggccaattccattgggtttgtcaaatttcaaccgcaggcagctgaagat

SEQ ID NO: 607960 - DNA, 441 bp, Homo sapiens
  misc_feature (404)..(404): n is a, c, g, or t
acatcaagcacatgggtccatacttgtaaatactttcggcaaaatacttattgtaactcgcagatgataattaagatccaagatgtggcccaaagtaaatagaagtgggtcataccacacattacctgttaacatcagcttccatttacaagtcatgagcccagacactgacatcaaactaagcccacttagactcctcaccaacagtctgtcctgtcatcagacaggaggctgtcaccttgaccaaattctcaccagtcaatcatctatccaaaaaccattacctgttacagctaaaacaaaatcagcacatctctgtctgtattagaaacgacaaaaccttacaaagcagtcacctccataccagtctgacaatcactagttcatttggcagatggacaacnaaagtttaaacttgccattccaatcaactttctttac

SEQ ID NO: 607961 - DNA, 151 bp, Homo sapiens
tgagccaaaaaattttttttaacctccttaattttttgggaggggcccctaatatttaaaccccttttaaaatcaattttttcaaaaatttttttgggttaaaggctctttttttggtttcaaaaaaaaaattcccccttttggatatttt

SEQ ID NO: 607962 - DNA, 111 bp, Homo sapiens
ttgctctgtcttccaccttactaaatcgatttaccttacggacgtgacaggaaaagaggacattcatgtatttgtccttccgtttcaattcattagcaccagggacaaagt

SEQ ID NO: 607963 - DNA, 493 bp, Homo sapiens
gactctagagtataccaccatgctcgtatcttcagcgactggaatataaaatcccaagacgtctccttgtccatttcctaacagtagagtatggcaagtggactggtggaacttggttccctttctgctccgccaacaatagctaattttatcataatctataggagctcgaaggtgtcctatagggctgggaccaacccagtctggcagcggtatctggtggcatctcatccacagtgatttcaaaataccaggcgcccttccgtactccatgagaggacctcaccatatagtataccttctctcccaacacagtcaggcggtcatctgagatctctaactgtggagcgcgatcctgtatgggttacaaaaaccgttcatacaagcaggctctgtagaggtctccccgaataggtttttctgtccagcagtcaagattcaccttctcggggtcaagggcgtgcggagtaagctcagctagaatatatcgata

SEQ ID NO: 607964 - DNA, 586 bp, Homo sapiens
  misc_feature (53)..(53): n is a, c, g, or t
  misc_feature (56)..(56): n is a, c, g, or t
  misc_feature (58)..(58): n is a, c, g, or t
  misc_feature (72)..(72): n is a, c, g, or t
  misc_feature (358)..(358): n is a, c, g, or t
  misc_feature (360)..(360): n is a, c, g, or t
atgtactcaataggtgaatggttaaacatactatggcacattcatacaatggnatncnacacggaaatgaanaggaacaagctattgatacatgagaaaacttacatggatctcaaggacattctgtttagtggaggcaaaagagtcaatctcaaaagttacatattgagtattaagtgcatactatatgattgcacttaataacaccctcaaaatgacaaaactatatagatggagaaaagattagtggattccaggaagataggggatatgaatacaaatggagagtacaaggaagtcctttgtggtgatggaactacacacaaccacacacacacacacacacacacacacacananacacatacacaaatgcatgtaaaaactggtaaaacatagaccagtggaacagaaaagagaactcagaaataagacggcacttctacaaccatctgatctttgacaaatctgacaaaaacaagcagtggggaaagaattccttatttaaggccgggcacggtgtctcatacctgtaatcctgagataaatactggcaatatagtggggtgtagggcgataacattca

SEQ ID NO: 607965 - DNA, 507 bp, Homo sapiens
  misc_feature (53)..(53): n is a, c, g, or t
  misc_feature (56)..(56): n is a, c, g, or t
  misc_feature (58)..(58): n is a, c, g, or t
  misc_feature (72)..(72): n is a, c, g, or t
  misc_feature (358)..(358): n is a, c, g, or t
  misc_feature (360)..(360): n is a, c, g, or t
atgtactcaataggtgaatggttaaacatactatggcacattcatacaatggnatncnacacggaaatgaanaggaacaagctattgatacatgagaaaacttacatggatctcaaggacattctgtttagtggaggcaaaagagtcaatctcaaaagttacatattgagtattaagtgcatactatatgattgcacttaataacaccctcaaaatgacaaaactatatagatggagaaaagattagtggattccaggaagataggggatatgaatacaaatggagagtacaaggaagtcctttgtggtgatggaactacacacaaccacacacacacacacacacacacacacacananacacacaaaaattctgaaaccataatactgtcaaatccccagtgagtctcacttctcaatgacaactatggataaccgtgctcatatatagcgagagtagggggaaaaaacgctttaatagagtggcagcagactaaagtgattatc

SEQ ID NO: 607966 - DNA, 879 bp, Homo sapiens
ttctgtaggtgaatcaagctctgtgaaaacaagggcgccacgtctgtatcgtaacatctcatgctagtattccgagcatgctaaataacaataggctcagcacatagagaaggcattcgcgtgaggcatgtagtgtgggtcgaactagaactggatgaccatatactctaggatacgcccatggatcaaggaagcgtgaatagaatactatgatgatttgtcatacgacagtctatatggggaacctactggctagaagttagaaatattgtagtatgaagtattgtgttgtgtgtgattgttagtggttaatttattatcctatgattgtgagaaaaagtcgttgatgcaatcggaagaatgattagcaagaatgtgaagtcactggagttatgttctctagagggatcgtgagatggagtgtgagtgagtgaacgggagagagtcaagttcactatgacgaactgcagttcgactacttactggagggtggatgatgaactttatgaatacactgaagtatataatgggaatcaattactatatggaggattggattaatgtaatttactgtatacttattccaagatggagtttaaggaaatacttgtatggacttaaatactagttcgagttggcaaaagaaaccggtaattgactgtactggtcgatatcaattcttgtgacaaacattctcattagtaacgtgattttcatcggtgatgaaagcttgcttcattcgcagattcaagtcggtttaggacaaagtgtcgcctaggatgttcagggactttagattatctttgaagaggaaaagagtgttttcagacaaggtggggggaacgtaacaggtgtgaggggaatgtggaaattgggacc

SEQ ID NO: 607967 - DNA, 167 bp, Homo sapiens
gacgagagaacggaaaggaaaggaagagaaggtctgaacttagcaaggtaaacttaaggtccacggttcctgaggtgactgaacgcacagagccgagaacgtcccggcttatggggtaccacgatcgggtgtattctcactgcacaaccgtcagcgtcggaatttca

SEQ ID NO: 607968 - DNA, 1058 bp, Homo sapiens
ggcttttagataggggattttgttaaaaactatcggggtcaatatattttttcgaaggctctacattcccctaaaatgggccatttttatataagggtaaccaatgcaaattgggacataattggggtgaggtttgatatacacacatattttgataatatcacaagaaaatgtgaggaataaaaaagggatagctctggttttgaaaaaagtttttggataaccgtgttgtgaaattaacgtttggggttttttgtgccttaacttctggtaaatggagttttttcccaccgcaattacactgatgtaaaattgtttttttgaattcagataagttctgttaaagccacggttgagataatccccctgtactctatttctgctgtggctcttaatatagaatggaatagtgtttacaggccctctaaaatagattataattgttgaaaaacacctttctcgagagataaccatacccaaagttttttccccaagaagatatttataaatcccaatttaataaatagtaaggtttaataccagatttcttataaataagtatatagtttattaaaggccaattttaatagtttagagacttaatttgtgaatagtagtggaatggtacccttaataagagaaaagtgagctgcccaaaaaatttttaatagcgtgagtctttataaattcttaaatgttgaagtttttaaatgagttaattttaaaatgttataaataagtttagtaaaattgtgcattctcccaagttatcactttttataattatgggacgcttttccagattgggctaataatttgcacttgtaaattttgtaagccacgtttattctaaaattccaaaaatactgtccagtaccaccagcggtgttaacaatctataattcccaatatttggaaaccagttttaaaattgtgactgccaaaactattgtgtgcgttttaccaccagtatggcgatcctaattgttgtctgtgaaattaaaggacatttgatagtttactgaatgtaaaatataatgcttggtatatgaatgata

SEQ ID NO: 607969 - DNA, 268 bp, Homo sapiens
  misc_feature (231)..(231): n is a, c, g, or t
cccccccctgctaaatctggctcaaaaattaaaagattattaaaatttgatgaattagtggtgatggttgcccccccttgtaaatataataaatgtccctgaattgtcccctttaaggtggttaaaatggcaaattttacatgtcttactgaaaccactgtactatttaatacaaaggacatagtataaaatttttaaagtgataggaaaatgcttagattaatattcccncttttccagtatatttttaataaaaacagttttggta

SEQ ID NO: 607970 - DNA, 697 bp, Homo sapiens
  misc_feature (269)..(269): n is a, c, g, or t
gcagttcggcggctcccgggggtctgtctcttgcttcaacagtgtgaggacgggaacacgatcctggggcactctctttccagccttccgactcggccttcctgatattcgctctgctcgtcttgctaagactactcggagaccaatcatgtcgtcggtccgatctactctgctttcatggaatcctggccaagaccacacagtgtatcgtaggttatctaccttcatatgtccaagctaaacagtgacgactccacagcattgcgtcnaggatagttgattgccaccggatcggtggaaggctagcccggatcgaaaccagccgtaggttgcccatgttgtaccatgcaagtgtctcacttcagacgctaccttcatcctcatgggacttcgtgattgtcgtaggcagcagatggactcgtgtgctctgagaagagctgtgcagccaatcgttcgttccagcagaatattgtgggctgaaggggaggaagcagcgaagggtctacgaagctgtctgcctttgaggtattgcacatctatgccgtcggcgggactgcgctctgcttccaaggtatcaatccatatgcacatcgcagcttgataatatcgacgtcgggtgtaagaaaacccgagacgagccatttgcaaaacgactgccaatgtggccctttgtgatgagaagcatgcttgaaaccag

SEQ ID NO: 607971 - DNA, 412 bp, Homo sapiens
ggtcgggggacacatccgcctgtccgtcgtccgtccgtctgtctgccctgcccgcctctggctgcgctcagtccttccagtccttcttgatggtgagattccactcccgggacaggttcgtcttgtcttgttgtcctctgtgatagcgtgacttgttgctttagttcccccgggccagcatacccttgtgtgcctcctccacagtggttcacgaactcgtactccttcgggcccgggcccatagcttcctaccatgtactccgtcttgtcaatcttcacgccttttctgtacctatgctggatgtacttcatgccgcacactatctctcggttaaaccgcaaagagattttatccggtactccataacctccttcaacacatacaactgcttcttcaagctctccacgtcgc

SEQ ID NO: 607972 - DNA, 313 bp, Homo sapiens
cgtcgaactaggcctcaaaaacatacgtaacgaaaaggcctagcgaggcaaattctgattgatttgaatctatatttttctttaaaaagtccagggttttatattgtgagtaaattaaatttacctttgagttgtttgttgctaaaaggtagtaaatgtaaaagaggactggttccttcagtagtgagtatttttcatagggcagctttatttatctccaggatgtttttgtggctggatttgattgaaatgggctttttttgatttttggtaatttccccccatattgaattaatgtggtccaaacaaggga

SEQ ID NO: 607973 - DNA, 417 bp, Homo sapiens
  misc_feature (93)..(93): n is a, c, g, or t
  misc_feature (97)..(97): n is a, c, g, or t
  misc_feature (99)..(100): n is a, c, g, or t
  misc_feature (300)..(300): n is a, c, g, or t
  misc_feature (400)..(400): n is a, c, g, or t
  misc_feature (417)..(417): n is a, c, g, or t
cttttaggtggtttttctgtgagtggcctctctccaagacagggaaggatatgggaggtgctctttggggagtgtgcctgacacacaggtttnttgntnnaaataaagataaatctgcatctggggctcccggaaatttttgaggataggtttagaatttccatggaggaagaagaacaggaactacaaattactgatttattgttactttatttctatctgcaagtcagtgagaccttggtgacatttgaactactcattcactaacaaactattagaaattcatgagttgtgactttngattgctctctttttttttttttttctcccgatagtcttttgactaaggactattctgtacctttggtatgggctgttagccaatgtgctgctcatattncaggcaggtattcggcn

SEQ ID NO: 607974 - DNA, 139 bp, Homo sapiens
taatagggtaagggatacatcgcataatctgtgtaagtgtttttcctgattaagctccttccgaactaacaactgcatggatcttccctgactttgataggccatctactactgcagctactatgaaacttcacagtga

SEQ ID NO: 607975 - DNA, 153 bp, Homo sapiens
gaccataataacgctttcacgatcatacgtcacgtgcatggctaaaggcatcgttgtcacataagatgggtcaatcccaacagcgactcccaatgggtcgtgtaaggcagcgcttttttgtcgatgtcacgattgtataggcatcattttaga

SEQ ID NO: 607976 - DNA, 220 bp, Homo sapiens
  misc_feature (177)..(177): n is a, c, g, or t
ttttattctaacattatgcaggggtgcgagatatgcctcccatgctgtaacacagatatttattacgatttatagggtcggtaagacagagttgtgggagggaggacccgggtggtaggactcccagcttggggattagtctggggggggtgtaataagattaggggtaacactccngtcttccagcacttcaactctgtagtcctgttgtaaggctttt

SEQ ID NO: 607977 - DNA, 519 bp, Homo sapiens
ccactccgttcgctgcgcgcacatgggcccggcgagaggctcggagtttgatcacacacagcgttccggcttccatgtccccagcgcctccatcgctcgactctgatattctatgaggttgtacccaactacgacgcacgctgtacaaacgacagacaagtgccataagactgatactaacgacaacaccaagtagaggacacaattaagctacaccacatagccgagagctacagacagctaacgacataggagaccacccattcagcaaggaaacaaacccatagcagaggaccgacaccacagtaagacaaaaacaacaacacacacatccaacacaagaccaacgaatccacgcgcacgaagcaagagaacaactgaaaacacacgggaaagagcaatacacacctgaccaacaaccacacacagacgacagcacgaccaagaaagatcaacagagaacaccaaacacacaagcaaccacaaaacagcgcacagcagaaaacagaaaacaaaaaa

SEQ ID NO: 607978 - DNA, 179 bp, Homo sapiens
tacccattcccagcgtccataggggtagcatcgcatggcatcagcatggcacacagcagcgctcaagggccatgggcatgcagcagggggcagggcattcatttatccaacacagcaggtcaacagtcagattcccaacacacatcacatggtagtcaccatccaacatcacatttcca

SEQ ID NO: 607979 - DNA, 1493 bp, Homo sapiens
  misc_feature (272)..(272): n is a, c, g, or t
  misc_feature (614)..(614): n is a, c, g, or t
ggtgctagtccgggagatagtcatcgtgtcagactactattccaccatgacgtcggtgtctattgtcaaagtatcttgaccaatgcactatgggcctggatggagtccttacagttgaaagcggtttgcagcggttggatagctgcatgcatggagaagaagcatgaaggtacccagtatcgaacacacgggggtacaaggatcactgggacctgtggtcgtgttaactcggacgtacgagtgctcaaacaacgacaacgcgtcccagtggnggctgtcgggctccggtctgaatgtcactgtacacctgatgagagggaggcgttcgagtatggacggtggttgactcgcagagtaggcacgtcgtacctaggaagcaaaggggtccgtcactccggagatcactttgtgtgttgggcagacctccacaaggactagggcgtagaatcctgctcgagaagcacacaagtgtcccttcgcattcaaccaggggatgcccacgacgtcttagtgttgcttgggataatcgatttagtctgagtcctactgagcaggtcaaacacagatacagaatgcattcgaccagacatgtacatgagccttagacgtacaanttcaggtgacggagatacacgtgaatagggatatatacagttgaaaccatggccggggaacgagggccacttcctggaaagacgctgccgagacgggtgccctgaggtggagggaccatcccacaccggtttcgcttggggtagtctaaagaaagcggaccacgacacttgggggtacagcgccaaggggaatgaaaggattttgggtcgcaatgcggcgttagcaccctagtacctcatcctccgttgagactggagaccaaattccaaaccgcaggtcccatacggcttggggaatgatggggtcccaaagggcctagggaggttcgcaaggacgccaatggggcttgagggaggctttgcagtggacgcccttgaagaaacaccgaaggggtggatgttagccgtaagcttcaaaccggccaatggtcggaaacgcgaaatggttacggcccagaaaaagggctcgctttggggaaggaacccgttcaattccgagggttgacatatccggaagaggggcttgggcaggcgtggggccaaaaaggttggggaggaattggatccgcctggcttgttgggtgggcgaggctttaaactgaaacttgcttttgcccaaaggggtttgaacttgcggtggacgcgcaaattgcttcaaccacttccatttggcttttcagaaaaaccatgttaacagaagggccgtgggacaagtacgtgtaagggggccagcccaaaaggggacactccgggggtccctgtgggaagggcacagccggaaaggaacacagcaatttaccgggcgcagggagaggcatctgccgggatttttactgtgtcccacaagaagacggcacctgggcaaggagcttttaaccc

SEQ ID NO: 607980 - DNA, 138 bp, Homo sapiens
catgtacgccgttttatttaaaccaaagcaagcctggtttatattaatggccagtaacggtaatggttgatttacccatgtccagaccattgatttccaggtcaccaatggatgcattagctgctgaacccaagtgaa

SEQ ID NO: 607981 - DNA, 281 bp, Homo sapiens
  misc_feature (36)..(36): n is a, c, g, or t
  misc_feature (57)..(57): n is a, c, g, or t
  misc_feature (98)..(98): n is a, c, g, or t
  misc_feature (130)..(130): n is a, c, g, or t
  misc_feature (132)..(132): n is a, c, g, or t
  misc_feature (150)..(150): n is a, c, g, or t
actactgtgcatatccagccaggcccttactccaancacctatgagctttggcgtgntgaattttgtgtattggtacagcgagcggactgctcaacancctgggcgcggcgccagcgccttatctcaaangncgtagctgctcacgaatnacgcttgtgtgggcgcgggcttgcccgcgattggcattgttgtctgtcaaacgcctattattgcaacagttagttggggttccgacgtctcgaacttcgtaactcgtcgttcatagcctgtttcctggtgt

SEQ ID NO: 607982 - DNA, 960 bp, Homo sapiens
gggatgcacccggcaggcttggcggcggcgggtgcggggatcgccccggtcctggccctctgaagccggagagatccgcatgctgtcccaaggcctgggacagtggcacgatgcaccgcgaccgagacttttcggatgacactagagttcaggccagagccgggggctatggggcccagcgggctcctggtggcctgaggttatcctgcaggcctgctcccagcggcccgcatggcagctcttcctggtctgtacccggtgtccaacatggccatggcctatggggagcagcctgggccgcgcagggcgaggagctggtggataagaacatcgagccgctttcatcgccgctagtcacgcaagactcgaagtagttactgttgctgtggacaccatgtatgtgggcagaaagctgggacctgcgtgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggtcatcctgctcagactctatctggtcactgtcaacaacgagctcaccatcatcgagctggtggcttcttgggctacaaatatgtcggggatgattggcggggtcctcatggggctggtcttcgggacagatggtatactggtgctgggccggctgatgcgatggcaaccatggggtcatgaatccggaagctgggttaagaacttgcgaagcgcaactgaaggggtcccaagcgcagggccgaaacagttgcattatcctgacaaagcgggagaggggcactatgccggtcgggacactaacaggcgg

SEQ ID NO: 607983 - DNA, 363 bp, Homo sapiens
gtgaattgacgaggtccgcctgaatcacgggtccgctctaagatccctaacattacgcttaggctaaccattagcaatccgttcgtttttaccatggcatatatctctcatcgctttggccccttcgaagatggccccatcggtcatcatcttcccatatcgtagtcgcttattttcacaactccttcgtgccccattttaccgcctttacatcctactcccatcatctactccggacccgtcaattcttgccgttaacagctgtatcacctactctcaggcggccgcacgtgctagctacatgtgggcccttaacgcccatatgagcgacgataatcttaactcaggccgacgaaaatcttc

SEQ ID NO: 607984 - DNA, 103 bp, Homo sapiens
ccttgtcctcgttttgttgtatattttgaaggggaaggttacgtcatgtcctggagtatatcatgtaacattctacaattgtgccagcgagacaccgtgtaac

SEQ ID NO: 607985 - DNA, 755 bp, Homo sapiens
  misc_feature (76)..(76): n is a, c, g, or t
  misc_feature (85)..(85): n is a, c, g, or t
  misc_feature (130)..(130): n is a, c, g, or t
  misc_feature (138)..(138): n is a, c, g, or t
ataaaaatactaatgaccatcacaactcattaaaagcataaaatgtgcaatgatttaaactacatgttctttctangaatctgcntagaaatgtagacacatttgataaatgctatttaaagtctgagtnctttggtnaatgattcatctataggttgaagggattacttttatctgccttcatagtgagaattagatttctgttctttataaagcagggaatacagattgtgcatggagtaaaagcattcaatccttaataatgatggtagctgtgttgcagaaaagaaagcctgtcagagtaacgtgttcagttttacatcataatcagagtgtgtccatctctgttgaaggcagaattaaaaacgccttcaacatttttaaaataatagatgaaaaacatctcaaagtcacttttaaaatttgaattgacgattccacataacaggaaaaggaccaggaacatcttaaatacttcacgatggaagtgatgttttaagtgtaatttcatcaaggagaagtttttccagaaagtcttttgacttcagtaagaagcttatttactctggtaaatagtttctagtaagatgagaaagacttgattttttaaaaaacaattaaaaatttacattgtttaatctaatgttgtgatttcgaaagtactacctttgcccttatagttacgcatgtgtatttatatgtattttcttggttcattcaaacgccaataaaatactttactatccaggcaaaaa

SEQ ID NO: 607986 - DNA, 1290 bp, Homo sapiens
  misc_feature (1289)..(1289): n is a, c, g, or t
cctagcatgacatatgaacgctgaaacatgcaatcagactgatcgcaggagcataacacctcttttcgaacagttgtgcgcgtcaactgaccaggtggaggcattcgagactcaatgtggaaagcaagtattcttataagctgatctagcattagaatagttcacatggtgcatcagctgcacacaaaaatcctatgctgcaatacattaaacataactaagcaagtatcattcatttctagcaaacagatgtttgtcttcaacaatacttcctttttcattattgcgttttaccacaaagcattcatccttttcatctctacaaataagtcaatcaatctttccagcttcattcaaatgcatcagcataatgcctttttggttttgtgtggtattcaactaatacatggtttaaagtcacagccgtctgaatatattttatcttggtagtacattttctcccttaggaatatacatagtctttgtttaccttagttccaattctctcgggagagtgacccctacatatgtcctaatagctgatgtgtgcaacctttgatgtgttgatgactcactcataaaggtttcagtctactgtcatcgtcctttccacttacttctaagccatttcacgagctaataagaagtcataccttattaaataaaccgcaacccttttaacaagcgcaacacctctctatacacgccacgtcgtcatcgtcccacacctgagcaacacactactactctctcacaaccaactcgaactgcagccaagtaactaacactaacaaatccgtctcagagccgagcggacagacagtcgccgcacacccgctgacacccccttcacccctccccgagaacaaacactgcacgaagcgcaacacgtcacagagaaagacaccacaggcacaggagacacacgcagtacactcgccccaggagtacgaacaccacacccagagacaaactcagacgatcacacccactccccttgcgcacacaacaccaccagacgtcgatgcagccatccacatagctcctactcacactccagaaccaccagacaccaacccatcactaacaacacaaacccagcacccacacatctcttcacccagcctcccccaactactaccccccaaccacccccacccatactacacacctaccacaacacactccacgctcacacatcacccccactgcacaacctcctacccactcgactccagcctgtccctccaacccataccacacttctacgtccttaacttttcaaaaang

SEQ ID NO: 607987 - DNA, 759 bp, Homo sapiens
  misc_feature (76)..(76): n is a, c, g, or t
  misc_feature (85)..(85): n is a, c, g, or t
  misc_feature (130)..(130): n is a, c, g, or t
  misc_feature (138)..(138): n is a, c, g, or t
ataaaaatactaatgaccatcacaactcattaaaagcataaaatgtgcaatgatttaaactacatgttctttctangaatctgcntagaaatgtagacacatttgataaatgctatttaaagtctgagtnctttggtnaatgattcatctataggttgaagggattacttttatctgccttcatagtgagaattagatttctgttctttataaagcagggaatacagattgtgcatggagtaaaagcattcaatccttaataatgatggtagctgtgttgcagaaaagaaagcctgtcagagtaacgtgttcagttttacatcataatcagagtgtgtccatctctgttgaaggcagaattaaaaacgccttcaacatttttaaaataatagatgaaaaacatctcaaagtcacttttaaaatttgaattgacgattccacataacaggaaaaggaccaggaacatcttaaatacttcacgatggaagtgatgttttaagtgtaatttcatcaaggagaagtttttccagaaagtcttttgacttcagtaagaagcttatttactctggtaaatagtttctagtaagatgagaaagacttgattttttaaaaaacaattaaaaatttacattgtttaatctcccttcgccgtccgtcacatgtccctgcccgtggtgctagcgggctcttggtgctcagtggttgggctttggggtggtccgcaggccgggggaccgggcgccactcacaaaaccgctc

SEQ ID NO: 607988 - DNA, 637 bp, Homo sapiens
  misc_feature (137)..(137): n is a, c, g, or t
tggagaacggtttctcgctatattgcccaggcaggtctcgaactcctgggctcaagctatcctcccgcctcttagcctccctgagagctgggattacaggcgtgagccaccgagcccggcccccttctgtcgactantcctaccccttcctttgccccattctttctccacttacctcctctttttcttcctcttcctttctcctctcctacatctactccctcttcacctctgatactctactctctcctctctccctcctcctccccttcctccctctcctctatttctttttatctccctcctccttcttatccccctctcctccctccccttctcctctactctctactcctttctcaatgtatctcctctcccctctctctcttctcccctttatcattcccctcctctcctttcacccctcaccttcttcactcccacttccctcctatccctcctcagctccctctctcctcctctcttctcctctcttctctcattatctatttccacctcctacctctcctcacgatctcactctccttccccttcctctctaccccttcctcttcgccgttccacttcacctcccttccttttcccctccctcagctctcccttacctactcttccg

SEQ ID NO: 607989 - DNA, 202 bp, Homo sapiens
ctctgaggatcccggtttttattattactcaaatcagcctccctgaaaatttggaggctagggttttttaaaggtagtttggcgggcagggggctcgggaagcgggaatgctgattggttgggtcggagatgaaatcataaggagttgaagctatcctcttgcactgagttggttcctgggtgggggccagaagaccagatg

SEQ ID NO: 607990 - DNA, 391 bp, Homo sapiens
ggtctgcctgccaccatgcccttgtggacctggttctcttctaaccccttgcaatagcccccattcctggtgtctatagagatcctgtgggcaagtagtttggaaccagagaacagcctgcctgcttatgacagttatcccagtggagcgtgagaaaatccctgggtctagaatgggcaacttggagaggaccctgagaggagacggtgctgggctgtgctgaccccacagggctctcgagaacagattctcccctccagtctgtgccctgtggttggtgggccccatccctcaggactgcacagaggatgcatggctccgtggtaccgtcgggctccacccttacacactattcctggctctgcatgtgaaccacgctggaaccgagcct

SEQ ID NO: 607991 - DNA, 283 bp, Homo sapiens
ctcatacatgtccatggtactggtacaaaaatagggatatagaccaatggcacagaatagagaacccagaacataaacccaattacttacagccaactgatctttgataaatgcaaacactaaatataaagagtggggaaaggacaccctatatcaacatactagtactggggataattgggcaagcctacatacaggcagaatgaaactaggatcctcaatactctcacctatatacaaccaatcaactcaaatgtagaataaaggacattaaaaccgtaag

SEQ ID NO: 607992 - DNA, 923 bp, Homo sapiens
  misc_feature (3)..(3): n is a, c, g, or t
  misc_feature (150)..(150): n is a, c, g, or t
  misc_feature (187)..(187): n is a, c, g, or t
  misc_feature (216)..(216): n is a, c, g, or t
  misc_feature (232)..(232): n is a, c, g, or t
  misc_feature (242)..(242): n is a, c, g, or t
  misc_feature (258)..(258): n is a, c, g, or t
  misc_feature (271)..(271): n is a, c, g, or t
  misc_feature (273)..(273): n is a, c, g, or t
  misc_feature (276)..(276): n is a, c, g, or t
  misc_feature (280)..(280): n is a, c, g, or t
  misc_feature (344)..(345): n is a, c, g, or t
  misc_feature (484)..(484): n is a, c, g, or t
  misc_feature (554)..(554): n is a, c, g, or t
  misc_feature (805)..(805): n is a, c, g, or t
tgntgcttacacccagtagtcccagctgctggggaggctaaggcacgagaatcgctcgaacccagaaggcagaggttgcagtgagctgagatcgcgccactgcactccagcctgggcaacagtgagagactcggtcttggggggaaaacngaaagtcctgttgtaaatgattttttactgttttaangcatttattttaaaaaggtgggggaaaangtgtgtttccccgcangtcatactangctatttgggtgtaantcgcaaaaccctnangtngctngttgataatcttttcccactctatatttcttatttcatgttcatccaccactcctaccttgtannaatcaacagcaacagtttaaagggcattttttcatacttttcttcttgctcagtggaatgcatgtaaacatacatacgtgtgagtcagtgagtctgctataacagagaaccaaaacacagtagcttgacctacatgctngtttatttctctattgtctaatagttcagaggtagacagttaggagggtagaacatgtttgttgtggctnctatctctgggtccaaggtggatgctatgggctgaattatgtatcccacaaatgcatatgttgaaactctaacccccgatatgattgtatttggagataaagcttttaggaggtaattaaggttaattgaggtcataagagtagagccttattccacacctcttctaataggcatccttattagaagaggaagagaaagagatttctccatccatgtgcatgcactgaggaatggtcatgggaggacactntgaaggcagctgtgtccaagccaggaagagagcccccaccagagaccaaaccctgctggaccttgaacttggactttccagcctccagaactgtgagaaaataaatttctgtgtttta

SEQ ID NO: 607993 - DNA, 251 bp, Homo sapiens
  misc_feature (81)..(81): n is a, c, g, or t
  misc_feature (204)..(204): n is a, c, g, or t
actatagggcgaatggcgagtcgcatgctccggcgcatggggcggggatcgattagctaaatgttatttcattggtcagtncagaactaggattggcattagattgttaatctcttgccacaagataggaaaatggggcagatgaggagaaaaaagctttaatgggagacgacatttggactcaatcactagtgaattcgcggncggctgcaggtcgaccatattggagagctccccacgcgttggatgca

SEQ ID NO: 607994 - DNA, 973 bp, Homo sapiens
  misc_feature (413)..(413): n is a, c, g, or t
aggtcccgttgcaggagtttactgtcctcgtccctgccgattgcgacgtcgcccgataggcgattgccttgcgcgtccggtccgctgtccggcgtccaggttgtggacggtgagtgccgcctgcgacagatcgcgcagcaggtcgtacgaccgctcggtagccagtgctgttatcgctgtcggctctgcttctcggcgcgacctgacggatggcccattattgttccgtcggcgtgatagactgctgactcggtaagggatggtgaaccctaaggcggtaagatgcgcgcgcgagtatattgctggccgacgtcccattgtcactgttctctcccgcgtgctgacaggaggtgcgtcagcgtggaggtgatagacttcgggaagtcagaggcaaagacaccgcgagcagctantggcacgtgtctgccatgagatgattcacgtacacggcatagacgtgggtcaattcgagatcggtcaccgaactctctattcgcgcatagcaagtggcaacgtcgagccagtcgtagaggcatttccacgtgcacgcaagtctcgcacgcactaaggcaacaaatgttctattgaatttgcatgagacctagcatatgagcataatgcttcaagtgatcttcttaggaaacgacaaatgaactctattccgacaggaagtgggactttgactagtactgtctgttactagaaccattacagaggaacctagagccccggagcatgatagagattccggatagtgtcacaagtgaccgttgtttcgcatcctgagtcactctacgttggcgacagaactagagtgtatgaccaggtggatgtcaacgcatctgaatgccactagagactggagatctggcaacctgttcacggttggtcaaatgtggacatccaggacaaccaccgaggaggccaccctgggggcgtacctcatctgtgagctctggcagttgtatcagca

SEQ ID NO: 607995 - DNA, 1156 bp, Homo sapiens
tcactagactggggcgttgtcggctctcctcgacccaccgtccgcccccccgctcgtatgcttttttggttgtggtgtagtggtggttggtggggtgggagggggaacaggcggcggtggtggtgtgctctggcccaacataggttggtggcgcgcgtgtcggtggttggtgtggtggttggctcatgggtcgatggcgccatccgcacggtgtatggtgtgtgttggcggcgccgtgtggctgcttggcgcgcacgcagcacaggcacgcgggcggtgggttgtagtctatcaaggagcgtgggggtgccacgacctctgacgcactccgcgcgcgctggggtcgtcgcttccctctcacatagagtgttagcgagagtggggagagacggtgcggggacgaggacgagtgtctcctcgcgccttgcgttttcttaggtggacgaagattctgctctcgacactatagggtgtatgggtctagatatttgtgagagtgtgtgttgatttggggggccgcgccgccggcccacgcctcgcgttcgtggttactccgcgcggcgagggagcaccctcctcttctttttgtgtcgtctcctctcgtctctataggagggagactcgctctcaccgcgcgcgggcgagagagagagagagtcccgtgcggtgccggctccccctgcgcgcgaaatgagagaagagcgagcggcgctcgcgtgtggtgggggtggttttggctcccctcacgctctcttgttgtgttttcgtggtgttgtactggagaaagaatttgttttctgcgccaccgctggttgttgtgtctgtggtcggcgcccacgccccacagcatttttttttttctccgctgagcaagagagagaggtcgtctggcgggcgcgacgacaatctttttgatctgcgggtagtgaatagaagcaccaacacgtcctctccctagttctattttatgcacgccgcgcgcgcggcattcgtacttatacaacaagagaggggtgctccaccacaagaatatatttattaggacgcgcgtagatagagtcgtagatgtgtttctttctttctttgtgtgccccccccccgcccggccctttttgttcccccccccggggggtttaatatttttttttttttttta

SEQ ID NO: 607996 - DNA, 425 bp, Homo sapiens
  misc_feature (214)..(214): n is a, c, g, or t
cggctcaggcactggtcatttcagtgtcagagagctgctcacccaaccctgcccgtccggggattggctctgcggggctgccccccaattggctccagctgagtttgggggtctgtgatggccgcgggcagagcagcatgagtgtgacttcgtctcgcttccctccagctgccatcgtgccttgggcctctatttccgcgtgtctttagctctnggcgatgccttggatccagcagcgtgacagttctggcgtgcggctagaggaccggggacgtgtgggcatgggagggcctcactgtacgtagggtgccatttggaactcgacaggtgcatagaaactgaggcgacaggcatggggcccatcgccccaggggaagtggacgtccttggtccagcggtaggggcaggggtgggcaggccgtgca

SEQ ID NO: 607997 - DNA, 230 bp, Homo sapiens
caaaaaagtttggggccccccccccaattttttttggtttttatttttgaacctttttttaatggttgggagagaaaactttttcccaaaattccccaaatcgggggtcccattttttggggtcccccattttttttaaaagcagaggggcctgttttaaaaaggccaaatttttttgggtttttttcgggggaacagggaaaaaatataaagttgggggtccaccttta

SEQ ID NO: 607998 - DNA, 127 bp, Homo sapiens
catgaggccgaggtacaaggatgctcgagcccgagaggtcaagccttgaggccaaggatggaagttgcaatgagctgagattgagccactgcactccagcctgagtgacagagcaagtccctatctc

SEQ ID NO: 607999 - DNA, 112 bp, Homo sapiens
gcgatctagcggatccttaaacacgcaatcttcatgatctcacattctttaacagctttctcgcagattaaagtgcataaccggggacagtttttttccccatcacgaatgg

SEQ ID NO: 608000 - DNA, 151 bp, Homo sapiens
aaagaatcatgaagacgacaatgatccagtggtctcatttcagctgataactatcgaagaagggaccctgaagatggaccctgaatcctggaaaccctcctaactgttaccgtacatatgcgaccccggctcgttttctgccagaaagggg

SEQ ID NO: 608001 - DNA, 333 bp, Homo sapiens
ggaagatcaaggtccctgagaggagatctagtctcttctccctgacctattaaggaatcagagatcatagatttcttcctgggggcctctctcaaagatgaggtatggaagattatagtccgagttgacagaagtcagagtcgcgtgccggccagacgcaccgaggttcaaggtcgatttgtttgcatatcgggtgactaacaagataggctcgacagttctggatctgtggttgttaaatgttgcatccaagatggcaggtgggctaccaggccatccgatggtggccatcaatccatggccgaagctcatcacaatcgatctccctgtgcg

SEQ ID NO: 608002 - DNA, 390 bp, Homo sapiens
tactgtgctataatcatgaaggactgtgctcacttacaaggaaggatgtgctccctttctggaggttctttgccagctagagtgcacccacatttcttggctcatggtccccttcttccatctgctaaggcagttatgttgcatctctctgatcattctttcctagtcacatctccatctcactctttctgccatcctctttcacttttaagaacgcttgtgatgacactgggcctgcctggataatccaggctaatcttcctattttaaggtctgctgatcaaagccttaactctatctacaaccttaatttcgcttggccatgtaacaacatattcacaggttctgggaattaggatttggacattttgggtggggggcattattctg

SEQ ID NO: 608003 - DNA, 148 bp, Homo sapiens
gccaccaccacgggcgcctcttccagacaagacacaggagagcctgtggagattcctacctacatttcttctaccaacccagatgcttgcaagcgagggtccaggcacaattcgttaaaccaggctttgccctggatttccaccccat

SEQ ID NO: 608004 - DNA, 297 bp, Homo sapiens
gatgatttgatatatgtatacattctgaaacagtaaccacaatcaagttaactaacacatctgtcacctcacatgtttaccttttctgtgtgtgtggtgagaacaactgatagactcttagtaaattgcaagcacacaatacagtatcattagctacagtcaccatgctatcctttgcaccctcagaatatattcatcttatgaagtgttcgtactctgactaatacctccccagttacctaccccttcgccgccaggcaaccatcatctactctctgcttctatgagttcaacttt

SEQ ID NO: 608005 - DNA, 329 bp, Homo sapiens
  misc_feature (103)..(103): n is a, c, g, or t
  misc_feature (128)..(128): n is a, c, g, or t
cgaaagatgggtactcccggcaaaagtgcaatctttatttttactgtgatttgatttgataattatagtattgaaagtgaatgaccctattcattatgcttgnaattataatcccattataacttatnccgtttctttcctttccccccttggtttcgcttaattttcctgttcttcccttcatccccaacatttttcatttttttatcctgcaccccccttaaatttatacatacacacacatatatatatatcacacaagaggccttatttgttttatgcgggagacatcagaactttttgtttttatttcctttctacgtcttttc

SEQ ID NO: 608006 - DNA, 111 bp, Homo sapiens
  misc_feature (32)..(32): n is a, c, g, or t
ggaccctcacaagacctgcgctgcaaaccagntagcctacaccttatcccatactagttattatcgaaaccatcagcctactcattcaaccaatagccctggccgctgcaa

SEQ ID NO: 608007 - DNA, 999 bp, Homo sapiens
  misc_feature (61)..(61): n is a, c, g, or t
agtgattatgaataaatttctggggggaatgtgttgtaaaattatgtatattgttgatgcncccaccaaagtgtctcgtattgctgccgcgtcatattattaccagcgccgttgccaaggaatgtttgggttgcgcccgccctcgccccacctcattatcggctgctaagtctttataagtgaggggctttccacattagatagggacaacgaaacttcgtgctcaacagggggctaggaagactatggtcgtctgcaccaatataggtcccatgctgactccccaaggttgtttaatgcacccccgataatttttcttgtggggggaaaacaaaatacccaccagatggggcggagcgccaaaccacccggtggtttaaaatcaattggtggccgcagatggcaggacccccccggatgggcgtcacgaaaataccacacaagattttcgcgcgcgcaaatattcacccccccaaagttcgttttccctcgagaggatacatcccttgtgggttatatatatgggagctcttccagatgagcgatgaatgtttgtgtaataacctctctttttttgtcatatctcgctggtacatattatgtcttgagctttcccactctcctctcttatatataacacacaaagagatcgttttttctttttgtgtgtgagcaccacatctgacaagctgttcttactcagcacatgtgctcgttttataaagagcggatgtcttttttaagaaagacattaatttttcaaattatgtgtttgagaagacgcactaagtttttgagagatgtggcgcccccattttgttgcgaatggggccataatacaacaattccccgtaagttctctcccgggcaccaacccccctttttttatttttgtttttttttttaaaaagaagcccaaaaagcagggccgctattttttaaccccggggggtaaatttaaaaaaaaagaaaaatggaaataaaccttaaaccctttta

SEQ ID NO: 608008 - DNA, 159 bp, Homo sapiens
cccaaattttttgggccctttaacccgggcaaggggccgggggccaccctttagcccttcccccccggggttccccttgtttcccttttgggggggggggccccccccccccccccccttttttttttaattttttccctcccgggggtttccccttta

SEQ ID NO: 608009 - DNA, 160 bp, Homo sapiens
acctagtactatcgtgattccgctgacataactcatgacatgaagcagtcccgagattccctttgcaagctgggccgttatattcctccggcctccattcttggagtaggctcctttgccacaccccttttcaccttaagcggatcagcgggtaccgagc

SEQ ID NO: 608010 - DNA, 1406 bp, Homo sapiens
  misc_feature (116)..(116): n is a, c, g, or t
  misc_feature (542)..(542): n is a, c, g, or t
tccggtcgtctaagggtcctgtctggatgaggaggcatcatggtcagacactagcaggcatgtcccgcctgatctcatccttgagtacatcggtctattgaaaagattatagaganttgggtatcagattagtatctctagtgacaatattattaagcttcggactaagggattcagcatagatggattaactaaggcgtctaagggcggatgctgaggatacggtatgacgtgggatgatatttgtggaagatatggcttgtcacacggagtatcgacacgtaagggagacacagctagtgtggaagcaaccctgattaaccgcaacgctgaggaacactctgcacgtaggacactggggaggacattaccgtatcacctagagggcgctatccacctgagacaatcctctagtgtgcaccacgagcatggcgagtcccgcaaagcaacttgggaggagcgcattttgcggtattgccaagtctgggccttgttaatacgaagcacgcttcagcgccacgcacggtaagctcaagtatacnaacagccagcagacgatgagacgcaacttaacttccgcgtcacgaacgtcacgtggacccttgttagcaccacttctcgacacggctccgcctgaaaattaaaagatacggcaacctttggaagaacggcacacgggcgtctccttgtcgagcttaatcttgtagccggcgaaactgcgcgaaccggaacccacccgtcagttctcggacgcccctcgaggggctacgcctgaccaccgcgagctctctgcgcacagcctagagcccttccaccttcggcacagcagcaaagcagcgttcagcatgtggaggacacaaggactcagccggtgggatactagaactcccgcgcatcagatgcaacgcaccccgtctctggcatccaaattgtcttaacttcccgttggactggacaacactttctcacatttaactatcgccccattaaagtcgcttaccgtttgaggtaccaaacagacctcccacagaggttatcgcccacggcagttagtggcgccacagaagccaacatccagacgctttatcacccctctacccgctactcgtacccttcacgcaacaccgcgacctttcccaagcactcacgggacctgaaggctacaacctcccttatggctcatcacctactatcaaccagacgcgcggaacacactctcggcagccccattcccggcactcttcccgccaaacacgtcacaaccctttcttgcaaacagcaacgctctcgtcagcggcaactctctcttgtgggcaacacacaattccacaggagagcgggacaatctaccacaacgacaaagagaaaagaggcacctagggaccacacacccctcttcacatcaa

SEQ ID NO: 608011 - DNA, 660 bp, Homo sapiens
ttccaagattattccgcacgtattaagtttcgctgctgcagaagcctgccagtgcgatcaaggactggcaaccttcaggcgggctggattgtcctgttattgctgcttgtcggtttcttctttctggagccgcagggaatcctggtcagtgcgatagcggccgctggcgcagcagtgctgtttgtagtggcgaaaagaggtcattctatcaacaccggaaaagtcctgcgcggtgcgccatggcagatcgttattttctcactgggcatgtacataccgcaaccggcagcaatacggcgtttacgcgaacctttgatgatttctggcttagcgcgctctttcatcgtcatcgagttgatgatggcttccatacgcaccagcactttatcgtccatctgtgacttgacgttatccgggatctgcaccatgcccggcagcttgcccatcagactagccatgccgcccatatttttcatctggcgcagctgctcaagaaaaaaagaaacccttttgaaaagcattaataattggtgaagctgggtggggaacaaatgcgtattcatatataatctctcaatggttatggatgctttaaagtttacttaatcacattttgtttgggaactattggttgaaataaaagaagcttatatttgagcc

SEQ ID NO: 608012 - DNA, 458 bp, Homo sapiens
  misc_feature (7)..(7): n is a, c, g, or t
  misc_feature (157)..(157): n is a, c, g, or t
  misc_feature (172)..(172): n is a, c, g, or t
  misc_feature (244)..(244): n is a, c, g, or t
  misc_feature (275)..(275): n is a, c, g, or t
  misc_feature (286)..(286): n is a, c, g, or t
  misc_feature (369)..(369): n is a, c, g, or t
  misc_feature (457)..(457): n is a, c, g, or t
tttttangacagtgatggagtctcattttgttgcccaggctggagtgcagtgacgcaatctcagctcactgagacctccatctcccaggttcaagtgatcctcctgcttcagcctcctgagtagctgggattacaggtctgcactatgaggcccagntaatttttgtatttntagtagacacagagttttgctatgaggctggtctcgaactcatgacctcaagccatccgctggccttggctncccaaagcgctgggattgtaggcgtgacacncggtgactggnccaaacatttaacaaagaaaaacagtgtatcatctttggagagactaatggaaaagtcaataaaacaaatctgggtagaagtnttaaattcacagaggcagaattgtatttttacctttcatttaaaaggaaaaaaaaagggttcttagtgtttcagacagtagctggggna

SEQ ID NO: 608013 - DNA, 494 bp, Homo sapiens
gtcatcaggtgaattgcagtggcatgattatatttctataacccaattctttggctcatgtgatgcttctgcctcagcctcccaatgtagctgtgacttagctgggctactgggggacggctgagtgtgagaggatctattctatctaagacatgcaccaccaccatgccgtggcaaatctttttctttaatttttaaaagagatgggggatcttgctatgtaacccaagcttgttcttcaagtggtgggcctctattgattctcttgcctcagcctctcaagtagctgggataacagacacaagccattctgctccctatataaagattgctcggtggaatcccttatggttttcggtctgccatcttaagaaaagatagggtcttccatacctttttttcacggaccaaaaggtatcttgaaatgcttcatggatggataggaaaatatgccgatccaatcttttcaattctcttgaatctaacagtcgcgg

SEQ ID NO: 608014 - DNA, 559 bp, Homo sapiens
  misc_feature (1)..(1): n is a, c, g, or t
  misc_feature (31)..(31): n is a, c, g, or t
  misc_feature (49)..(49): n is a, c, g, or t
  misc_feature (112)..(112): n is a, c, g, or t
ntttgagggaccatccctcaaattattaganccttttatgccaaacccncagcaaccattgaacttgaatggccaaaagctggaaccattacccttgaaaaccggcatgagncaaggatgtcctgtcttaccacttcaattcaacatagtactggaagtccttaccagagcagtcatgcaagagagagaaataaagggcacccatacaggaagagaggaagtcttctctgtttgcagatgacatgattgtatatctagaaaacccaatagtctcagccgggcacggtggctcacgcctgtaatcccagcactttgggaggccgaggtgggcggatcatgaagtcaggagatcaagaccatcctggctaacatggtgaaaccccatctctactaaaaatacaaaaaattagccgggcgtggtggtgggtgcctatagtcccagctacttgggaagctgaggcaggagaatggcatgaatccaggaggcggagcttgcagtgaactgagattgcgccactgcactcaagcctgggtgacagagcgagactccatctcaaag

SEQ ID NO: 608015 - DNA, 139 bp, Homo sapiens
  misc_feature (135)..(135): n is a, c, g, or t
tttcatgagcagcagagtcgagtgtagagtgcaggatccagagcggggataggctgggcgagttggcgcctgcagctgcgcgctggttacttggtgacgtgcagagttctctctgggcgggctgcacgctcatcnttgg

SEQ ID NO: 608016 - DNA, 795 bp, Homo sapiens
gccagcgctttccgagcccggttgcacctcggcgatccccgagtcccttctttatggcgtcgctcctgtgctgtgggccgaagctggccgcctgtcggcatcggtccatcagtgcctggggatatgatcatgttgataatgctcggaatgatttttcaactatccattccgctgatgtatggattgaggtacgttccctatcagcggtagcaaagatttctgatgaatggagcccgcgagaacgatatagcagagccttatagcggagacagagtcaggcgtactgagctgtatatcagtcagtgtgcagcgaccgtattagccgtcgctcctcgggacggcttctctttgtcttgccaaggttcaggctacaagtataagcggcaaggaactacattgggtgtcgctagtgtgccccgggctgcgttgtccccccgctccagctcctctcctgctatgttgacaagactacgcgctgcatcctgtgttacacccaggtcgctgtctcgcatcccctttgcgcggcgtcgccatcttggcgcgggactagggtttgcccagggctgagacgacgtgaatcgccgttctcgccagtactctggcatcacggaccccgtgggacgacgggctgcaggctggggtggcctgttccagtctcgtcacaactctatgcgcgtgtgatcccaggtattctcaataaaaggagaatcatgcatctcgttgacaatcagaacgagcgaaaagaggacaaaaatggcactatcagagagaaacatatcagagagggcaagaaga

SEQ ID NO: 608017 - DNA, 486 bp, Homo sapiens
tgggcttgacgttcgcacacttctaaaagctgtcgtccgaacactggcgccacattcaggaaggccctgcgctctttgcaccggtcgactttatgctcgtatgcggctatgcctgcgtgataagcgttttccgggatatatcaaactatgctattccaggatgcatgccactgacgagtggtgccacgacgtcggcaaggcacaaggcgagcgctgacccatgcctcctggtgcctcgagacggaagatgacacgcaagctggcggctctgcctgaagctctccacatctcggggactccgtacgaggacaacgccgataactcaacgcggacccgagatcagcagccgcatcctggttcccgctctgcccaccggatcgcgcctccagcagacaaggtaagcggcagtccggaagaagctggcacagagcacgcagaaccgcgcttgccacctcccccatcaccgtcggggacactgggcatcgt

SEQ ID NO: 608018 - DNA, 789 bp, Homo sapiens
  misc_feature (3)..(3): n is a, c, g, or t
  misc_feature (430)..(430): n is a, c, g, or t
  misc_feature (505)..(505): n is a, c, g, or t
  misc_feature (667)..(667): n is a, c, g, or t
  misc_feature (699)..(699): n is a, c, g, or t
  misc_feature (757)..(757): n is a, c, g, or t
gcnagagcgaggggagcagagggaagagcgggggcgaggaagccggaacgagggaagccggaaagggcgagggaagccggaacgaggcccggcagggggggcaggagcggccaggaggcgccggcgcgggggggacggcggcccggcgacccaggggcgcgggggggggagggaccaacagagacagaagcggcggcccggggcagcagggcaggggcagaaagacgggagggcacgggggggcgccagcgcggaggaggggggcgggggggaacggggggaaaagacgcccggggcacacagaaacaggaagacacacaaagagagacacaagggggaggagaggggggggggcaccaggggggccaggcggggcgggaacgacggaccgccggggagccaccaggccggggcaagcccggcgccgganccaggcggggggaggcaggggaagcggagggggcaggggggcccgcgggaagggaagacggggggggggggaggnacggaagggggaacaaagaagcgagggcaaaggggcagaaagcagcccggcgagagcggagaggcgccgagggaggaggggcgggcagaaggaaaaggagcggggcagggcagaggaggggcggcggagccgaggaggagagcgcgaggaacgcgggcaggnacagaagcaaaggaaagcgggacaggacaganagggagacgaagcgggcaggacacggaggggaacgggacacaagcaggcaagcggganggggggcgcgcgggggcgaaaggggggaaaac

SEQ ID NO: 608019 - DNA, 1189 bp, Homo sapiens
  misc_feature (437)..(437): n is a, c, g, or t
ttcagtgtttgcccctccttgccgggccactgccccctgtgtcccctatggttcgccgggccaagtcctcttcgggtgttatgcctgcccggggtgggtccatgttcaccacggtgccactcgtcccacttgggcctctttcacgggtcccccttgggtcccgtgttgtcgcctacctaagcccgggttgtgttccccgtcccgcatttgtccccggtttttctgttcgttcctaaaacgtttcggtctccctttggggtgccacttcgttatctcggttattacccccgctttttctcttttatgtccccctgtgtgcccccaccgggtggtgacttttacctggcctcaaagcccaaaatgggggagaaataaatagtgggggtcccccgaattgagggaaattattgggcactctttgtgccacgggtcacagnctttgaaagagaaccctgggaaaagggggaaataaaggaatatctcgagttattttcctggacaccgcttttaagttcccccacgagaggattaggcgctttttttaaaaaaaagggagaaaacccaccgaattttggagagtcccacttgttgggttatatttttggtgggggattggaaggatttctttaaaaataggcctccatttgtggaagaagaatttcacacttgggctcgaagaaagtggtgttaaaattttcctggagaaaataaaatggctctaattgaccataataacccgcggaattttaaatatagatttgggggaagaagaggtttgggatattatccaattcaccctcttgaccaatatactcgtgtataaataccaggaagtgttcttctggaccactccccatatgtataattcttagagaccattaaaaatttgtgttttctgttaataggatatgtgttttggtttgttttctggagtggttttaaatatttgcccaaacaccaaatagttaaatattgtggcttccagtgaccttagatataaattggaaaggttaatgttttagtttttggaaggtaagcctgggagaccacataagccaattcactgctataatttagttgatgttaaatgaccgggaactgactccaatatgtccaggtttaactctgccccaaagccagcagacatgtaagcagatgtgccattaaaaatgattttgatccctttcca

SEQ ID NO: 608020 - DNA, 479 bp, Homo sapiens
gatcttgcgcgggagggggtgtaacactaaaatgcacatgatggtttttccggagcgaaggagcttcggtgaagtaagaacttactaatgttgacctgacgtaccggtgggcattcgaaagatgttcaaaccgtgatgcgaaactactggcggaatacatatcagccagcactttcattgataaacaaacgcaaccttgcaaagcggctgtgccacagttatgtcctgagccatcagtaacagagggcataaccctatcggtgatatggaccttaagaagggattgcattgatatccctattggaagcttgccatcgctggccaagcgattgggtcatgaggagcaaacaggcgcgctccgacaggtgaaatctaatcaagtgctgacctggggtcagttttcgctgcaaaggggtcctggcactacctagtaatgtgtggtggcgtagatatgaccctggggatatatatgcacggct

SEQ ID NO: 608021 - DNA, 390 bp, Homo sapiens
agaatggactttccagcctgaaatattcagcaccttcctggtgccagctgatgagcagccgggccctgaggctctgtgggtcttgggatcctacccaggctgctgctggagcaggagtcctagtggcctcttgggagcagaaatgatgtccccagagagacaggtacatggccaggactccagctgagagctgccttgggcggtgctgacctaggtctcacctccacagctcctagaagtccgaggcacgagcacctggctatcctgccctgtcctcaaggtgtttctatgttcacttattgcattcaaactctgaacggtcctgtgaaatggaggccacagcgccatgcctcctgggtcttccagtggcaccatcctacttcttcatgt

SEQ ID NO: 608022 - DNA, 229 bp, Homo sapiens
cacagctcatcaagatatcacagtcaacattcagagacccagctaaattttgtctctatagctggatgtaaatttttcctaacgctcttctaggaaacagtcagaagatgccaggatgtccctagaaacaaaagcttgaaagcaatttgatctaccagtcctggggtcacctcagctaatagccaattaaaagcagtatatcaaagaatgagccagctgttgtatttgg

SEQ ID NO: 608023 - DNA, 527 bp, Homo sapiens
aagtttccagccccccgggggttgaaaacagcaaccttgctacccccaggatccagcacccatttggttttgtgccctttggttatggggtccggccctgcctgggccgcaggattgcagagctggaaatgcagctactcctcgcaaggttgatccaaaagtacaaggtggtcctggccccgaaaacgggggagttaaaaagtgtggcccgcattgtcctggttcccaataaaaaagtgggcctgcagttcctccaaaaacagtgttaagttgagtttcccccttgttggggcttgtccaaaaggctccagttttggcacagtggttcctggctgctcccatgtttcaaatgaggagggaaaaaaggaggcccccaaactcaaaaggtgggaggaactccttgcacaccccctgagcttttgccacttttatcatttttgagcaactccctttcagttaaaaggccccccctttatggcattgctgtccttgggtaaaaaataaaaaaaagggacttttatttttta

SEQ ID NO: 608024 - DNA, 101 bp, Homo sapiens
gaagaactaaagacgacgagagacctcttaagtgctacccagtggcaatcacttccagatgttcctctggtgaactcacagtcctagttggctgtagcaat

SEQ ID NO: 608025 - DNA, 309 bp, Homo sapiens
gtgatgaagatgacacttttcctctattaccttccccccaaaactcacaaccccaatctaatcatgaggaaaacatcagacaaatttcaataaggaggcatcctgcaacatcgggcccagaactcctcaaaactgtcaaggtcatcaaaatcaaggaaagtctaaaaaactgtcatagccaagagaagcttgaggagatatgacaagtaaatgtaacaggtatcctggatgggatgctggaagagaaaaacgacattaggtaaaaagaaaagatctaaataaactatgaactttgattaataaaaaaaa

SEQ ID NO: 608026 - DNA, 322 bp, Homo sapiens
  misc_feature (6)..(6): n is a, c, g, or t
  misc_feature (28)..(28): n is a, c, g, or t
  misc_feature (80)..(80): n is a, c, g, or t
  misc_feature (94)..(94): n is a, c, g, or t
  misc_feature (142)..(142): n is a, c, g, or t
  misc_feature (157)..(157): n is a, c, g, or t
  misc_feature (275)..(275): n is a, c, g, or t
  misc_feature (286)..(286): n is a, c, g, or t
tgaccngttattttagagtatacctttntccccaattatatccaaaagttaactgtgaaacaaccctcaggcaggtcccntccaggaggtatantcccagaagaaggtattgttatcacaggagatgacccatgtgtgttantgcccctgaaaaccntctagtaagaccagatatagaagtggaagatagtgatattgatgatcctgaccctatgtaggcctaggctaatgtgtatgttcgtgtcttagttttaaaccaaaaagtttaaaaagtnaaaaaaaaganaaaaacagaaaaacacttatagaataaggctgtaaa

SEQ ID NO: 608027 - DNA, 368 bp, Homo sapiens
cagtttgcatcctaggaatgtcattctttttttttctttaatattatacttaagtttgagggtacatgtgcacatgtgcaggttagttacatatgtatacatgtgccacgctggtgcgctgcacccactaactcgtcatctagcattaggtatatttcccaaggctaatccggtcgcagtgtagcgaggagacacacgcgcaaccaagacgctgcagacagatggtagaccgttccaacggtggacaacgatcggagcaacggagagggccccataggtatcgaataaccacaagccctcacaagacgctgaagaaatatgacgagaagcaaagaagagcaacaggcaccatagcagaaaaaggaaaa

SEQ ID NO: 608028 - DNA, 1012 bp, Homo sapiens
ggttggtttcggagcggaggagggagccccgaccgtcacgagcgtcgaagagacaaagccgcgtacagggtggcccggcctggggtggctggggtgagcccggtggcttgttggtagccccagccctgctgcggagtggcccttctggaccctgctgctgcctgcctgctgcctgcctgtcgcctgctctcgcaaccatgtgtcctggtgctggtcctcgtctctcctgctccccttccccctgcatacctgctggaccccctcctggtggtcaccctcagtctcgtgtcctgggtggcctgcaggtctttgtgcctaccctgtcttccagtgcgtgttctggtgtcccaagatcgatgcccgatgtctacttacctgttgtactctcatgtaagcaattgagtcagcactatcacatgagagttccgagttactaccaggaagacaatattgcacgagagcgtggttggcattcttgtgcaaatgaacccggcgagatgtgatttgccagtttggccttgacacgtgttggtgctgcgctcttggtactctacgagcgaaacgctacgtacagttgtactacggaacctgtatggttggcagaccatgcaggctgcgtgacactacgtggtgcatacattggcctgtcactgaactacccttggcttggctaagcctagtactaccaccatacctgggtggaatcgcccaaagatcttcccccaggaagcaatgtatacgaagctttgtgttccacattcgacgttccatagcccccattccaatgactcaggcctaagctaccagactagaaggggcatcaaacttatctatattacagggtagaatggatagcagtatcaaataccattggttaggggcccagggaagttgggtcatcgaaatcatccctttggaccctttcgttgatacacgaccgtagtccttccgagccatccctcatatacgtgctctggcaattatccagtgtatgttaggccaacccagacga

SEQ ID NO: 608029 - DNA, 267 bp, Homo sapiens
ggtgacaggcctgacagctactgagtgagcagctggagccctactcactgcgggtcgtgcgtctgtgcagcactggggtaccaccacccagtgcaggtgagcggcctcacggaccgtagtttccacctgtgtcactgagaggcaggatggagctagggcaggcatgggaattttttgggctgtggtctatttttggttcattgcagcattgattacatgtgaatgtggactgttcttgcgaaagtctagacctgtcgtatttgtaat

SEQ ID NO: 608030 - DNA, 406 bp, Homo sapiens
aatggtcctgttggtctgcaccccatgtgagcttctgtcctgttgttccactgagctgcgtcccttcttaaggtcactctgccctgccaacccacaaccagcatgtcactggtgggcctgacagggctgccccaaggtctgtcctgccctgttccccccagcccctggctcccagctcttcgggtctgaaccttgatactacgtgactatgaacccacacagaaggatatacagtggtcacctccactgaccaggcctcccctcctccctcctgaggcacgcgcttagctagtgaagtgaagctcggccctcaggcggaagacaccacttcgcccatctgctgccttgccggtctcccggctccagccttgccaagggctgtcttctgcacagttgtgcctacatt

SEQ ID NO: 608031 - DNA, 1049 bp, Homo sapiens
gcttctagtgagcctggtgccatgagcccaccagtgttcctgtacgggaaggtgcctggtcatgctcaccgtaggctgctaggccagagccatgccaggtctgctgatccctccgaagcttgggatacagcataggtggaccttggtcggctcatcagacgtttccgctgccactactccacgttcgttgtgtgtcgcgcaaagtgaacttacttgagagtgctgaagtcgtgtctcgtcccgttctcagtgaatgctgggcccccagcctgggccagacaataagattgtcgggggagagggtcgtgagtctgtaaaacgagcagtacagtttggcgttttctactacaatcgatcattatttatattgaagagtaaatccgatcctgtcggttcactggtgtcgttctgactcctgagacttttctgcgtgatggctatgccttcgcacactagagtggtcggtagatggcggcctagttaagacgatgcctgtagaatggtaccatcgttttgctcaactgtccatgtttccctctcctagtcagttgtttgctcaaacgaacgttgataagttgaaaagaacaccagaattcgtcgggggagtccgggaccttataccattgagaatccttacacacgaaatgctggtgggcaagggcatcacaagtcatggtgagtgtctggctttgacttactgtagccgctcctagatagagggttggccacaagcagggtagtagaacgcgcccaggtgtatcttccaacaaaggcgatgagagtagcagcagcttagtcttgatccgtccaggaagtgcatgagcttcaggttaagcatgagcgcaggccgtgttgatcagtgctgtgaaagaagcccgacaagtgagaaataacgttgggcccctcccgcatttactggacagagaagttacaaggtaaagaccgttaaaacaccatgttttgaagggtagcggaaataatttcagaaacaacagtattggtggtacaaagaggaattcttatatacataaaaaggcataagagacaca

SEQ ID NO: 608032 - DNA, 220 bp, Homo sapiens
ccatttgcttttgggggggggggggccccccccccccctaaagatcccttcgggaaaaaaccctccccccccccccccaggggtttccaagttccccgtttggtttgggggagtgttccacgcccccccccccccaccttaacacccaggggcgggaaggtaaaatttttttcccctgccaagaaatttttaaaaaaacaggtacttggccctctttcta

SEQ ID NO: 608033 - DNA, 1259 bp, Homo sapiens
gagtgctacggggtggccggagccttgccctggtgaccgctgacccgttacctggattcggggctggacgcagcaagcggggccgctgtgtacccaagactcaccgatcctcagggccagtgacggtgcacacaactgtgtcaggatgcttgaggctaccctcatgtgaagggagcaggaccgtaccggatctactgaaccctgtgtgtgggcagcgtgccctcacggagaggcatcctgcaagccttttcgaggcgcctaggtgacaggaggaacttcccgcgcttgaagtgaacacagcgaactgccacaggcgactcaacgcactcgttacgggggacgccttctcgagcatacggagattccacaggaacttgtgaacgctgaacccacgagacatcccggtcgcagcgcacagggccacgacggaagccgtaggcctgacaggggcaccaacactgacggccttgaatcccccaacccaagccctgtacttcacacttcacctttagagagactcccacgtttcaggacagccaccacattggggattcgaaggcaatcaaccagtggacaacacggggacgtacacaagacatggttccaaggaggcgaattcgctcaccacaaagaaagacccccattgactatgagaccaccccaacagacaggaacccaacaggatcacaggagcaaccgccagaagcaccaggaacacatgcgacgattcccacagtcaccaaaagagtagacttacacacggcttctcgcagtctctcctgtgggacaggtcccacctgtcgctggtgtgcggccaccgggtctagtaccctggggcaatatagggtaacgcccagcggagacgactactcccgatccctcgggacgcccggtgagttaccgccaggcggaatggtgcattgacagctgctcatacagcaaaggggtgtgttgcgaaaggggcacgaccaacaggacaccgcaccgaggtacttcgacgggtccactagcggacaggagagatacaaacaactctagggacaccaacgacgaccaatactcgggacgaaaagccctgctgtgcgcggatccctacactgcggcggtccccactcaacataagtagcacaatacgcgtagcagagggctagccacacgactgagaaacagacgttgcccgacgaagcaaagacgacccacgcagggttcgattgcgaatccaagggcagacagttgtaacacacaacactgatcaacag

SEQ ID NO: 608034 - DNA, 172 bp, Homo sapiens
acctctatttcactcccacttgtctggggcagccggtactccagcgccgggccgggtgagggcagcagtggcacacagttaaacataaagacattgtggtcctggaaccatctagccaccttggcactcccatgtctgcctcccccaggcagccctccaggaggtagatata

SEQ ID NO: 608035 - DNA, 271 bp, Homo sapiens
gactaagaggcttgtgtatctcttggctgtctagctttttcaactttctgatgagtctttcattatcatcatctggaattgtcacgtgaatgatgttaatgtgtcttcaacacctgatgcagtagtattaacatatgggtgatgaatttatttttcttgggagggctcttagaaggagtgtgctctcacttaatcgccgtactcaaacatttctgggctttttaattgatgaacttaatttgggctttgtttctgagtatcttctccagcc

SEQ ID NO: 608036 - DNA, 352 bp, Homo sapiens
cacctgggcttcccaggtaacttgggattgcaggcgtcaggcatcaatacagcctgaaaaaattacattttcgggctcggtgtgatggctcgcgcctgtggtcccagcactttgggaggctgaggtgggccgttcatggggtcaggagttcaggaacagcctgaccagcgtggtgaagccccatctctgctaaaaatacaaaggttggcctggcgtggtggcgcgtgcctgtggtcccagctactcgggaggctggggcaggggaatcgcttgagcctgggagcgtagactgcggtgggctgagattgcgccactgcactccagcctgggtgacggagcaagactccatctc

SEQ ID NO: 608037 - DNA, 177 bp, Homo sapiens
ggaatgagatgacttttagaaagcaacatggggtataaagcagtaagggatgatgggtgtctaggaaaattttttttcatgattgtgtccggaatgtatgtctcggaattagctgcctactttcacctagatgaaaaaaagagtgggggactaatgtgatacccgggtcccgagctc

SEQ ID NO: 608038 - DNA, 484 bp, Homo sapiens
tttgatgataacatagtcgatagagatagaagtacacagaagcaatatagccatgagtatcgactcactatcttatatacatatcctagtagaaaggtcggatgaatcgtgacaatcctagtcgaaaaggtgaaggatacttctccacggcttagattctagggtggtcctggtgaatagttttcaccaataaaatgtgacaagagtaacactgcaggagttccaagtctcagctttgaggccttagttttcattttcactctcctgtccagagactgtcatgtgaggaggcctaggtctgggtgccttgatagatgagcattcacatggacgaaagaggagcagccaacagccagcaaacaccctcccaacatgtgcatgaggccatccaggacctctccagatctcaggaaagcagctgcctggctgctgacacttgagtgatcccaggcgagataaccagaaggatcacccggctaaagtg

SEQ ID NO: 608039 - DNA, 259 bp, Homo sapiens
  misc_feature (15)..(15): n is a, c, g, or t
  misc_feature (31)..(33): n is a, c, g, or t
  misc_feature (95)..(95): n is a, c, g, or t
ccctttgagaggggntcaggtgatcatattnnngtagggcacgatgcaggacaggcggaaggtcaaagcagctctgcccagccctaccccagcanagccctggaaaggcacagtcacgaagcacagcacctggttccaacaagcatgagaggcacagcacaggccgggcgcagtgagaagcctgtggctgtgctgacattcattagatcatagtcattgttggtctcgtatggtgtcccaacagtatgggcctaggggc

SEQ ID NO: 608040 - DNA, 719 bp, Homo sapiens
gcacatggcttcgatgttagccgggaccgatcagatgcggatgctatagaagagcaaataagggaaggttagagttgcctttatgcatcatggctcaacttatggaggactagaaggaatccgcctatggcgaatactcgaggtcttacagccacgtgcagtatcacaggcagttgcacatgggtgttcaattagccatctacatccttggagcgatctccgtaccatttgatacaacaggcgcaactagcatttggcagcagccgggccgttaagctactagcaagacatccagacaacacatactcagatgtaacccacaaagacctgctgggcctttgcatgccgacaccaatgcgcgcaatgccatgcaaaggcaaggccgtggcagttgtcaccaaacacggaccaagatacttcaaccaaacacattcaggagcaagtgcccacctgtgatactcatggatgttgcacaagaccagcaacgcggtgtatgtatccagggcagaaatcactccgacgtgtccagcacacaccccttgccgttgtgaacaagccaagggcccaagggagtggcgtatggccaacattgcgacctttacggcataggcggcctttaagcgccgtggatacgtacaatccgcatctagtaccaacagatggccaccaaaacgcgattacaacttggtaattgaggtcagtcccgagagaaccccaac

SEQ ID NO: 608041 - DNA, 106 bp, Homo sapiens
cagtaatgtagacacagtccttactaagctcacgaagagcagtagctggggagggactttgatgctcttatttacaatcccaacaattcactgctctcctttcaag

SEQ ID NO: 608042 - DNA, 255 bp, Homo sapiens
  misc_feature (71)..(71): n is a, c, g, or t
tttttggggggccccccccccccccccgggcaaaaaaaaaaccccccttttttttttaagtttgggttgantgacccaaaaattaaaaaaaaggggggccaagccccgggcccagttttttggggccccttgggtttcccccccctttttaggggcccagggggttttgggaaaaccacccaggactgtgggtttggggggggccaaggcccccccccccaaaaaggggaaaaaatgggccctttgtttttgtta

SEQ ID NO: 608043 - DNA, 120 bp, Homo sapiens
gccgtatgaggctctccaactcgggacgttcacaactaagtctcccgcagaaacttctccagtcttcttcctcagagagcagcccacatcccctcagcctggggggtacgagctcgaatt

SEQ ID NO: 608044 - DNA, 450 bp, Homo sapiens
gcacgagtacaccccaagaccaatgatcagctagttcgccgtgcatatttaaggcaaacccatatctgtaaatcaatatggtgccaataaatactattgcagaatggaaaaagccattaataatccatccccagaagatgtaaacagagaaaaattgacccttctgtcctaatttgtacaattgtgggtaccgctcaagtaatctactactaacaaattgatcaaatacaccaatgacaaaagggggccaaacagtgaagaataagttgtagaaactcattgtccatgattccataatggattgacctgaaaaggcattggcaaaaacgtaccaaaactgcgtcatgtataatgcttgtattcttgtaaaaagagtacaaaattgcgacagaaattctttgataagaccaggagccatggacaagtaatagtttttttaaaaatttaaat

SEQ ID NO: 608045 - DNA, 131 bp, Homo sapiens
gtttgagtaaagacctaggatgtggaaatgcctgggctcatatggtacatagttgcattcaactttttaataaaccgtctgacagttttccaaagtggttgtaccgttttgcttttttttttttttgggcc

SEQ ID NO: 608046 - DNA, 321 bp, Homo sapiens
cgtgtgccctttaacctgtctatgggtactggtatcacgatcggatacactcgggccaggcaccagatacagcttcttttcgttggcgattttacaaagactgtgaagatcatgtcgaacttataccctgcagatagaaccatacatggaatactaggcctagattaatgtactttatcaatgagacactccggaacctggtattcctgcttttgtcacctaccatttgtgaggtcttcattatgtctcttcagtatcatattcttctactctcacactacttataggggccaagatgcacattctgatcttggaactctg

SEQ ID NO: 608047 - DNA, 323 bp, Homo sapiens
ggaataatattccaatgtatggatagaccacattttgtttatccattcatctgtagatgaacatttgggctgttttcacttttggctattctgaacaatgctgcgaagaacaagttttttttgtacaagcgtgcaagttttttgtggatgtatgttttcatttctcttaggcaaatagagagacacaattttactttttatttattttattttttatttttagagagacaaggtcttgctctgttgcccacgctgaagtgcagtggcgccatcatagctcactgtagcctgcaactctatggattacatgttcctcctgcctc

SEQ ID NO: 608048 - DNA, 246 bp, Homo sapiens
tgtgcgtccaccagccataccaaaccatgagaattgcaacagtgtgagaaaaaaagaaccaaaacttccaatgccctgctttttttcttaaaagtactttaaaaatgtgaaattttgtttgtattttttatttacattttatattttttgtacatatttgttatggtcagccaatttttaattgatctcgtgatgcaccaaacccagccttcgagagctgttctcttgtacctaacttcttgactt

SEQ ID NO: 608049 - DNA, 900 bp, Homo sapiens
  misc_feature (232)..(232): n is a, c, g, or t
  misc_feature (256)..(256): n is a, c, g, or t
  misc_feature (285)..(285): n is a, c, g, or t
  misc_feature (317)..(317): n is a, c, g, or t
  misc_feature (331)..(331): n is a, c, g, or t
  misc_feature (348)..(348): n is a, c, g, or t
  misc_feature (351)..(351): n is a, c, g, or t
  misc_feature (362)..(363): n is a, c, g, or t
  misc_feature (365)..(365): n is a, c, g, or t
  misc_feature (373)..(373): n is a, c, g, or t
  misc_feature (405)..(405): n is a, c, g, or t
  misc_feature (410)..(411): n is a, c, g, or t
  misc_feature (415)..(415): n is a, c, g, or t
  misc_feature (422)..(422): n is a, c, g, or t
  misc_feature (430)..(430): n is a, c, g, or t
  misc_feature (435)..(435): n is a, c, g, or t
  misc_feature (441)..(441): n is a, c, g, or t
  misc_feature (443)..(443): n is a, c, g, or t
  misc_feature (448)..(448): n is a, c, g, or t
  misc_feature (456)..(457): n is a, c, g, or t
  misc_feature (460)..(460): n is a, c, g, or t
  misc_feature (463)..(463): n is a, c, g, or t
  misc_feature (485)..(485): n is a, c, g, or t
  misc_feature (487)..(487): n is a, c, g, or t
  misc_feature (497)..(498): n is a, c, g, or t
  misc_feature (507)..(507): n is a, c, g, or t
  misc_feature (517)..(517): n is a, c, g, or t
  misc_feature (531)..(531): n is a, c, g, or t
  misc_feature (538)..(538): n is a, c, g, or t
  misc_feature (570)..(570): n is a, c, g, or t
  misc_feature (575)..(575): n is a, c, g, or t
  misc_feature (603)..(603): n is a, c, g, or t
  misc_feature (636)..(636): n is a, c, g, or t
  misc_feature (639)..(640): n is a, c, g, or t
  misc_feature (653)..(653): n is a, c, g, or t
  misc_feature (667)..(667): n is a, c, g, or t
  misc_feature (688)..(688): n is a, c, g, or t
  misc_feature (692)..(692): n is a, c, g, or t
  misc_feature (715)..(715): n is a, c, g, or t
  misc_feature (728)..(728): n is a, c, g, or t
  misc_feature (755)..(755): n is a, c, g, or t
  misc_feature (761)..(761): n is a, c, g, or t
  misc_feature (784)..(784): n is a, c, g, or t
  misc_feature (787)..(787): n is a, c, g, or t
  misc_feature (790)..(790): n is a, c, g, or t
  misc_feature (809)..(809): n is a, c, g, or t
  misc_feature (898)..(898): n is a, c, g, or t
tagtgcggtgttgcgggacggggccgaggcccggtcggttggggcgtgggggcggagaggatggagcctccgaggcgttaggcgactctgtcatctctgggcgtgcagccgtcgtttcctggcgcggcccgtgtgatggtgccgggaggaaggaagcgcagtgacagtgcctaagttggagccggggttccgggggtgaggaggcccgcggacggcggaatcttggcgagcntgccgcgggcctgggcgagcaggnacaaaaggaggcggcggcccagcgaggantcgcgggagcatcccggcaggggagcctcccnctgcagaaatctcncggggccaaatttgcanctntaccttgccanncntacaaggntaatttttaaaggggtagactttagagccatnttccnnttcntccaagnttattagnaacantaccgntntaagnaggatccnnacnttnaaaacctttcttccagtagtgnangatagtccanntcctaagangacagcgccntctctctattcagntctttgnatatatactatcagacatcacacagcgtcccntcacncaccaaatgcgtaccatggggagtatgnacatcaaaatagggcagcccccctctcaggttnganncagagccgaacantcactttcttcagnggggaacagattgcacacacnaccntgccaccgcacacaagaaagaangtccgtccgtgtncagggcgccaagagaaggaaagaatgnggagtngtcgtgtcttcgacactaaattncanttntgtcgaagaatgaaaactnctcaccaattctctccttatcgcacaagcagcaaagcaatatgagggagccttcgatgccttccacccctcccgaatagtttctccccngt

SEQ ID NO: 608050 - DNA, 378 bp, Homo sapiens
  misc_feature (47)..(47): n is a, c, g, or t
  misc_feature (73)..(73): n is a, c, g, or t
  misc_feature (77)..(78): n is a, c, g, or t
  misc_feature (101)..(103): n is a, c, g, or t
  misc_feature (128)..(129): n is a, c, g, or t
  misc_feature (155)..(155): n is a, c, g, or t
  misc_feature (194)..(194): n is a, c, g, or t
  misc_feature (209)..(209): n is a, c, g, or t
  misc_feature (265)..(265): n is a, c, g, or t
  misc_feature (282)..(282): n is a, c, g, or t
  misc_feature (288)..(288): n is a, c, g, or t
  misc_feature (293)..(293): n is a, c, g, or t
  misc_feature (310)..(310): n is a, c, g, or t
  misc_feature (363)..(363): n is a, c, g, or t
atttatcctattcttttttcaaaaagtcaccctcacgtctgcttganagttttagaggaatataatgtatganagannattccaataacataatgtacaannntgttgtcacatacagaggagcaatnntctacgtattggggactattgccgcnggaaggggggcctgatcttcatactcatcttcctcattnagtaccatgcccccntccccttcctccctactacaccatcatctgtgccatgctttgccatgtcccaggtntactgtcccccccagtngtatcngccgnttggctcggctgcatgncctctattataccaccctccaccgccgtcttctttagaccactgttttccggnatctgatgtttcacc

SEQ ID NO: 608051 - DNA, 672 bp, Homo sapiens
agcggcttgttttttttctgttttgatatttttattttttctgcagtcaccggctgccaacataatctgcaccaactggagatcagaaaccaaaaaaaaaaaaaaaaaaaaatttaaccacaacaaaaaaaaagtcaaaaaaaccaaaacagaccttaaaaccagaacagccaaacagctcaggaggcacacagtaaccgtgcgtgcggggttaaccaggggcgcttccaagggccaaaagcgcaagcgttacggggggccactgggcacaaccttcaataccagggaaacacggcacacgggagcgcttacacagccaaaagcaccgaaccaccgccatggcagcacattctgttgaggagggtgacaacatgtggggggacacttacccacttcatacacctttattcccactttccgggatatcttctggaggacagaacttcgggtgacccatttgggatttattcaaaactctggccctttaaaagcaattctttaaaaaattggtaccggaattttgtacccgggaacttgtggtattttttgaccgtgtaaaacccgtgttgattgccagggttcccagggtcatatttttgcgatgggacccccaatctttcagaaaactggtgctaactcatggtttgaaagcgttccaagggttagagaaat

SEQ ID NO: 608052 - DNA, 826 bp, Homo sapiens
gcattcctttctcgtaccccgtgacatcttagcgggtgctgatgtttgccgtagccgactggctcctaagggcaaggatcgattgggttggtcgccaagacacgaactaacatcgctcgctggatgatagagatcatactcttaggctccgaagcgtctgttattgagaatagctgggaagtaccgtcgatggggtacaagcgagacctcgtgacggaatgatccagaccagggctgatagcctaggatctatggtcacattcttcggcttgcttgaacctgacgagcctatgtagggaaacctctgactactacgcagtactactgtctggtgttaggggtaaatactggtgtacactctacttagcaagaggccacaagacactgtttgaatcgtgggtgacacgaggctagtgccggaatagaaataccgtacgagtacgctggtgacaccaccctcgtgaacttattccaggtttgcattgcccaagcgattgaagttcctgtaaccctccaaatttacgtacagcattgctcaagtagccgaggaactgagctgagcaaaaggtatgatcctttggtcaaccgtacggaatatcattcggacgtgccataccttttaatgctctgcctaaaccattatttcccctttgggacttcaacgcttattgctttgatatttcatatattctgacaacaagttaccaacaatcatgcttcagaacattcagtcttctgaaagcggggcaataccgtcccaccagactacgcagttcacctatgggcactcagtattagtaggcccccggtcaacaatttgaagaac

SEQ ID NO: 608053 - DNA, 204 bp, Homo sapiens
tgtagatgaggaagctcaaaataccatggtctgtgatagttctgtctaccatggtcaagatcagatatattaggattttttctcctgcacccaatatttcgcattttgtatttctaacagttgttctgtgtctctctttctctttctcttgccttttttaggattattttttctcattccagttataatttccctttcccaatt

SEQ ID NO: 608054 - DNA, 146 bp, Homo sapiens
  misc_feature (65)..(65): n is a, c, g, or t
  misc_feature (107)..(107): n is a, c, g, or t
  misc_feature (128)..(128): n is a, c, g, or t
aaaaacaaaaaacaaacaaaaaaaaacgggtagaacgttaggttcacaccatccaaagacgtttncgtcttcttgtaggtaaagccttaaggacaacagtgatggtncctgttccctatgagaagatnctgcgagaccagtcggct

SEQ ID NO: 608055 - DNA, 301 bp, Homo sapiens
  misc_feature (188)..(188): n is a, c, g, or t
ttcccttaaggacagatttaaaaaatttcttgctgggcgcataggtcacgcctgtaatcccagtactttgggaggccgaggcggatcataaggtcaggagatcgaaaccatcctggccaagacgatgaaaccccgtctccactaaaaatacaaaaattacaggctggttgtggcagctcatgactgtnatcccagcactttgggaggcccaggtgggaggatcaatttgaggccagagtttgaaaccagcctaggtaacatagtgagaccccctattctctacgaaaaattttaaaccatt

SEQ ID NO: 608056 - DNA, 301 bp, Homo sapiens
  misc_feature (1)..(1): n is a, c, g, or t
  misc_feature (81)..(81): n is a, c, g, or t
  misc_feature (109)..(109): n is a, c, g, or t
nttggggggggggggtttaggggtgaaaggtccaccccaggggacccattttgttttgattgagaagattggtgagaaaantggggggatttgtgcccaaaaatgggantgggggggcccattttggggttttccttccccccttaaggggagaaaaagggtctttccctttccccaaaaatgggggtcctttcccccccctctttcctgccccctggggggggggggggggttattttttgggggacgggtggggccttttgtggttggggaaaaataaaaaaaaatggggggcccttta

SEQ ID NO: 608057 - DNA, 1019 bp, Homo sapiens
atcccagcactttggagaggccgaggctggcgctggacttaccctgcaggctcacggagctttgagaccagcttgaccaacactgcgacgaaacccgtggtctgtactacaaaatttcaaaaaattagccaggcatggtggcacatgcctgtaatctcagctactcaggaggctgaggcaggagaatcgcttgaacccaggaagcggaggtggcagtgagccgagatcgcgccattgcactccagactgggcaaccaagagtgaaactctgtctcaaacaaataaaaagaaatcatagagctatctcattgcctttcaactctgcttctaaaaccctgactgcttctgcatgatgcattctaagaaagatcatgcgatgtatattcataccagtggacaagcagggatctacagtgtctcatgtccaacaacagtccggatcgtctcacgactccatttagaaatccagtgcttctatcctgctcatacctgaactggaaaactgcgataaaatctcgaagccgaaagctccacggacacgcaaacacacaaaacaagaacaaagaccacacacagcacagaacacacacccaaacaacacacacccaccacccacacacacacccaaggaaccggcacggcacagcaaccaagtataaacgagtaacaagagaacagagcacagacacaagagaagaaaacaacaacaatcacatacgtgtgataacactgtccggacacacggagacggcacagcaaaagaggacatacaagcaaaagaacacacgaaaataaaacccgcccaacgttgaacaaaattagaccaacgccacgaacgagaaacgaccgcgcgccgccagcggacgccgaaccaggggagcggcacgaagacatccgacgagcacaacgagaggcaccggcaagacaaagatcgacacgacatcacatgcgagtcgagacagtacgctcgatagacagtgttcaagcagccgggtctaccgagaacacaaaaagacatc

SEQ ID NO: 608058 - DNA, 510 bp, Homo sapiens
gcattgaatatcctgttggtttactaagagacatgcctatatcttagttcatggggtgagaagagaggttaaatgttctttcccgttccctagagggaagtggggttttgccccaccacatttacacaacaaaattgctcccaagtagaaaaggggcttagattatatgtagacaaaaataaagcaaatacccactgaacatattaatctcattattcaataattaaaatgattgaatgggtgaattaagagtgaattagttcacataattgcttaacctcttttcatttataaaataagggtttgacctatgatctctgatttttattataactttaaattcttttttaaaaattattgtcagccggacatggtggctcatacctaaaatcccagcattttggaaggctgaagtgagaggatcacttgagaccaggagttcgagaccaacctgggcaacagggagacactgttcctacaataaataaataaataaatatttaaaaatta

SEQ ID NO: 608059 - DNA, 122 bp, Homo sapiens
tcatgatccagtcacctcttaaagggcttacctctcaatactgccacattgggaattaagtttcgacatgagtttcgcaggagacatacaaatcatagcatttacaaagcctaatatgttgt

SEQ ID NO: 608060 - DNA, 275 bp, Homo sapiens
ggagcttatctccaagtgctgggattacaggcgtagtacccatgcctggcctgtaatacttgttattgagtaacaattcaaagaaggaaaatataccctgataaaatgtacaagtataaatttgacctgagaaaaaaactgtccgtaaaaattacgaaaaacatataccatggctgaagacatggtgaataacatttgatgccgaccacaatacaacagacccccatgaagaagcacattttaattataaaccttaaataaaatagctcaaatat

SEQ ID NO: 608061 - DNA, 120 bp, Homo sapiens
ccctttagcccggcctagcccacctaagctcgcccgagagctcgcgtaaagcacaagacataaaacccccgcctatgtacgccaagctatgactgtcatgtatgtatagacagacactct

SEQ ID NO: 608062 - DNA, 1340 bp, Homo sapiens
agcggagtcgctgcccagaccggtcaggacgtgggacgcaaggggcaatcctgccctggttcgcaggtccgaggcgggcgcggtggcccttcgggccaggggcagggcacgggacaggaagcagacagcagccgacagaggagaggcacacacgagacaagacgacacgccaaacagagagtgcaacaacacaccaagcaaaccaacaacaacgagagacaacaaaaggacaaacaacgcacacaaagacacaaaaccacacacaaaacagagaccaccaacaccacagcccaccacgcccaaacggacagaacacgggagaggtagagcgaatcagggaagaaggggaaaaagaaagaccaaacacaaagacacagaagagcgagacagggaaacaccaaaacaccaaagagagaagcacaaaacagacagaaaacgcaacgcgagacacacggacgacacaggagacgaccaaagaaggcagcaaccagcgcaaagcggagagacaagaagaaagacaaagagaggagaagaggctgaagggagagagagagacaggagagcaacaggcggagcggaacggagggagcgaaacaggaagagcacatgagcagccgaccggacgacaggcgaacgagagggcagcggagacgaggcgaagagcgaaccaaggaactgccacggacggaggcaggcagaggagacgaggccaccacgcagcagaagcgagagaggcagaagcgacagaagaagaagaagagaggaagacgagaagcgagaggagagacgtgacaccgcgaacaagaaagacacagacgagaccacaggagagacgacacagcgggacagcagacaccaccacaggcagagcaaagggagcggggccgaagccggagcgagcatcgcgagcggaggagagaacccaggcaacgagacacaaagaggcgagccgagcggagccgcccgaacgcaaaaacaggacgccgacgagacgcaggacaggggagcgcaagacgcaggagaggagagggagcacggatcggcgaacaaggaggacgagccggaagcggaccaagcggaggaacaaacaccaagggagaggcccgggccaccgagggcccaagagagagaaaggagagcaccgcagacagagaagaaagcagaggggaaagataagagaaaagacagaacagagagaagtcctaggagcccaagaatgacgcaggagacagacagaagacacacacgagaacaggacccaccgcgcacaggagactagaggcaaacgacacaaggagcaaggtcacacgcagaaaggggagccgacaagaccaccagcg

SEQ ID NO: 608063 - DNA, 84 bp, Homo sapiens
cctgggctacagagtgcagtggcaatctcagctcactacagcctctgcactctagcctgggctacagagtgagactccatctca

SEQ ID NO: 608064 - DNA, 367 bp, Homo sapiens
atgatctctgcaacctctacctcccaggttcaagcaattcttgtgcctcagcctcccaagtaactgggactacaggtgcacgctaccacacctggctgattttttttgttttagtagagacagggtttcaaccatgttgcccaggttggtctcaaactcctgagctcaggcaatccacccgccttggcctcccaaagtgctaggattacaggtgtgagccaccacacccagctattttttctttcgtattttaattttaaagttggggggggtctcaatttgttaccctggctggtctcgaactcccggacttaagcgatcctctggctccaaggccactaccagtctcaggtttctttactaaaag

SEQ ID NO: 608065 - DNA, 241 bp, Homo sapiens
actctgaggatccccccgatagccgacgggttgggccagcgtgcctgtgcagctaggactggcaggcgggctaccctgggaaggacaggagggtgggctggggcccagcttgggaccctccaaggcacctggctgtgtgagtggcaggtagaagggagtgaggagacccgagggggtgaggcggccagcagggttgggccagcccttttccccaagatacaggctgtcgggctagtcgggg

SEQ ID NO: 608066 - DNA, 289 bp, Homo sapiens
cacgatggcgttccaaccacactcaggccaccaacgatccccctgatgtgaccgtgtttcccaaagagcctgtggagctgggacattccaccaccctcatctgacacattgatcagttcttcccaccagtgctcaacgtcacgtggctgtgcaacggcgaactggtcactgagggtgtcgctgaaaggctcttcctgccgagaacagataacagcttccacaagttccattacctgacctttgtgccctcagcaaaggacttctatgactgcagggtggcgcactgggg

SEQ ID NO: 608067 - DNA, 448 bp, Homo sapiens
caggaaacagctatatctaacaatttacgtgaatttatgtcgtggagcgattacaaataaatagcactaatgagctctaaaaaccatagttgtgcccgtgtctttcaactataggcagtaacctgtcattccacgaggatgctgactaaatgtttacgtggcacttttttggattctcatatttactacgggcttctgttggcactttaagcctaaacgacactcaccccatgttgtgaattggaaaaccccgtcccgatgaagaattagccctcccaaaatgtagattattttatttcaagggatagggcagattaccattagaagcaaaattaaaagtacaagctgggcaaactgacagaatactagataggagagactaattccaaccttctaaatttggctagtaaagtgcaataaaggcattgataagttctgttagctcacc

SEQ ID NO: 608068 - DNA, 441 bp, Homo sapiens
caaggctctgtgggccaaaaatggaataccatccccctgcgaacaagtctctgcagagaatctgtgctgtggactatgatgacagctattatgaaatccctgaatggttatgaggcaactactgtggtctcttatggagcaggaagcattcacgagcatggtgtcatctgactccacatcaccagattcttctttaacagaagaatcacgtactgagacagccagtagtttatcccagaagatttgtaatgggggattatctcctggtaaccccagagattcttaggacatgaaggaaattgagccccattattaaagtccctccctctgattataatcaggataaaggatttatcaaaggctttccaaagctcaataaaagtttccgaagacccacaaagcagtcattgggctcccattagaaaagaaagatatgcaaat

SEQ ID NO: 608069 - DNA, 449 bp, Homo sapiens
  misc_feature (425)..(425): n is a, c, g, or t
atctcgctcgtgcttcttctttcccactgtgaatgatctcagtgcttgcatatgtactgtgtgcctcatacgttgaagttcattcatgctcaattggcccatacctgtagtgtccgataacattcgctcgagcctgactcccaggatctagttcccttgcgcctcccgccgactcagcgcctttacctgcccctaccgctgactagtcccggaacgacatctggatccaatcattcgacgatatcgcactacacgcatgcctagggaacatccgatccattaccaacctcctgtccctgtacttacacgtctctaatttgattcttctatgaataggccttatggatctcagggctggacccgacgtcctagtggacctgactgtgaaattcctgtcaaacaaacaccacttttcaatggttcgntactccctgcgtactgaaagtctt

SEQ ID NO: 608070 - DNA, 366 bp, Homo sapiens
cgcgtgccaattaagacggtttctccctcttgctgacgtgcccagccgtgataatgaccagcttggcgtctgccgttacattctagtcttctgccagagacaatctttggtgtctaaggaaaaggctgccatgttggagatccatcatctctcccttcaatttgtcttcgatgacactctaccagagcaagttcatctgccaggtccttcattaagatactgatggcacaggccatgacaacagcaccaagcccgacaactgtaatcttattctggggggtctgttcttcctttagaagattataaatcagctgatcctttagagttgccataatagaacttggaaccacaaggaatcgggacatg

SEQ ID NO: 608071 - DNA, 575 bp, Homo sapiens
tgggaaaaagggaggggcttcaaatatctattatggcctatggcctgccggtagataaaagggtaatagggaaggactatgtacgccactcgactatgggggccaaacccagagaaagaatatcttattgggagtcatacagtaatttatgtttccccgtcaaagattcttggtgggagggactcccagttccaggccttttatctattaccaccagacacgaaaggggaagttcctttacacaagattcacataatcatccagaattaaaacccagtgagagaagcgggagttagctgggcaaagccacagcatttttaaccactcctgtgggaggaacatttacccatattattccatatgtgtttgtgcatatacctgggtagcctctcagctgggtgctctcaaaaaaattcccagttggcaatacattttaccgggggtgttgacccactgtggagttgtgtgttttcacggggacctgtctcaaatatagtgctctaaatagactcaaatttaagtgaggggacaggcaaaatttggcataatgtagattcatccccaaaaatatattg

SEQ ID NO: 608072 - DNA, 161 bp, Homo sapiens
ccttatctcttaaaagagtagagggggctgggcgtggtggcttatgcctataatcccaagccctttggggggccaaggggggccgttttcctggggtcgggggtttgcgccccgcctggccagcgtggtgaaaccccgtttttattaaaaatacaaaagta

SEQ ID NO: 608073 - DNA, 137 bp, Homo sapiens
ctgatctcatgtactgttgtcaggtagatgccctgggaagctggcacagcgagagtgtctgaggtgtctcgcaggaagtgcagcacgaagggcaaggtgcacagcaggcagagtgtcggccaccagccagagttggt

SEQ ID NO: 608074 - DNA, 347 bp, Homo sapiens
gggggagcagcgacagcaatatgagaacagcaaatattgctgctggttcttcctctggaagcttcgtctcagaggggcacctggccatatggggtgtcagtctgcccctactgggaggtgcctcccagttaggctacttggcagtcagggacccacttgaggaggcagtctgtctgttctcagatcttaaactgcatgctgggagaaccaccactctcttcaaagctgtcagacagggacatttaagtctgcagcttgctctttctttctttctttctttctttctttctttctttctttctttctttctttctttctttctttttctttccttgcttgttccgctg

SEQ ID NO: 608075 - DNA, 325 bp, Homo sapiens
  misc_feature (3)..(4): n is a, c, g, or t
  misc_feature (25)..(25): n is a, c, g, or t
  misc_feature (27)..(27): n is a, c, g, or t
  misc_feature (29)..(29): n is a, c, g, or t
  misc_feature (36)..(36): n is a, c, g, or t
  misc_feature (41)..(41): n is a, c, g, or t
  misc_feature (50)..(50): n is a, c, g, or t
  misc_feature (56)..(56): n is a, c, g, or t
  misc_feature (61)..(61): n is a, c, g, or t
  misc_feature (73)..(73): n is a, c, g, or t
  misc_feature (99)..(99): n is a, c, g, or t
  misc_feature (111)..(112): n is a, c, g, or t
  misc_feature (136)..(136): n is a, c, g, or t
  misc_feature (183)..(183): n is a, c, g, or t
  misc_feature (191)..(191): n is a, c, g, or t
  misc_feature (195)..(195): n is a, c, g, or t
  misc_feature (197)..(197): n is a, c, g, or t
  misc_feature (219)..(219): n is a, c, g, or t
  misc_feature (221)..(221): n is a, c, g, or t
  misc_feature (223)..(223): n is a, c, g, or t
  misc_feature (228)..(228): n is a, c, g, or t
  misc_feature (238)..(238): n is a, c, g, or t
  misc_feature (240)..(240): n is a, c, g, or t
  misc_feature (262)..(262): n is a, c, g, or t
  misc_feature (267)..(267): n is a, c, g, or t
  misc_feature (299)..(299): n is a, c, g, or t
  misc_feature (301)..(301): n is a, c, g, or t
aannatcaatgtttttccccgttcncncntattacntcttnccgttggcnttttcnatttnaaatgctttccnttggttgttggttttattctcccccnaccccgcccggnntcgtattattcggaatataaaccngcgaagctctgctcggttttggttttgaaagtttaagcttttctgcntctgtganaccncnggcttctgtcccgtttgattcngncngaacntttgtgttcncnaatgatactaacacggtgtagnttttncagtctccgaatttgtactggtaatgcatatncnggataaatagtttcgtttgttgcg

SEQ ID NO: 608076 - DNA, 561 bp, Homo sapiens
  misc_feature (442)..(442): n is a, c, g, or t
  misc_feature (452)..(452): n is a, c, g, or t
  misc_feature (461)..(461): n is a, c, g, or t
gagaccgagcgagattctttctccacaaaaaaaaaaaaaaagcaacagaagcaaatgagagtgcctgggagtggtcattgtggggcattcctgttcgtgtgacccaggtcatgtccctccctaagccctggtctctcttgcctcctgcagggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccccgcctacctgtactcgtgggaggtaatggtggtttgggacttgcttaagggaggtcttttgctcccatctggtagccctggcttcagcaggagcccaggacaggtgaacgggcaggtgtggtcctntgagcttttntgagctttntgatgtttcccacccttggtgggaggcccagattttttatttatttatttatttatttatttatttatttgtgacagagcgagattctatctcaaaaaaa

SEQ ID NO: 608077 - DNA, 693 bp, Homo sapiens
gggtgagtgggggatgatttctagtctcatcgttgtcctctacctgtgaagataaactgttaatttacattgtcagcatgagggagaccacctgaagaactatgtagccttctatcttgcagctgtctgtttatgaacaaatgggagtcagtttgactgagttcccaagcttaactttccttttggcataggccgttttattttcctttcacaacttacactcaatataatgttgttttcttagagctgcttggggaaagagatttcatctgtttgattttgaaaagtgacctgcagaagaataatttacttgatattattaatagatattttttaactcattttatgaccaaggcagtgtgctaggtgttcctgggaatataaagcttgtaattttatcattattaactataatatataataaactctaaacagtaataaaagttatgatataggtacctgtagtggtgttcaagtgctactgaaatgtatgtggagttaactaggtgtggtagttcatgcctatagtcctagctactcaggaggtgaggcaagaggatcgcatgaacccaggagtgaggttacagtgagctctaatcacaccactgcactccaggcctgggaagcctctttttttaagagacagagtgagaccctgtcccattgaaagagaaaggaaacaccacaaaaaac

SEQ ID NO: 608078 - DNA, 294 bp, Homo sapiens
  misc_feature (26)..(26): n is a, c, g, or t
ggggggggggggggggggttgggganaacccccccaaacaaggggggcgccccccccccccccccctttcccccccccccgggggagggggagggccccccattgggcccccccccaaggcccaaaaggggggggccttttccccggggggggggggaaatttttttccccggggcccccccccccccaaagggggttttttttggcccccccgcccgggccccaaacccaaggggggggccccccccccccaaaaaaaaaaaaaaaaaaaggggaaaataaaaacccttttta

SEQ ID NO: 608079 - DNA, 619 bp, Homo sapiens
  misc_feature (12)..(12): n is a, c, g, or t
  misc_feature (119)..(119): n is a, c, g, or t
aaaaaaaaaaanaaaattaaaaattaagttctttagttgcactagccatatttcaaatacttgatggatacatgtggctagtggctaacataagggatagcacagatataaaacatttnctcgtcatataaagttctattggatagtgctggtctgtagcttataggatggtatcttagtctgcttcagctgctaaaacagaataccataaattaggtagcttaaacagtagatattttgaccaagcgtggtggcttatgcctgtgttcctaacactttgggaggccgaggcaggtggataacttgagctcaggagtttgagactagcctgggcagcatggcaaaaccttgtctctacgaaaattagctgggcatggtggtgcacgcctatagtctgagctacttgggatgctgaggctgggagaattgcttgaaccatgcccggcgttgactttttaataataaccattctgactggtgtgagatggtatgccattgtggttttgatttgcatttctctaatgatcagcgatatgggcttttttcatatgcttgttggccgcatgtgtgtctcttttgaagtgtactgtacatgtcctttgcccactttctaatgaga

SEQ ID NO: 608080 - DNA, 256 bp, Homo sapiens
tttgttcagccaagtgtgcaagtaggctgcccgccaaaagggggcctttgctacccgctgctgcctgccggttgacacactgcctccccagccttcctgttaggccaccctcctcccttcccatgcttgtaaccagctttggggcttgcccctccccaaagtaaggttggcccttggaggccatgtttgggtttccggccagggcctagggttaggccatgcccccaatgggtgcccaataaataacaggtcaaca

SEQ ID NO: 608081 - DNA, 514 bp, Homo sapiens
  misc_feature (12)..(12): n is a, c, g, or t
  misc_feature (119)..(119): n is a, c, g, or t
  misc_feature (446)..(446): n is a, c, g, or t
  misc_feature (450)..(451): n is a, c, g, or t
  misc_feature (463)..(464): n is a, c, g, or t
  misc_feature (469)..(470): n is a, c, g, or t
  misc_feature (478)..(478): n is a, c, g, or t
  misc_feature (491)..(491): n is a, c, g, or t
  misc_feature (499)..(501): n is a, c, g, or t
  misc_feature (508)..(508): n is a, c, g, or t
aaaaaaaaaaanaaaattaaaaattaagttctttagttgcactagccatatttcaaatacttgatggatacatgtggctagtggctaacataagggatagcacagatataaaacatttnctcgtcatataaagttctattggatagtgctggtctgtagcttataggatggtatcttagtctgcttcagctgctaaaacagaataccataaattaggtagcttaaacagtagatattttgaccaagcgtggtggcttatgcctgtgttcctaacactttgggaggccgaggcaggtggataacttgagctcaggagtttgagactagcctgggcagcatggcaaaaccttgtctctacgaaaattagctgggcatggtggtgcacgcctatagtctgagctacttgggatgctgaggctgggagaattgcttgaacctgggaggcngagnntgcagtgagccnngatcnngccactgnactccagcctggntgacagannnagactcngtctca

SEQ ID NO: 608082 - DNA, 114 bp, Homo sapiens
cctagtggaccatccagcatcctggtgaggtatatgacatgggtggtcttagctcttggaagagcttcaaagactctagaaagaaggaaggacaaatggcctctgtcttcctga

SEQ ID NO: 608083 - DNA, 1136 bp, Homo sapiens
  misc_feature (12)..(12): n is a, c, g, or t
  misc_feature (119)..(119): n is a, c, g, or t
  misc_feature (372)..(372): n is a, c, g, or t
aaaaaaaaaaanaaaattaaaaattaagttctttagttgcactagccatatttcaaatacttgatggatacatgtggctagtggctaacataagggatagcacagatataaaacatttnctcgtcatataaagttctattggatagtgctggtctgtagcttataggatggtatcttagtctgcttcagctgctaaaacagaataccataaattaggtagcttaaacagtagatattttgaccaagcgtggtggcttatgcctgtgttcccaaagtgctgggattacaggcatgagccaccgcgcccggcctatcatatgaattttgagggaacacaaacatgcagtctgtagcagatggtaataggctganatattacacttgttgatgtaaatctgataggtttctttctctccaaggacagctttttaaatatttaacagtatcaataatttttcaggttctgtgagaattttataatttataatttgcagacttaatgtataatctattttgtcctaacaattacaaatatattttttatttcagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatctcggacgctatgggcagggagtgcaagggaagggacccatgtgcttcatccgagactgattcccttggtcccccggaatctctgacgggcccctggcatggagcgcggtctcc

SEQ ID NO: 608084 - DNA, 941 bp, Homo sapiens
  misc_feature (376)..(376): n is a, c, g, or t
  misc_feature (443)..(444): n is a, c, g, or t
  misc_feature (466)..(466): n is a, c, g, or t
  misc_feature (472)..(472): n is a, c, g, or t
  misc_feature (480)..(480): n is a, c, g, or t
  misc_feature (490)..(490): n is a, c, g, or t
  misc_feature (499)..(500): n is a, c, g, or t
ggcctgcgtccctgctgtcagcaacctggagcctggagtcggattccgaacgcaccctcgccgtgtcactcggccctcatgcgatccgcataacgtgcagtgccgaggcagtgcggtcccaccaagcagcactacgcggccgccttccacgcccgagggcatcgcagctggtcatacgggtagcctcctgctcatggcgctgctgcccatcttcttcggcgcccatgcagctccggtacgctgcgcccgcggcaagaatgcttcagacgatgccttgaaactaatcaccagccgggatgccaaccgcttccccatcatctgtcatgcttgacactcttggggctctacctctttttcaagaatattctcccaggantacatcaacctcctgctgtccatgtatttcttcgtgctgggaatcctggccctgtcccacaccatcnngccccttcatgaataagttttntccagnccagcttnccaaatcgancagtaccannctgctcttcacacagggttctggggaaaacaaggaagagatcatcaattatgaatttgacaccgaaggacctggtgtgcctggtgcctgagcagcatcgttggcgtctggtacctgctgaggaagcactggattgccaacaatctttttggcctggccttctcccttaatggagtagagctccctggacctcaacaatgtcagcactggctgcattcctgctgggcggactcttcatctacgaagtcttcttggggaatatgggaccaatgttcatgggtgaccagtgggccccagttcctttgacgggcacgcaattaaacacttgcgggttttccccagggaatctggctgcgaaaaaggggccctgaaaccacacaaccttgtgcccatgctgggaccttcggcacatgtctgtcattcccacgcgagcctcaaatac

SEQ ID NO: 608085 - DNA, 373 bp, Homo sapiens
  misc_feature (8)..(8): n is a, c, g, or t
  misc_feature (242)..(242): n is a, c, g, or t
ctcaaaancaaacaaaaataataataaagtgagctttatgaagacattacagaaaagattcaaatataaaatgacctctgcctcccgggttcaagcaattctccggcctcagccttctgagtagctgggattacaggtgcctaccaccacacctggctaattgtttgtactttttagtagagacggggtttcttcatgttggtcaggctggagtgcaatggcatgatcttggctcaccacanactccgcctcctgggttcaagcaattctcctgctcaggaggctgaggtgggagaatcacttgaacctgggaggtggaggttgcgtgaccggagattgcgtcactgcactccagcctgggcaaccaagcgag

SEQ ID NO: 608086 - DNA, 117 bp, Homo sapiens
agcactgtgagacttccttgctcctcaggctccgacactagtaatacctgtgccccaaagcctcctccaagcctcctataggaggggtcactccccttgtcgtctgaccgtgccatc

SEQ ID NO: 608087 - DNA, 497 bp, Homo sapiens
gagaccgagcgagattctttctccacaaaaaaaaaaaaaaagcaacagaagcaaatgagagtgcctgggagtggtcattgtggggcattcctgttcgtgtgacccaggtcatgtccctccctaagccctggtctctcttgcctcctgcagggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccatgcccggcgttgactttttaataataaccattctgactggtgtgagatggtatgccattgtggttttgatttgcatttctctaatgatcagcgatatgggcttttttcatatgcttgttggccgcatgtgtgtctcttttgaagtgtactgtacatgtcctttgcccactttctaatgaga

SEQ ID NO: 608088 - DNA, 292 bp, Homo sapiens
  misc_feature (26)..(26): n is a, c, g, or t
actgggggggctcaataaatgcatcntgtgagaggcagtggttgtggttcctgtaggcacagggcaggcagtagattgcctgggtgaacgtggagaagcatttaatcttatgtttagcctggtagattacagactggggatgtccgaagtatgaaatcaaagctctgcttcttttggtttcccagtttggggtatggctttgtggtcagtgcccttttcttcttcttttttttttttttggggcggggggtccctcaaaagttcacccgtgcgggtttccaccttggccagg

SEQ ID NO: 608089 - DNA, 1058 bp, Homo sapiens
aaacgcttgtagggcttcaccagggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatctcggacgctatgggcagggagtgcaagggaagggacccatgtgcttcatccgagactgattcccttggtcccccggaatctctgacgggcccctggcatggagcgcggtctcc

SEQ ID NO: 608090 - DNA, 209 bp, Homo sapiens
gctagcttctgaggcttcaccagaagaagagctggagctggctgggtggtggctcatgcctgtaatcccaacatcttggaaggcgaggcgggcagatcacaaggtcaggagttcgagaccagcctggccagtatggtgaaaccccatctctactaaaaatacaaaaaaactagccgggtgtggtggtgggcacctgtagtcctacctac

SEQ ID NO: 608091 - DNA, 991 bp, Homo sapiens
  misc_feature (923)..(923): n is a, c, g, or t
  misc_feature (927)..(928): n is a, c, g, or t
  misc_feature (940)..(941): n is a, c, g, or t
  misc_feature (946)..(947): n is a, c, g, or t
  misc_feature (955)..(955): n is a, c, g, or t
  misc_feature (968)..(968): n is a, c, g, or t
  misc_feature (976)..(978): n is a, c, g, or t
  misc_feature (985)..(985): n is a, c, g, or t
aaacgcttgtagggcttcaccagggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagtctttcccaggtaactccgatgaagtgttccaacaaaatgagcgagtgaaccaagaagaggatgacattagatccaggagatacaacagaggagataatctccaggatgcctgtgaagaaagatccctggatcccaggatgattataggacaagttgttcataatccagcaggccagaagacttccagggaaactcattcaaggaggtgaaaatgatggatgactcctccaagatgaaaatggaccagccgcagtggctcacgcctgtaataccagtaacactttgggaggccgaggcaggtggataacttgagctcaggagtttgagactagcctgggcagcatggcaaaaccttgtctctacgaaaattagctgggcatggtggtgcacgcctatagtctgagctacttgggatgctgaggctgggagaattgcttgaacctgggaggcngagnntgcagtgagccnngatcnngccactgnactccagcctggntgacagannnagactcngtctca

SEQ ID NO: 608092 - DNA, 1075 bp, Homo sapiens
  misc_feature (12)..(12): n is a, c, g, or t
  misc_feature (119)..(119): n is a, c, g, or t
  misc_feature (372)..(372): n is a, c, g, or t
aaaaaaaaaaanaaaattaaaaattaagttctttagttgcactagccatatttcaaatacttgatggatacatgtggctagtggctaacataagggatagcacagatataaaacatttnctcgtcatataaagttctattggatagtgctggtctgtagcttataggatggtatcttagtctgcttcagctgctaaaacagaataccataaattaggtagcttaaacagtagatattttgaccaagcgtggtggcttatgcctgtgttcccaaagtgctgggattacaggcatgagccaccgcgcccggcctatcatatgaattttgagggaacacaaacatgcagtctgtagcagatggtaataggctganatattacacttgttgatgtaaatctgataggtttctttctctccaaggacagctttttaaatatttaacagtatcaataatttttcaggttctgtgagaattttataatttataatttgcagacttaatgtataatctattttgtcctaacaattacaaatatattttttatttcagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagctcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatctcggacgctatgggcagggagtgcaagggaagggacccatgtgcttcatccgagactgattcccttggtcccccggaatctctgacgggcccctggcatggagcgcggtctcc

SEQ ID NO: 608093 - DNA, 209 bp, Homo sapiens
gcaaaaccaacttcaccaaaaagccaggtaacattaacaaaggaattccctgtatcaatcttggatctcaacaatcgggaaaaaggaggcggataggtgtttatggagatgggttcctgtaggagaaaattagtgaggaaacacaggtgatgataatgtttcagcaggcaattttgccctcagagcctgtagacatctctacagcaatg

SEQ ID NO: 608094 - DNA, 1314 bp, Homo sapiens
agcgggaggccggtgggtacttggagaacttactacgtctagctggaggattgtaaatgcaccaatcagcatgctgtgtctagctcaagaactcaagctccatgaggagatgtttcattgtcgagagcagtcatgatggcctgcactccacacaatgcaacagagtgaaagagcaggttctgcttctttggtgtagtcctgaagcttcctaagaaacttcacatcaggtgatggataggagcaaccctgtaaaaccagccttagactatttttcaaacaggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatctcggacgctatgggcagggagtgcaagggaagggacccatgtgcttcatccgagactgattcccttggtcccccggaatctctgacgggcccctggcatggagcgcggtctcc

SEQ ID NO: 608095 - DNA, 246 bp, Homo sapiens
agtctgttagaggcaaggtaacccagagtctcccagtgaaagaaggtgacagaggtctctctccttcgagtggggtggtctgtgatttgtcccgtccacagctgggtgaagatgaattctcttacggtttcgatggacgaggactcaaggcagaaaatggacacttggaggaattgggccagactttgggggagaatgatgttatgggctgcttggctaatttggagactgaagaagtagaacttt

SEQ ID NO: 608096 - DNA, 1185 bp, Homo sapiens
gagaccgagcgagattctttctccacaaaaaaaaaaaaaaagcaacagaagcaaatgagagtgcctgggagtggtcattgtggggcattcctgttcgtgtgacccaggtcatgtccctccctaagccctggtctctcttgcctcctgcagggctggtgaattaccatatctccgtcaagtgcagtaaccagttcaagttggaagtgtgtcttttgaaatcagacaacaaagtcgtggacaaccaggctgggacccagggccagctgaaggtgctgggtgccaacctctggtggccgtacctgatgcacgaacaccccgcctacctgtactcgtgggaggatggtgattgctcacaccaaagccttggacccctcccagcctgtgacctttgtgaccaactccacctacgcagcagacaagggggctctgtatgtggatgtgatccgtgtgaacagctactactcttggtatcgcaactacgggcacctggagttgattcagctgcagctggccgcccagtttgagaattggtgtaagacatcacaatcccattattcagagcgcgtatggagtggaaacgcttgtagggtttcaccagattgtatatattcctaccagatggagataattacagctttaaaaatttttattttttcattttatttcacacattgacattaaatttttatggacacataataactgtacatatatatggggtagaatgtgatgttttaatacatgtactcaatgtgtaatgatcaaatcagggtaatttgcataatgatttttctgtagggagaaaattcaaaatctactcttctggctattttcaaatatataatatgttattgttaactatactcatcctactatgcaataggacaccagaacttattcctgggttctacatccgttaaggcaaccaaggattggaaatattggaaaaaaaaattgcgtctgtactgaacatgtacagacttttttcttgtccttattccttacacaatatagtacaataactatttgcatgacatttacatcggatattatgagtgatctagagttgatctcggacgctatgggcagggagtgcaagggaagggacccatgtgcttcatccgagactgattcccttggtcccccggaatctctgacgggcccctggcatggagcgcggtctcc

SEQ ID NO: 608097 - DNA, 121 bp, Homo sapiens
ctactttcgacttttcatttcctgtagttgacaattctgcatgtatctagtcctcttagaaataggttaaactgaagcaacttgtatggaaggatctctccacagggcttgttttccagga

SEQ ID NO: 608098 - DNA, 132 bp, Homo sapiens
attctgctactacaatgcctctatacaggctcttctcagcaaagcaaacaggatctccttttaaaatataagatcatgtcactctttggcttaaaaccctgtcatgactttccatcttcactcagagcaaaa

SEQ ID NO: 608099 - DNA, 265 bp, Homo sapiens
ggggggggggggggggggtgccccggggggcccttttttttttttccccccccttttttggggggggggttccggggggcccccccccccccggggcccccccccccccccttttttagggggggccccccccccgggggcccggggggggggtggccccgctttttttttccttttggggggggggggggggggtttttttttttttttttcccccccccccccccccccccccccccctttcccccttttttttgggggggga

SEQ ID NO: 608100 - DNA, 402 bp, Homo sapiens
gatccagtctcgtagtatcatacctatacccaggtgtaaaaggaccttctgtaggggctagaaagtgtgctggtagcatgtggctcactctctgtattccagcactttgtgaggctgagacgggcggatcacaaggtcagtgagatcaagaccatcctggctaatgcggtgaaacctcatctctactaaaaatacaaaaaattagctgggtgtgatgacaggtgcctgtagtcccagctactcgggaggctgaggcgggagaatggcgtgaacccgggagacggagcttgcagtaagccgagatcgcaccactgcactccagcgcttgcgacagagcaagtcaaaaaaaaaacaccggtgtgaaaaaatcaaagagttttcccttcaaaccaaacggccaag

SEQ ID NO: 608101 - DNA, 390 bp, Homo sapiens
ctacacaaaccttccctttgctctggaaggtgatactatcactgtgtctcaaacaaaggcagtcagtacctctgtataccacacttgcagaaatgtgatccatacccatgaataatagtcttccaatagtgccccagccaggaagcaaggaaaatgtgttcctgaagtagcggtttatgaactgagtctggaacatcttcctattttcagaaatttgccttctgaaaatgtcatggcaaagaagtaaacatgtaaaaaaacatttttgttttatacccagttttctttgtctttccctaagtaattgtatgttggttaatacattttctggagtttcaatactcagtgtgactatgctagtatcttgcttagttactgtgttttttcagc

SEQ ID NO: 608102 - DNA, 609 bp, Homo sapiens
ctgagaatccgtcgccatccgccaccatggtgaacttcacagtagatcagatccgtgccatcatggacaagaaagccaacatccggaacatgtcagtcatcgcccatgtggaccacggcaagtccacgctgaccgactcccttgtgtgcaaggctggcatcattgcctctgcccgagctggggagacgcgcttcactgacactcgcaaggatgagcaggagcgctgcatcacaatcaaatccaccgccatctccctcttctacgagctctctgagaacgacctgaacttcattaagcagagcaaggatggctcgggcttcctcatcaacctcatcgactctccaggccatgtggacttctcttcagaggtgacagctgccttgcgtgtcaccgatggagctctggtggtggtggactgtgtgtctggcgtgtgtgtgcagacagaaactgtgctgcgccaggccatcgctgaacgcatcaagcccgtcctgatgatgaacaagatggaccgggccctgctggagctgcagctggagcccgaggagctctaccagaccttccagcgcatcgtggagaacgtcaacgtcatcatctctacctacggcgagg

SEQ ID NO: 608103 - DNA, 800 bp, Homo sapiens
  misc_feature (512)..(512): n is a, c, g, or t
  misc_feature (517)..(517): n is a, c, g, or t
  misc_feature (585)..(585): n is a, c, g, or t
  misc_feature (599)..(599): n is a, c, g, or t
  misc_feature (608)..(608): n is a, c, g, or t
  misc_feature (662)..(662): n is a, c, g, or t
  misc_feature (682)..(682): n is a, c, g, or t
  misc_feature (691)..(691): n is a, c, g, or t
  misc_feature (697)..(697): n is a, c, g, or t
  misc_feature (714)..(714): n is a, c, g, or t
  misc_feature (756)..(756): n is a, c, g, or t
  misc_feature (777)..(777): n is a, c, g, or t
aagaaaactgtgagctattatatagtgtttcttttttaacacaaatcttttaactttaaaaaaaggcaaaaatttttttttctacttcccacccagcttaccaccttgatctctttaacttatgttctaaactttggtgttaatggtggtgtctagcatgctagtagttagattttatttagatgccataactggtaatacagcttttattttgactatattaatttagttttttgaggggaagtttgtttattctgtgactctcaaagcacacagaggttttaaaatatatattattaagactgagagaagaggaaatgggagggagtaacatcacagaagtgctgttgttcaactgttcttcaatatagttgctagtagggttgtatttactcagtaaggaagtcagtgacctgaactacctataaaaattcaacagtgctgcagtggtgcttaagtgaaaccctttggctatctagtagtttttatgctactgaaacttggattactgnatganattcacttggcttgggccctctatgtagacaaacattcatattcataagtaggggtggatactggccnggtttataacttanttttcaaanattaacaacccctgcttttcaagggggtatttttttttttttgaagcaggaaanaaacctttgtttttgccccngcggattgngtaagnaatatgggtacctggcnaaggctttttttttcctgggaaaatttgaagcgggccagctncttgctaccaaatgggccttnaaatattggacggggcttttaaa

SEQ ID NO: 608104 - DNA, 674 bp, Homo sapiens
  misc_feature (458)..(458): n is a, c, g, or t
  misc_feature (460)..(461): n is a, c, g, or t
  misc_feature (478)..(478): n is a, c, g, or t
  misc_feature (515)..(515): n is a, c, g, or t
attttatgtttaccccaattaaaattatgaatgggttgggctgttggtttgtagatggtagaccagacggcccagcctgttggccagggtcaaattccaacatgctgagcctgttgcagaagacttagcctttgaagcaggcagccctgagcttctgattcctccaggcccaaaccaccgttgccctattttacaagaccttggctggcttcatgacgtgttcttgaactggagccagtggtgagctcagggaggctcgtgtaacaatagttccctgaggcatgtttatagccgggtgccctcttcacaacagacacatgtcctgggtcatctcattctctctgcactgccacggggaggatggggaggcagtcacgtctccatgtggcatatcaggggaccggggtgggaggggctgacttgagcaaggccagaactaggtctgcgcccttgccctntnnctaatgccagattcggncttacccgtgaagcttgcctggcaagggatggccttnctgaattctgtgtggctaagcttgggttgcatgctttcttgacaaagacagatagtcatatgctcagttttcaagctggacgggtgtgtctcactactcagcttgctgttgtatgcttaggctgcattgacacaacagaattagtcgaggtggccgttt

SEQ ID NO: 608105 - DNA, 987 bp, Homo sapiens
catttattcaatgctactgtgtatataatggaaaacttaagtccagtttgaaacatctagtctttctaggtgtttaaaagtgtacaacagcctgtcgcagtggcgcatgcctgtaatcccagcacttgggaggccgaggcaggcggatcacgaggtcaagagatcaggaccatcttggccaacatggtgaaaccccatctttactaaaaatacaaaaattagctggtcgtggtggtgcccacctgtagaccccagttactcgagaggctgaggcaggagaatcgcttgaacttgggaggcggaagttgcagtgaggcacaagatcgcaccactgcactccagcctgcgacagagcgaggctccgttcaaaaaaacaaaaagtgcacaagtaggttaccagtagagggcttaagtaacacccactctaagcaatatgttttcagatacttcctaggagtggttgcattatgggaatggacattgttacaaattgatgctttaggagcgaatgcagatatcatgggtgtaggggtgggggaaaggggggtgggagagaaaggtatgcagggaacaggggtctggtgtccatgaatagtacacatggtctaaccatgtgtctatatgtgctttaggtaaactggtcttaacagggactgcgccaaaaaggcccaacgcatgtacacacaacagatggtgcaaatcacgccttcgggggaatggaccctaggagacagtaacagaaaggcccatccacgggaatgacaccaacttagaacaccactgggatcaaatccggaattaacaggggcatgtgcaacggagacacgaagggacaggaaaggaacgtcaacatgcaattaacacacgtaagtcacccggccaaaggcgagaaacgcgtggagagcacacatcgaaaacagaagggacactacaaccaacaaccatacagaaaaaacaagagagacaaggacaaacacaaaagaacaa

SEQ ID NO: 608106 - DNA, 829 bp, Homo sapiens
catgagggtccagtgtgtgacttgctgtggtcagatccagatgaccgtggtggttggggtatatctcctcgtaggagctggtcacaccttcggggcaagatatttgtgagtacaatttaatcatgccgatgggccgtcacggtaggttggtctagagtctcacgcagcactagatgatggtaggggataatagacgtggatgcccttactgacacggtaatgtggtacaccgatcttcacgcggctccacaactattgtaatcgcttgtgggtgagaccaagtcccgtcttagtacatgggaaactatgagcgataactctaacccattatctctatatcttggcggataggatactcaggaataactcgtaagtaggagcgagaccaaatggtaagttgagatgagatatcacacaagagatagtgtccctggtatatgaaaatttataagactctgaatcaggatagtatgccattgaaaacgattattagtcgagcttaagtggtaatatgggaaagatgacaagcaagtaaactccaataggtgtccagaagacactaggttatggcagtgtaaaagagaaactatgtgtttgcgcataggaaccatgggtgatgtgggcatataagaagagtacgaggaggcctcgtttgtaattgcaaacatgccgtgtccatgtttagcaatgaatccagttgataggatgctagaagcgatatgtgtggtgaagaaaggccaagtttctgggattgggcaattagggctacttattgattacgtgtgagaaagtggcgattcatagggatggaattaaaacatcgggatta

SEQ ID NO: 608107 - DNA, 354 bp, Homo sapiens
aacctcaaactgtctgtcctgtccagcggcggccccggtggcacggacgatgaagccgatgcgtgaaggatgctggctgtgtgatgcctggggacaaggacaaagaacatggatgctgtcttgaacgatggataaacatgcttcaagatgaacttggagatgctcgtggaacgactaggtgtgagaattgatacatccctgtatcgaccagctgctggagcgaatttgctgaagtgcagattctgttcttactacaacgttccgatgacattcaggttgccccaagccctctcaaacattatcttgctgtcacaacaactactgtgcaacaaccttgacatgggacacactcct

SEQ ID NO: 608108 - DNA, 913 bp, Homo sapiens
gcgtgtgcacctcgctgctccagcctctggggcgcatgccaaccttccagcctgcgacctgcggagaaaaaaaatcacttattttcttgccccatacataccttgaggcgagcaaagaaaaatgaaatttgaatccatgagggaaatcgtgcacatccaggctggtcagtgtggaaaccagatcggtgccaagttctgggaggtgatcagtgatgaacatggtatcgaccccaccggcacctaccactggggacagcagaccttgcaagctggacacgcatctcttgtgtactacaatgaagccagaggtggcaagatatgttcctcgtgcgcatcctggtggatctagaacgctgggaccatggagctctgtacgctcagcgtcctttaggtgcagatcttgagaaccagaacaacttggtacttgggtcagatctggggcacggtaatcgaactgggccaacaggccatatagcacatgagggctgccgagctggatagattctgtcctggatgtggtacggaaggaggcagagagcttgtgagtgcctgcacgggcttccagctgacccattcactgggcggggcacaggcgtctgggaatgggcgctctccttagcaggaagatccgataaggaataccctgatctgctatcatggacgtaccttcaggtgtggttgccattcacccgaaaaggggtctgaggaccgatgatcgaggcgctaaaagtgcaccctctccgtgcaatcagtaggtagagaatactgctgcgacctatggatttgacaaacgagggccccccaaggatatcctgctccgatcttagctgagcacaccaagctaagggatctgaacacttgttctagcaccagaagtgtggcacacctgctcattcaggcgagtaaggggcac

SEQ ID NO: 608109 - DNA, 304 bp, Homo sapiens
agattattccttcagagtaaacccatgaccaactatctacatccccctagatggtcctgactgaagtacaggttcttctatcagtttctgctggcaatgaacgagccacagcaaatgagatcaaggatgaatatgtggagacgctgagcaagatttacctgtcttactaccgctcttacctggggcggctcatgaaggtgcagtatccatttgaggccctcttccgcagccagcactacgccctcctagacaattcctgccgcgaataccttttcatctgtgaattttttgttgtgtctggccc

SEQ ID NO: 608110 - DNA, 470 bp, Homo sapiens
gttttttaaggtaccaaaagaaaaaagtctctctatgattggtgtgaggatggcattacaagtgtagataagtaggagaagaaatacttctttataaaatttgatctctttatttaaatattttattaaactatgtgaaatttcataaattttatataggatttacatgtgattttttaaatggggttgataaccatggattcaatacatattggtagagcatctactatgttcccatcactgtgttagcctctactgagcaaaaccagaaatgacccttcttctacaaagacattatagttccctgtggaaaaactgatagcaatcaaagtacacaaagaaacataaaccaacaacagtgtgagagctacacatgacagcacagtcagaagatctggcctggtcagtttcccgaggacgtgaataacaccagctaacacatagttaccgtgtacaggcaaccttagaat

SEQ ID NO: 608111 - DNA, 447 bp, Homo sapiens
  misc_feature (112)..(112): n is a, c, g, or t
  misc_feature (286)..(286): n is a, c, g, or t
  misc_feature (406)..(406): n is a, c, g, or t
cgggtgatgaacgctttaaagctgaaatgtttgcagaattgtacaagaagtaaatataagagatgactataggaaatgtcctagtaactgtggtcaaaaaataaaaattcgncgtgttttaatgaattggcccaggagattggtgagcattggtatagtctgggactccgagcattctgacttgaccgaagctgtagttcggaatctagcaacacacctttatcttcctgggcttttttatagagttactgatgaaaatgccaaaaatagtgaacttaaccttgtnggtatgatctgctacaccagccaacattattgtgcctttgcatttcacaccaaaagttccaaatgggtattttttgatgatgcaaatgtgaaagagatcggaactagatggaaagatgtngtctccaaatgcattcgatgccactttcagccactactttg

SEQ ID NO: 608112 - DNA, 1125 bp, Homo sapiens
  misc_feature (104)..(104): n is a, c, g, or t
  misc_feature (107)..(107): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (117)..(120): n is a, c, g, or t
  misc_feature (122)..(122): n is a, c, g, or t
  misc_feature (124)..(124): n is a, c, g, or t
  misc_feature (127)..(127): n is a, c, g, or t
  misc_feature (809)..(809): n is a, c, g, or t
gtaagtctgaccagtcaaaggcaagaggtatcaaggtggagaaacagatctttggagaagccaccaagcagcctggaatcgtatttgttgcagccaagtttganggnancntngncnnnngntnccntcatatctctgttaacaacgtgcttccggtcttgacaacctgatgcaacagaagctggtggacaagaacatcttctccttctacctgaacagggacccagaagggcaacccggaggagaactaatgcttggtggcactgactccaagtactaccacggggagctgtcctacctgaacgtcactcgaaaggcctactggcaggtgcacatggaccagttggaggtgggcaatgagctgaccctgtgcaagggaggctgtgaggctattgtggacacagggacatctcttctggtggggcctgtggaagaggtgaaggagctgcagaaggccatcggggcagtgcctcttatccaggtgagtatatgattccttgtgagaaggtgtccagcctgcccacggtctacctgaagctaggaggcaaaaactatgaactacacccagacaagtatatactcaaggtatcgcagggtggaaagacaatctgcctgagtggcttcatgggaatggacataccccctcccagtgggccgctctggatcctgggcgatgtcttcattggttcctactacactgtgtttgacagagacaacaatagggtcggctttgccaatgctgtcgtactctaacttgctccttctccactgtcagggaactggatcagagtccagtagaggaagccagncagcccatcctccactgcccactcacacatagtcacactcgttatgttgctggaccctggggggagacctggctggagcttgtccagctgttctgttctgtggttcctcaccctgggttcagattgctgccctctgcctgtctgaaggaggccaaggccacccagtacacgaggctgccttcaaaggcccctactggtttaatagctgctgagatggattgtcttgtcctgccggcctttgctgtgtgggcagtactctgaagcaggcaaatgggtcttaggatcctccagaaactgtctgaaccagaccattacc

SEQ ID NO: 608113 - DNA, 522 bp, Homo sapiens
tggtgaccagacagggatgtcgttggagagattctggtgttgaagtgcttcagctacatgtctcagtgaaaagaagttcagcgaagtggcgtctctctctgatgagaccaattcaattgatgtactctcacagccatggaatgagcccccagtaattctctcgatggtcattcacatgctaagttatggacgtggtattgccagggcaatggtgctgatgcagtggggggctgtcctgcatatgcaccggacagtgaagacgatgtggtacctccacctcagcgtggcggacctcctctgctgcctcatccttgcccttctcgcagggtcacttggatctccagggaagcagtgcccctatgttaggttcctatgcaatctcatcccctccatcattgtcctcaacattgtttgccagtgtcttcctgctttactgtcattagcctggtatcggtgtcttgtgctatacaaggccaatttggtgtcagaatcatcgcaagtgtagggatggactgctctatc

SEQ ID NO: 608114 - DNA, 837 bp, Homo sapiens
  misc_feature (488)..(488): n is a, c, g, or t
gggggtgaagaaggggccggccttcaagcaacagcgacgcaagatggcagccaccacgggctcgggagtaaaagtccctcgcaatttccgactgttggaagaactcgaagaaggccagaaaggagtaggagatggcacagttagctggggtctagaagatgacgaagacatgacacttacaagatggacagggatgataattgggcctccaagaacaattttatgaaaaccgaatatacagccttaaaaatagaatgtggacctaaataccccagaagcaccccccttgtgtcaagatttgtaaacaaaaattaatatgcaatggcagtacacatcagtctctcaatggagtggtggcacccaagagccatatcagtgctagcacaaaatggcagcaattcatatagcatccaaagttgtcctgcagagagcttcggcgcctaatgatgtctaaaagaaacatatgaaactccctcagaccgcccganaggacagtgttacagcaattaactcaagaaagaaaaaccacaggcccttccccttcccgcccaattcgatttaatcagtccttcattttccacagaagtaaattttctagatacgtcttgtagaacctcaaagtaccggaaggaagctcccattcgaaggaatagtttatctgtaagatactgtaaatgatactaagtttgttgtccatttgaaactagataagttgtgctataacgaatcatcctgtcaggtgtaacgcactgtccacgtagttgaacttgctgggatcagagaaagtctagtttacaatggattcccatcataactggtggggcacatctaactcaa

SEQ ID NO: 608115 - DNA, 416 bp, Homo sapiens
cacatttagcgtcacggccagcagtgctcgggccaaagaaaatgtctggctgctgcacgacacaacgaaagcggtgcatggccatcgttgtgtagataagcttcccaaggatgccgtctctcaccttactcgctcagcacgcaccaggtctgcccacagcgcagtacggccgcaggcgatgcagtcgatcagttcaagattcatggttggattgcctcccctgtaccggtggagaataagcgcccagaggtcaggcggctatgatggctcggttgattgctgccagggagcaaccgggctaagttgccaagtaatggaataccaatcccggaaaccatctttgcctctgtgacattcaggtaggcgctaacactgcgcgtcaaatacagcgagcaggcaacccctatcatcaagaa

SEQ ID NO: 608116 - DNA, 395 bp, Homo sapiens
aggaattgatcatgtgaaagcactgccaatttttagatatgaacactgggagggttctatacaaactgcggtgagaaaacaaaagagcaaactcttggcagcaacctggaaagaaaactggtcatcacatttgactccctgttcactaatgtgctgataaataaatgggaagtggacttttagaatccctggtcgacagaggccacagtgaggcctggcaaagacgccagagacgaacgacagccagcccgggcggacctgacacgtggcacagggacttccagcagtgttgcctaatggtggcacattgtaaatggcaacccagacaccaacacaggctgctgtaaacctgcttccagggtgaaggcaggtgcgagctatgtgttgaaagggca

SEQ ID NO: 608117 - DNA, 870 bp, Homo sapiens
  misc_feature (1)..(1): n is a, c, g, or t
ntgctcctgctgagagtgcgcttcccctctcctcccggccgtctttgtggggcaactcctttttgttccgctgcaaaccttgtttgtgacctcctcgtcggaggccccaattggcgccttccacaatggtcccccggcgataaaaacttctttggtagtgccttgacagtgttctcgcaagttatatatgcatttcaaagaggattcttctgcgtccccagagtgtgttttgctgtcacccgcgtctgccgggggcgccgcatgacgcccgtggtaggccgcacgtttgagggtactacccccctgtgccggtataatacccacacccgcgcgttataccgccccccagctgggtgaggcgaacacggctccccctcttgggggttgtctcacatccgtgccggaagaccactggtcgctgtcggattagacgccccctctattgcggtcttctacgactctctatctctccggacggtgcccccccctgtgtgtgaatttttcccgggggaggtggtcattcgcccccctcggccctcgtgggagacattacaatccgcgcgctgccacgcctgctgtgccaaaatctttttgacgccccgacactatacaaaaggcgatgacatgtgccccgtaacaaccccaccatctcttacccttctctcacagtatcattataatttgatccccggagtcatatctaacacactcttcttataataaatcggatattccccccctgaaccacaagagcatgggagaacaacccgataatcccaacagtttcccccacaacaaaaacagatgaggaacccattctactccccaaacacccggggaaaaaaaacccaaatgggcgccgacaaaaca

SEQ ID NO: 608118 - DNA, 342 bp, Homo sapiens
  misc_feature (274)..(274): n is a, c, g, or t
  misc_feature (301)..(301): n is a, c, g, or t
  misc_feature (313)..(313): n is a, c, g, or t
  misc_feature (329)..(329): n is a, c, g, or t
  misc_feature (340)..(340): n is a, c, g, or t
cggcacgagtgcagaccagtaccagcttgtggcccgttaggaaccgggcagcacaggacgaggtgagggagcatgattgcccgagctccacccactttcagatcagcctgggcatcagattcccataggagcgtgaaccctactgtgagctgcgcacttggatctggattgcgctctgcttctgtgaggttggctggcagtccctgaagactcctgcctgaggcctctgcctgaaccctgtcctcagggggccagaagcaaactccagcccttnccgtggtctactgctcgctgaggaagncgcagtgcacantgggatccacaaaggnacagaaccatntt

SEQ ID NO: 608119 - DNA, 146 bp, Homo sapiens
gagcactgcagctggtggagtgtggcaggtggcagcagcgggttcaggaggagtggctccctacctgggacacgaggtttagctggacatgatgtgctacacaatgcttcatagttgatccagccatgggagtcctcttgcccagc

SEQ ID NO: 608120 - DNA, 966 bp, Homo sapiens
ggccgggcgcggtggctcacgcctgtaatcccagctctcagggaggctaagaggcgggaggatagcttgagcccaggagttcgagacctgcctgggcaatatagcgagaccccgtcctccacgaaaacaggaacaaaaaaaaaaaaacaagaaaggacaaacaaaaaaataaaggggtagtgtcccctctaagggaaacctttccaccttccggggtccaagcgcggatcctctcgggcataaaggcccccaagaggcaggggaaccccggggttccgttgccaccatagtgccggcgcaaagtttgggcatttttaaggataaaaccaggggaggtttccccccatggttggggcaaggggcgggccttcagaatcccgtggacgctcaaggttgggaatccacccacaacttttgggctcccaaaaggggggcacagagcgcaatggggttgtagagcccaccgtgtgtgtctgagccggggcttcaaccattttttcttggacgacaaaatatccatttgccaacaccgtgcttcaaaagtgggagccggggccaccgcaccagggggcttccaacaacttggaatccccaaggcacggggggagaaggcgtagagcgcaaattctcgttggtactaaaattccgttcacactcctgtacatttcaaacgaaaaatattttggtgggccacctcgggagccgtgaggccggaccaaacggccaaacctggggggcgcacgacctgcggggacccggaaatggccccgggacccagggcggggaacaaaggcgaaactcctccgccagaagagagggatttccccagtgtatcacccagggggggaagggtccccatgggcccaccaatgggcgggagaactccaaggtcaggcggcaaatccgggcgactcggaaggacgcgacccatgggcgccggggccatagaccggctgagacagaaga

SEQ ID NO: 608121 - DNA, 418 bp, Homo sapiens
  misc_feature (297)..(297): n is a, c, g, or t
  misc_feature (314)..(314): n is a, c, g, or t
  misc_feature (335)..(335): n is a, c, g, or t
  misc_feature (389)..(389): n is a, c, g, or t
  misc_feature (411)..(411): n is a, c, g, or t
  misc_feature (417)..(417): n is a, c, g, or t
tgaggagtcttactctgttgagtgcagtggtgtgatctcggctcgctgcaacctctgcctcccgggttcaagcgattgtcctgcctcagcctcccgaataggtgggattacaggtgcccgccaccatgcccagctaatttttgtatttttagtagagacggggtttcatcatactggccaggctggtctcaaactcctgaccttgtgatccacccacctcagcctcccaaagtgcttgggattacaggacatgagcccccgcgcccggccaagtttaggaagatagtttgggcagtntccaccaaagctgagcngccagccattctggccctagntgtgtggcacagggagaagtggggggacacacacttcacctttaggaaagtgtnccccttcattcaggcagtcagngatttna

SEQ ID NO: 608122 - DNA, 189 bp, Homo sapiens
tatgggaataaaaggagatactggcaacaggatgtgtcgacgaaagttacggtcactcagtggtaaatccatcagcttttcactggtaaaaaatttggcaaaatatacatgttctcctccggttttcatttcttccatcttttttctggaggccggagtatcatctaatttataactcttaaaaacagg

SEQ ID NO: 608123 - DNA, 125 bp, Homo sapiens
  misc_feature (84)..(84): n is a, c, g, or t
  misc_feature (94)..(94): n is a, c, g, or t
ttaaacaccgcaatcaacaccgcaatctactataaaatacaaaaattagctgggtatggtggcgcgtacctgtggtcctagccnttttaaaaanccccccaaaaaaaaggttttttttttttttt

SEQ ID NO: 608124 - DNA, 845 bp, Homo sapiens
  misc_feature (596)..(596): n is a, c, g, or t
  misc_feature (739)..(739): n is a, c, g, or t
  misc_feature (769)..(769): n is a, c, g, or t
  misc_feature (780)..(780): n is a, c, g, or t
  misc_feature (839)..(839): n is a, c, g, or t
gaggcggcggcggcgggccgggcggcgggcccgggcggcgcgcggccggcgccgggggcccggggcgcgggcggcagccggggagcccggccgcagcccccggggcaaggcccggcccgggaacaggacgaagaggcccaaccaccggcgaccacagcacgcaggccagacgccagccgggccagcgagcagggcgaagggcggcggggcacccacggcagccccgagcggcgcgcgcggccgcggggccagggacgcgcccagcggcaccagggacggccagcacgagcccagcaagcccgggaaggcggggggcgagcgggcccggcagggcggggagcccagacgcagcaaggaccgccacgcggggccggagaaccgggccggcgaggagcggccaggggacgacaggggcgggggcagcgcgcccgaggccagcgggacggcggacggagcggaggggccgagggaggcgaggaacggaaacgggagaggggcaagcagggaacgcgcggaaagggaagccgaggagagcgcacgacagaagaccgagggacggaacaaggacaacgagggcaggcgggcgaaagggaaanagagaaagacgaagggccaggaggggacggcaggaggggaggggaaggagaggcgaaaggccgcgcggggaaacaggccacgggacacgggcaaccgcgagaccagcgcgggcggccgcggcccgccacggaaggggaaggangaagagagcagcaggggcgaggaagaggangaacgggccanaggacgcgggggggaaggcgcgagagcggagaaggggaaggagcgacgcgggaaaaaanggaagc

SEQ ID NO: 608125 - DNA, 162 bp, Homo sapiens
tgtcgtattccaaacagtcccaatgtagcgactcttcctttaggacctgaggtgggaggatcactcgagcccgggaggttgaggctgcagtgagccaagacggcaccactgcactccagcctgggtgacagaccgagactccatctcaaattaattaattaa

SEQ ID NO: 608126 - DNA, 106 bp, Homo sapiens
gttggctgtcgtcactaagacagggcccttcagcttcctctggatcgaggggctcttctttgacgtgtaccggatgcgacggcttgctatggagatctgcctggac

SEQ ID NO: 608127 - DNA, 504 bp, Homo sapiens
tgagaggattgcttgagcccaggagttcgagaccagcctgggcaacaaagcaagacccccatctctaagaaaagtaaataaataggcagggtgcagtggctcacccctgtaatcccagcaccttgggaggacgaggtgggcagatggcttgggctcaggagtttgagaccagcctggccggcacggcaaaaccctgtctctactaaaaatacaagaattagctgggcgtggtggtgggtgcctgtggtcccagatactcaggaggttgagacaggggaatcacttgaacctggaggcagagattgcagtaaccggagatcgtgccattgcattccatcctgggcgacagagcgaaactccgtctcaaagaaaaaaataaaaggactatgagtgggagcagatgtagggagatgcaagggacggcgtatcaggagaacagtacctgttctgggctctccgataatcaaaccactcccgtaccaggagtaccgagctcgacatcgt

SEQ ID NO: 608128 - DNA, 922 bp, Homo sapiens
gggatccgtctcgatctctgcctgggagggcgcgccccggtgggcgtggacactgttctccggccgcgtcgggccgggcgggtggggcgtcctgcgggttgggcggctggcctccgggtgtggcaccccggctcgccctggcccctcctccgcgcggctcccgggtgtggtgtcgcaccagctctctgctctcccaggcagcgccgccgccgggcccctccagttcccgggaccatggccaacctggagcggactttcatggccatcaagccgggacgggttgcagcgcgcccttggtgtggcggggaaaatccatcaaagggcggctttcggagccagaggggaattccggccttcggtgccaatggagatgttccctcgcgggccccctggaaaagaacactttgaaggcgggcattatatttgggccttgaaagaccgggacatatcttcccgtggctgggtgaaggtactattgaacctcgggggccgggttgtgtggccatgggctctgtgggcgggggcttggaactgtggtggaacacaggccgaggtgatgctgtggggggagaccaatccaggagattcaaaggccgaggcaacattcgcggtggggactttcgtgcattcaggtgtgccaggaaacattcattcatgggcgtgctcagaacagttgtgaaaagaaatcggctatggttaagcctggagaaatggttggtacaagtttgtgtcatggctggtcaatggataaggagggggcaaagaggttcctacgccggggtggtggcctgacaggttctcactgtgaggcagggggatttttaggttgcaaaggtggcggagaaaaaaaaaaagtggggggcagataactggggcgaagaggggtcgacgggggtaaacggggcgtggtgttaacgggggg

SEQ ID NO: 608129 - DNA, 1391 bp, Homo sapiens
agtcgatgatctgggtcgcttctgtgcttcgggctgtcagctgctgttgcgcgtggcattctcacgcatgtatctttgccgctgtggtagtaattgtctactcccgtcgcgcccgtctgccgcgcgtgtgggagttcgtcatatccgcgctgcttgttttgctcgtgtgctcttctgtggggccggttccttccgttggtgtttgccccccccgagagctatccttgcggcggcggacatgattccaccctctccctctgggtgtgcctccccacgctcattggctgcggcgccccgctatggggggctggttcaccccccctggtgtcgatggtgggtggtcacaagttggtgtctacacatgagtggggccccccttatcttgcccccccctgttgttggatccacagtaccgcccgttggtgggttgtttccgggccccggggcactttttcccggggtaatatcccgtgcggctctcttttcggggttttttgtgacccccgttttccccattgccgtgttctgccccttggtgttgagcacctccaaaccgtgggcgctgcccttgttgtagttggtgacccaccttgttgggccttagggcgcgtgttgaccgcagagtccccttgtgggatcacgacagggggtgagccacctcacagacgtgctgcattgttacggccccctggattcggggcgtcacttccggggcaagtatcgcccccggccgcatcctcattatggaagtcaccccctatgcccagtcagtgtcgtacgggtccaccctgtgcgtaataagtcgggtcccttgtggaccttctccgcccgtttgtccccagcccacaggaccacctctcgagttacttcctgacccagtcatgacccccttggcccacatagaaatgatttcactgtcccacccgctatgccacgagtgccccaccgcgaccccccttcgaaaccttggccgcaaggggagctccgcaaactacgttctcacggccttcaacaatcgaatatccccgccacggccccttcgcccctattttcttcgatagcccgcattacccccaaccacttagttaatacacttataccacccctctacccacctacacatcgttcctacgggaccacaacactatgtgaccgcacctctcccctgagactctacacaacatattgttgtcacccagaccctacttctaacctccctgttctttatgaattcgtaccagcatacccccgattccgctacgacccaactcgataccacctccttatgtagagacaaacttctctcacccactctaccctcagccttcacttattatgtatatgtctccataccccattaccattctccagcattccccctccaacctcta

SEQ ID NO: 608130 - DNA, 412 bp, Homo sapiens
ttttttttttttggccccccccgttggcccccccgggtttccccttttttttttgggggggattttgggggggaaatttttttcccccaaaattttctcaggggaaaatttttccccctttttaacccccccccccaaaaagccccccaaaagggggcccccccccgggggcccccccttttgggggcgggttttcccccggggggcccccctggggccgggatttttttttttttaaaattaaaaaaaaaaaaaaaaaaaaatgtgggggccccttgggggcccactttttaaaaaaaaaatttaaagggtttggttgagggggggggttggggtgggaagttagggtttattttaccctttttttccccctgggcccccaaaggggggcccttttttaaacccttttcca

SEQ ID NO: 608131 - DNA, 378 bp, Homo sapiens
gaagcgagatgacgaagggaacgtcatcgttggacaagcgtcgcaataagacgcacacgtagtgcctgcgtgtgcgtctaaggcctaccaccttcagaagtcgacctgtggcaaaatgtggctaccctgccaaggcgcaagagacaagtcttaccctggacgtgccaccggttaaaaagacgaaataccaccggaactggtcgccttgaggcacctaaaaattgtatcccgcagattcacggcatggattcccgtgacgggacacaacacctaaaacccaaggagggcagatgttgcagcatccaggttcactctcacagaatgtcacacgcttagctcatgaccaataaatgttcctggttttacaccacacataga

SEQ ID NO: 608132 - DNA, 551 bp, Homo sapiens
cggcgcctttttttttttaaactatgcaagtctcattacatttaaaaccctttttttaaacttggtcccttttctgtgccaactttatgttggttttggttcttgttttggtttgagatggagtctcgctctgttgcccaggctggagtgcggtggcgcgatctcagctcactccaacctctgcctcctgggttcaagtgattctcctgccttagcctcctgagtagctgggattacaggcgtgcaccaccacgcctggataatttttttggtaattttagtagagatggggtttcaccatattggtctgaaactcctgacctcgtgatctgcccgccttggcctcccaaagtgctggcattacaggtttgagccattgtgccaggcccctattttttattttctgagatgaagtctcgctctgttgcccaggctggagcgcactagcatgatctcagctcaatgcaatctccgcctccaaggttactgcaattcttctgcctcaggctctaagtagctgggatcaccggtgcctggaacgtgccctgctc

SEQ ID NO: 608133 - DNA, 948 bp, Homo sapiens
gaaagcgcctgaaccagaatcagacataaagctacgcgctaagctcttggcgctgacgtgaggctcgcgacgatatggcgtcattaggtaatagtttctccaacgctctattctcactatcgcctgacttaacagagggatcgtcttggagatcgttagagtgagggtcccgtgattggtaaagaagaagacaaccatgagaagaggtactgtagatagccgtcgctctgagaaaaaatggagcatgcgctagaataatcgagaaaatgcctccgtcttgagaacgggaatatggagataggggaacacacgatagtagaagaagggttgagaatggtagtatgtacaggagggtcgaaatcacctattgcgcgatgataaatgagggtactatatagaggggcttggaagaaataccagtggaatgtagagagagttatggcagataggggggcatcgctggatatggtgcataaaatcgaattacttggcaacgtaatgtgcataatgataaaattgtcaacgatgaatatcagagaaagcaggggaaaagaaatccagaggagaaaaaagagagatctagagggccggtccaggagatacaatctatgcataatagggaataccctgaaacctgaggacagagcaagtggagcttgaaaggaattaaaggatctagttgaaaaaattcttccagaaatttgaatgagggaacataagatctaacaaggtgggcacaaggctcatagggaatacctttaaagtttaactgaagagaaacgctgggatctagaacatatcgggggtgaacggttataagaaatttcgaagacgaaaccattttaacaaggccattccagttcagagaaaagcagggttactttcaaaagggggcacaagtcaggtttgaacatccagattttcttcatgcaagtgctaactggcgta

SEQ ID NO: 608134 - DNA, 311 bp, Homo sapiens
atgtgtggttgtgggtagcagacttgggttgtattggtagaggagcatcctttcccacaggacccaaggtgcagccctaccttccggagcttatggaatgcatgctgcagcttctgagtgaaccccatgcagtcccctgggccaaggatgctggctgtgatgcgccctggagagccatgtggtgagtgagatgaggcagtgagtgcagggagtgtggtggttcacaccaaatggcccttgtggcatgggtggttgttgggtagccacatttcctcagttgtgacgtttgtctgccccgtgcaccccacctc

SEQ ID NO: 608135 - DNA, 343 bp, Homo sapiens
  misc_feature (264)..(264): n is a, c, g, or t
gaggaggaagacagggtgtagcaatggcatcaggagggcgtggacactgagcaccacccacccacccaaatgctccctggggcacctgctgtgcagtagggagtgagtgtaccagaccctctgcatcctattccatttaaaacattttgctcaagtaatctgtgcccattgtagaaaaaccaaatacagacaagaaaatcctccctaaaccccagcatccagagagtcacagtcatgggtcgctgaatgtcctggccatctccnttccttgcctgtctagtggggacgttctgcttacctttcagatggcttcccagatcagggtggtgtgaggggctccacg

SEQ ID NO: 608136 - DNA, 276 bp, Homo sapiens
gctcgactgcacattctggacatgtatcccataatttaaagtatatataaaaaaaaaatcacctgagatcaggagttcaaaaccagcctggccaacacggtgaaacccatctctacaaaattacaaatattagctgggcacgatggcgggccctgtaatcccagctactcgggaggctgaggcgggagaattgcttgaatccgagaggtggaggttgcagtgagctgagattacaccactgcactccagcctgggtgacagagccaggctccatct

SEQ ID NO: 608137 - DNA, 215 bp, Homo sapiens
catccttcttcattccttctaccaacagataagggcggtgctcgggtctcaggcactgggtcctcaggcaacccagctctgagcagtttctgaacataatcccaggagcctcacttccctcgcaggcctgtgcagtgatcatgtacaagtctgtgggactgggcgcgggggctcatgttgggaatcccagcacttggggaggttgaggcgggagc

SEQ ID NO: 608138 - DNA, 103 bp, Homo sapiens
  misc_feature (9)..(9): n is a, c, g, or t
  misc_feature (22)..(23): n is a, c, g, or t
  misc_feature (55)..(55): n is a, c, g, or t
  misc_feature (66)..(66): n is a, c, g, or t
ctccagccncgacctcagtttnnatgagaacgacggcatgagttctcactcattntgttcagcttntccaaggaatgtttttatgggggactcatcatcgatc

SEQ ID NO: 608139 - DNA, 860 bp, Homo sapiens
cgccgtcggctgggcgggctacgcccaaagcctcctggccgatgccggggtgaggttgccggcatggctcgccgccgcgccgggggagggcggtgggttcaacctcccggcggccctgatcgtgctggtgctcaccgcgctgctgatgcgcgacaaccggcaggcggcgggcgccaacgccgtgctggtggcgctgaaggtcgcgatcatcttaggctttctcggcatcggcgccgcccatgtgcggccggagttgtggcagccgctggtgccggccaacgaggggacgttcggcgccttcggctggagcggtgtcttccgcggggcgggggtggtgttcttcgcctatgtcggcttcgagaccgtctcgaccgccgccggcgagacccgcgatccgcagcgggacgcgcccgtggggctgatcggctcgctcgtcgtcaccgccgtgctctatgtggcggtggcggcggtgctgaccggcctcgtgccctatcgcgacctcgacgtggccgacccgatcgccagggccatggcggcgaccgggctcaccggcttctcggtggcgatcaagctgggggcgctgatcggctgaccacggcggcgctgacagcgctctacgggcaggcgcgcatcttctacgccatggcccgcgaccgatgctgccggatgtgttcgcgcgcatcggcgcgaccagccggacgcccttcgtcgcgcaggggctgatcggggctcgtcaccgcgcctggtggcggcgctggtgccgatcgacgtgctcggcgaactcgtcagcaatcggacgctgttcgccttcacctggtctgcgcggcgtgctgatcctgcgcgcacggagctgaaagggg

SEQ ID NO: 608140 - DNA, 198 bp, Homo sapiens
gacaccaagaggctgaatggagccgggataccatgtaccttcgaaggaggtgccacatagactttaggtcgcatctgtagtcccagcttctcaggaggctgaggcaggtgaatcacttgaacccaggaggcagaggttgcagtgagctgagatcataccactgcactccagcctggcaacagagcaagactccatctc

SEQ ID NO: 608141 - DNA, 313 bp, Homo sapiens
  misc_feature (299)..(299): n is a, c, g, or t
  misc_feature (302)..(302): n is a, c, g, or t
ctttatctactttttcaatagaccacatcaagagctccccacgtgctctacttatcaattaactgagtagctctctgacttttaatgtcatttgttaaaatacagttctgtaatatgttaagcagctaaattttctgaaactgcataagtgaaaatctacacaggcttatgaatatattaagcacatcttttaacctgcaaatctgttctaacatgtaatgcagatactcgacttcttctgatatttatcttccttcgctttccttgcttccctttgccatctaacatacgcggagganctnttgttttttac

SEQ ID NO: 608142 - DNA, 294 bp, Homo sapiens
aacatcagcgccacaggtaacttccacaaaggtgtgaacgatctgagagacaaggcaagaagggcactctatgccatcaaaagaaacatcaatttcaacataccaattaggatttggctaaaaatacttgaatcagtcatagagcccattgccctttatggttgtgaggtctggggtccgctcaccaaccaagacttcacaaaatgggacaaacaccaaattgagactctgcacgcagaattctgcaaaaatatcctccgtgtacaaagtaatacacccgataatggtcgacgc

SEQ ID NO: 608143 - DNA, 111 bp, Homo sapiens
tttgtcgttctgagttccccccgcggtctgggctgggtactatgtcactatgggaccacttactatttacattactatgcaccaccatcaccattctgcagctcagggcgt

SEQ ID NO: 608144 - DNA, 806 bp, Homo sapiens
  misc_feature (38)..(38): n is a, c, g, or t
  misc_feature (71)..(72): n is a, c, g, or t
  misc_feature (172)..(172): n is a, c, g, or t
  misc_feature (180)..(180): n is a, c, g, or t
  misc_feature (210)..(210): n is a, c, g, or t
  misc_feature (241)..(241): n is a, c, g, or t
  misc_feature (265)..(265): n is a, c, g, or t
  misc_feature (274)..(274): n is a, c, g, or t
cgggtttcatttagagtggtgatgtatgaagggaaganaatcatggctgactcaggacccatctatgatannacctatgctggtgggtagaataggggtgttgtctttctctcaagaaatggtgttcttctctgacctgaatacgaaatgtagagatcctaaatcatcaaantgtgatgnaaaagactgatcataaaccaatgctggtantgcactttctggaactatgggcttgagaaanccccagggatcacttctcctggcnttccttctnttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttaggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggcccaaaccctaaagggaaggggcataccccagccgattgtattaaaaaaatatggaggaactggtacatggtcgggacttagtccttttccagggaattaaaaaccaatggtggattttcataatgtggccggccgtaagttgataacccctggtaattggccctttaattggagccagaaaggagagccaaa

SEQ ID NO: 608145 - DNA, 262 bp, Homo sapiens
caaattctaatcattattattatttgaaacccatctttaaattattattgattttgattgaaaattgcattcctaaattttataatttcttttacctactaatttatattcttgtataataaaacacatgggtttgtaatggttttattactatggtatcatgtctttttaatattttttaaaattttatttttctatattaacttcttgtacattaaattgtctaataaaactctaataggtttatatatttttccattgt

SEQ ID NO: 608146 - DNA, 1161 bp, Homo sapiens
gctcttctttcttttctcttcttttttctgttttgttttctcttttttttttttcctgtgtttttgtcgtttcctttcttttcgtttgtgttttgttgtgtgctcgggtcttattttatctttgtgtttctttttgtttctcttttctcttctgttgtcgttgttgttgtctgttcttttttcttttcttcattatgttctttctcctgtcttttcttgttcttgttttgctctgttttctttgttttgctgtctactcttggtccttttttttcgtttgttttttcttgatgttttttacttttgttctggtagtgtgctggttttctttgtctttcttttcctgtgttctggtggctttcctgtcttattttgttccttggtctttgttttttgtttgtattggttctttgtttcttgtctgcttctgctccttctccatgtttgtattgtggttcctttgtagttgtgtccctctgttatcctctgtcatgtgttccctgttggtctttggtggttgacccctggcgttgagttggtcattttcttggtatgctcatgtcttctagtccctccgccgtgacgtctgtccacatcgtgcgcgcttcctcactggttatgttattgcacggatcttaagttattctccccagccatgagcccgagtctcctgcttccctgggaaaagtgtgcgtatggccctgagctgggcttctatattttatatctgcaaatgaaatcacattttatcttatatttcagggaaagccggagtatcatacgaccgaataaatgtttaagccgggcgcggtggctcacatctgtaatcccagcactttgggagtccaaggagggggatcgcttgagtcctaggagtttgagaccagcctggacaacatggtgaaaccccgtctctacataaaatacaaaaattagaccatgcatggtggctcatgcctgtagtcccagctacttgggaggctgaggccaggatggatcacttaagcccagaaggcagtatggttgtagtgagctgagatcgcaccactgcactccagcctgggctaacatgagcaaaatcctgtctcaaaaaaaaagttaatataatattgcccggctcctagaatttatttatttcctgatatcaccgcaagcgagtta

SEQ ID NO: 608147 - DNA, 330 bp, Homo sapiens
acgcgtccgctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccagactggtcttgaactcttgacctcgtgatccagctgcctcggcctctcagagtgttgggattacaggcgtgagccaccatgcctggcctcttggaatatttaataagctaaaaaattcttatacacacgtagattaatt

SEQ ID NO: 608148 - DNA, 488 bp, Homo sapiens
tctgggaggtggaattcatccaggccaggtgtatcccaggatgtgcagcactgactctgaagaagctgatggtcttcaaggagctgaagaaggagctgatctccgtggtgatcgctgtcaagatgcaggctcgaaacgaatccgtgcggtcccatgagattgtgctgccccccagtgggacaagtggagacagacctggccctgaccttctccttgcagtatcctcacttcttgaagagggaaggcaacaagcttcagatcatgctgcagcgcagaaagcgctacaagaacagaaccatcctgggctacaagacgctggccgcgggctccatcagcatggatgcggtgatgcaacacccgtctgacaggtggccaggtgctgagcctctgcagcagcatcatggaggcccccgtcaaggcggacgaaatctgaatcgcctccctgtccagccagcccattgaccacgaagacagcaccatgcagagcg

SEQ ID NO: 608149 - DNA, 1089 bp, Homo sapiens
tgggttgagcacagggtactttatgtgacgtggtacattgacaagggtgcggctccctaggccccttccccttcttcaaggggttctacagtggcaacgtggtaaggaggggagattcaggtggtgggtgggggacgtgacggtgtggcagggactcccacagacaggtgcaagggttcttttcttctttccttcttgtgtgatgcctcaatgtgcgtggggcagtgggtggctccaaaggggctctttacactcctttgagagggccagtggtgggccattagaggttcccaacaacccgtgatgtgcttgtgtaaagcacaaaatttcggttgtgtctatacaccatgtgaatatgagactctttgggacccaacatgtgggcgttccgttgagagggggcaaatgtcgcccagcccccaacgctgtccaaaacgtgtcggaacgccagtggcggtggttcagctgagtttcaaacgttaatatgacgtgaacacccacccctgcgtgtttgcctcatccgcggtaactcccacaacgcagatttgcccccttatcagacgagggagagccccttccatcgcaccgccacttcgatctttacacaccacaacccattttccctttagatatagcgtctatatcaaacaatcctgcgcaccaaggaggtcacaacacacaacacacacagcgcacagcgtcacacgcgtccccacccaacacaggcacacccagataggcgccaactaggggagacaaacaagcaaacagcgccaatacccaccacggagaccccaccccacacgaaacaaccatcccaaaggcaaataaacccatctacccccaacacaagcctgtgcgcaaaagccgcccaagtaaaaagcgccagcgtactagacagcaaagtagaaaacaagaccccccaggcggcccaaaaacagccaacacagtacatcccccgcgaaagaggcatcacaacacacaaagcacatacacactgaaacagagcacacaaagacacgaaaaagttgaaacatagatagcacagaagatagcgcccaatgaacaacccacacataccgcaataca

SEQ ID NO: 608150 - DNA, 246 bp, Homo sapiens
actagtcgttcatacacggatccccctggctagctcaggtctctcatagtgttacggattacataggctgtgagccaacgcgctccagcctgttccttattattgtgagtagtactccatggtatggatgtgtcacacagaaatttcattttttttttgttttttttgaaatgaacccccctccttttgccccaggcgggacgtcgacggggattgactcttggtcctctcgtgcaagcctccacc

SEQ ID NO: 608151 - DNA, 1136 bp, Homo sapiens
ccaggacgtgctgccagacaccatgccactcagatgcgcctctgtcgctgggacccttcagaaactctctttgctcacagagttaccaaaaaataaaagagccaacatgtggtattgctggctggtatctttgtggtccacagtcgctactgttattatgctattggttagcaccatggccaatgtctggtagggtttccaatacggtagatgcatcagtaggtcttgggaaaatactgtaccaacattagctgcaagtgacagctctgtcatatgccagtgacagatgccctcaagacagtgcaggccttcatgattctctctatcatcttctgtgctcattgccctcctggtcttctgtgttccagctcttcaccatggcacgcaaggggccaaccggttcttcctctcagggtgcaccacacttggtgtgctggctgtgcattctctgctgcgaggtgtccatcatacactagtcattatgccgaatcgtgacgcgaacgccagtatcaccaccggctatccatacatcctagggctggatctagcattcctgcattcagcattacatcatcggcgttctctatctgggtccctggagaatacgacataaggccggacgaagtccatggacgatctggacggagttgcgagacagagcaacgccccggtcgaatcctggcggagcgccaccagatcgatgagaggaaggccagcgaaacaccgcagccacgcgcacacgcacaccgacacaacacacacgggaaagcccaaaacccccaccatcacaacgaaggacacactacctccccaccccctcgccctgaggccaccaacaccttcggcacaccaacctcctgctcaacccacgaacgagccccacaatgccacccgtccaccccaaattggccccccagctgtcaatagacacccaccgtgacttggacccaacccatcctaacacagcacatacctgagaaaacaaacagtacaacaccgcgaacatacccacgcaacacactaacacactagcagtcacaccaagcaccacccacagcagccacacaccacccccaacgtacatcaagaacacacacacaatcaatcccacagacaaacgtacacaaaaaagaaaa

SEQ ID NO: 608152 - DNA, 312 bp, Homo sapiens
  misc_feature (163)..(163): n is a, c, g, or t
  misc_feature (228)..(228): n is a, c, g, or t
aaaaggaatgcttttacactgttggtgggagtggaaattaattgaaccattgtggaagacagtgtggcaattgctcaaagatctggaagaagcaatatcatttgaccagcatttccattactggaaatgctttatataaatgctttatatgtgtatataaatncctttatgtacatacaggaatataaatcattctatttaaagatataataaatgaatgcatatgtntcattgcagcactattcacaatagcaaagacatggagtcaacccaaaatgcccatccaacaatagactggataaagaaatgtgg

SEQ ID NO: 608153 - DNA, 245 bp, Homo sapiens
  misc_feature (2)..(2): n is a, c, g, or t
  misc_feature (40)..(42): n is a, c, g, or t
  misc_feature (47)..(48): n is a, c, g, or t
  misc_feature (86)..(86): n is a, c, g, or t
  misc_feature (88)..(88): n is a, c, g, or t
  misc_feature (97)..(98): n is a, c, g, or t
  misc_feature (100)..(100): n is a, c, g, or t
  misc_feature (137)..(137): n is a, c, g, or t
  misc_feature (144)..(144): n is a, c, g, or t
  misc_feature (168)..(168): n is a, c, g, or t
  misc_feature (217)..(217): n is a, c, g, or t
  misc_feature (221)..(221): n is a, c, g, or t
  misc_feature (231)..(231): n is a, c, g, or t
tnaatggggaccttttgagttgaatttattttattatttnnnttttnntttaatgtctggtgctttctatcacctcttctaatctntnaatgtattnntntgcaattttggggtaagacttttttatgagtactttnctttgangttttagcggtcaatttgcctttntaatgaacatgtgaagttatactgtggctatgcaacagctctcacctangggngtcttacttngagttagtgccata

SEQ ID NO: 608154 - DNA, 143 bp, Homo sapiens
tcaggagatcaacatcctggataacgcagtgaaacccatactctactagaaaaaatatatatatatatacaaaaaattagccgggtgtggtaggagggcgcctgtagtcccagctactccgaggaggctagaggcaggagaat

SEQ ID NO: 608155 - DNA, 268 bp, Homo sapiens
actgagtacttatgtaacttcttattcgtatggaaatgcgcttatttgaaaggatattaggctggatgtggtggatcacgcctgtaatcccagcacttgggaggccatggcgggtggatcacttgaggtcagaagttcaagaccagcctgaccaatatggtgaaaccccgtctctactaaaaatacaaaaattagccgggcgtggtggcgggcgcccgtagtcccagctactcgggaggctgagacaggagacttgcttgttccgctg

SEQ ID NO: 608156 - DNA, 294 bp, Homo sapiens
gaggcgataatttcttgagtttctactgggtacatacctaatgttgtgatgtttaaaacaatgtggactgatcaaaatatcatcaggaaggatggctttctctttatcgtctgctctgatcccctcttctgttggagcggcatcctctagtagctcttacctgtcgagacttgccggtcttggctgtggccgtccttctccatcgtctctgactttgtagataccatcgggcagagattccctatctttctcatctctccatgaggccttctctttttcaccttccctttctgg

SEQ ID NO: 608157 - DNA, 354 bp, Homo sapiens
tttttttcctctccccctcctcccctgccccccatacatttctatccctgaggtaggtttggaagggcaggaagtacttaacatctcaggaggtagattggggaacatggtcaggtataagaactgagcttttaattttgaggttaaaaaaggacatcaggagcagctggggagggtccttttttaaaaaaatttttccaaattgggttttcgggcaaaaggccggtttggaaaaaccttgggggttttcaattttttgaaaggagaagaaatttggtgtgggattttttttcccgaaccattacaaaataacccgtttatttacatgcaaataaacttctttgataaaaagta

SEQ ID NO: 608158 - DNA, 125 bp, Homo sapiens
catgtcggtagcgtgagattatgccattgtactccagcctggagacagagcgatgactccgttctcaaacaaactataaaaatctgtcactcaggaacaagtgtatgggtgatcctctagcagtc

SEQ ID NO: 608159 - DNA, 166 bp, Homo sapiens
cagctgatgctgaggtgacttctagaggatcccttaaaagctacccggaggtattgcacgaatgctacagccatatcatttctgcagacgcctggcgcagaaggcctacgcgtccgaggtttcgggaaaacttcgggagccatggtagttactgtcctttatacgt

SEQ ID NO: 608160 - DNA, 935 bp, Homo sapiens
  misc_feature (770)..(771): n is a, c, g, or t
  misc_feature (914)..(914): n is a, c, g, or t
gaaccacatgtgaaccacttacctgtttaaccctatgaacttgaagagaacatgtaatgccacttaaaatacctaagctcgggttctgccttcagcgactcctggtagtagtgcccttatgagccatttatcaagaagtgataggatcgcattctgtcacccagtctggagtgcaatggcatgaccttggctcactgcagcctcgatctcccagcctcaatcaatcctttcacctcagcctcctgagtagcttgaactacagctgaggatgctatgaaaaccccttgaggaaacaaaggcaccttgggggccattgagaactcctgacgaagagggctcagctgccagacctgctcaagaaagacctcagaaatctctatggggctgtcagaagaaaaggtttgaaaagggtctggagagactgaaatttgtctgccttggacttttcttttgacaattcacatccaacttaagcagaatcattgtttattcttattatgccaggtttccttttctggtctgcaggttctctagggtttcataggctagtagttggaattttcatatttccaaagcattggggattttgcaaaaacaaaatctaaaggatattcagcagcacagtttacttaggaggttttaatcataataatctgcataatgtatgagaatttctacctcagctgcctcctttctttctctttcgtgtctgggaaaaagccagggatttttcccttcctctgatttaaataccttataaaattttggtnnaagcattttgtcctattctgtcttcctgattcattttctgctgtaatgagcaaaattaatttgcaagagctgctactgacatagtgtaataaactggggtcataggtagaatcagtgccgccttatgacccctagctgtcatngctttaaggaatttggcatgg

SEQ ID NO: 608161 - DNA, 392 bp, Homo sapiens
  misc_feature (1)..(1): n is a, c, g, or t
  misc_feature (42)..(42): n is a, c, g, or t
  misc_feature (148)..(148): n is a, c, g, or t
naataatcctcttttagacggcaaaaatgaataagtacagtngtgtaaataccatacaatgaatgttctacgtttacaatgttctgatactgtgaaaaggttgtttatagcaaatctgtttccagctaggtgggcttaaaaacagacntaaaccattatattatgaagatatttggtacttcttcacagtgaagtatgtataccttgttgaataaaatcatacattaaaattttggacaaataggctgggcacggtggctcatgcctgtaatcctagcactttgggaggtcgaagcggatagatcactgttggccaggctggctggaactcctgacctcaggtgatcacaccattgcactccagcctgggtgacagagcaagactttgtttc

SEQ ID NO: 608162 - DNA, 136 bp, Homo sapiens
gatgtctaggtgcctggctgcagcagctaggccctatggattgctggcatcccaggagcctgtccagttcaagggctcatggatgcctggaaagcgcctctctgccagagggcggaggcagacaatatggaaactc

SEQ ID NO: 608163 - DNA, 87 bp, Homo sapiens
  misc_feature (36)..(36): n is a, c, g, or t
  misc_feature (65)..(65): n is a, c, g, or t
gtttccatggagtggccagaacgactacgtctttgnccctgtgatagtactgactcaatggtgtnagtactacagagctatagactg

SEQ ID NO: 608164 - DNA, 133 bp, Homo sapiens
ctagctgactctagagggtaaaaggacgcccagggagacggataaaggaactgagaagcctgcagggatgaaagctctgccttaggcctcctcttcggcctcctcaccggaatcctgctcctcgtcttgcggc

SEQ ID NO: 608165 - DNA, 1321 bp, Homo sapiens
acatattccaagactcttttacattatgtcagaatgcaagcccatgcctcagcttctcccagacactcagctttgtcgcaacataatcccagcactctggaacgctgggtggattgcttgaacccaggagttcgagaccatcctgggcaatatggcaaaaccccagtctttaccaaaaataagctgggtgtggtggaacatgcctgtggtcccagcattcttggagaggctgaggatggagaggattgcttgaacccgggaggtagaggctgcaaatgggccatgatcacagatccatgcacatccagcctgggcaacagagagagacagatccctggcccaatgcccccttcccatggcccagtcatcaaaacaaaatgaggatggagcgtggtgagctcacaatctgataatcacagccaaggaatgaaagaatcactatgagcgccaggagatactgagacacagcactggcctataccatggatgcacaacaccacaaatcctctactacaaacatacaacaccctggccaagccactggctgacgacggcaccagataagaccgcaggactaccattgcgagcaggcctgacggcaggcgcgaacatcaccataacaaacccgagagaaggatgagcaaggaggcccgaggacagagaaagaatccaccaccccaactggaaccccccaagaccatggaaagagcagacaagcaaaacaactggcacacaacagcaacaaaacacaaatacacaaacacacaacaaacaaaacacaacacccacgacacacaacacaaacaacaccccccaacaaacggagcaacaaacccatacaagcagacacaccacgcaaaaagcagaaaaaagagagaccacaacataagacacagaacaacaacaagaccaccgcccagcaacaaaaataaaacagacaaaaagcaagagaacacacacaaagacgacgaacaagagacaacagaacttaaacggatcgagcaggaaaaaacaggacacacacccacacaacaggagacatgacagaacagggacacaacagcacacacagcggcgcacgcgcaacacgccagccacacagcagaggagacaacacaggctcagctgagagcagcgcacgctcacaggaccccgtaacccgacagcgacgacaggagcaacgacaaacacgccgacaacagcacacgacgcgccgcgacagaagaagaacagagcacaagacagcagagaacgaccacacgcagcagcaaacaaaaagaacacgggccagacgcgagagaaccgaagaccgcgccaccac

SEQ ID NO: 608166 - DNA, 950 bp, Homo sapiens
  misc_feature (1)..(1): n is a, c, g, or t
  misc_feature (71)..(71): n is a, c, g, or t
  misc_feature (89)..(89): n is a, c, g, or t
  misc_feature (93)..(93): n is a, c, g, or t
  misc_feature (100)..(100): n is a, c, g, or t
  misc_feature (103)..(104): n is a, c, g, or t
  misc_feature (113)..(114): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (126)..(126): n is a, c, g, or t
  misc_feature (128)..(129): n is a, c, g, or t
  misc_feature (136)..(137): n is a, c, g, or t
  misc_feature (142)..(142): n is a, c, g, or t
  misc_feature (157)..(158): n is a, c, g, or t
  misc_feature (176)..(176): n is a, c, g, or t
  misc_feature (212)..(212): n is a, c, g, or t
  misc_feature (214)..(214): n is a, c, g, or t
  misc_feature (217)..(217): n is a, c, g, or t
  misc_feature (228)..(228): n is a, c, g, or t
  misc_feature (237)..(237): n is a, c, g, or t
  misc_feature (239)..(239): n is a, c, g, or t
  misc_feature (253)..(253): n is a, c, g, or t
  misc_feature (264)..(264): n is a, c, g, or t
  misc_feature (270)..(270): n is a, c, g, or t
  misc_feature (274)..(274): n is a, c, g, or t
  misc_feature (277)..(277): n is a, c, g, or t
  misc_feature (282)..(282): n is a, c, g, or t
  misc_feature (292)..(292): n is a, c, g, or t
  misc_feature (623)..(623): n is a, c, g, or t
  misc_feature (625)..(625): n is a, c, g, or t
  misc_feature (844)..(844): n is a, c, g, or t
  misc_feature (935)..(935): n is a, c, g, or t
naaaaagccattattaaatagaaatgtatttaaacagcaagaaattaactataaatactaacaataaagtnctgcttaggacgtgaagncttnccctggnccnngccgtcgtnngncnggnggggngnntattttnnttttnctgttcacctaatcnntcttctccattataccantctctgtgtgtgtgtgtgtgtgtgtgtgtgtatacncngtnctctttcagtngagcataancnctgggggggggggnaaatacaatanagcggnggcngcngatgngctgtctgantttctgcagacaatctgcaaaaaaatggaagttctcaaggcccagttgctggtgtctcttttgaggccccaaaacttggttgatttatcttattggcactctgcatgaatcaagagtaggctcaaaggcaagccttatctcctgcgaacacaattccatacaggtctcaactcaatatttaaatttgtttggaactggctacaaatttggaacttcctcaaatgatattaaaagctctacacaaaaggtatgcagaagcagttactggtttttcaagaacaaagacaactgcaaaaaagcaacagttctgtaaatggagctgtagtaaatntngagacagcaataacaaggtaacaaatagagcagaggatgaccttttttgtaaaaaattgctgcctcaatatttcactatttaaaaaaaagattcccacaacatgaccttctgagagaaagaatccactgctgtgtttgaaagaggagttggttctggtggtgaaaggactgggaatgtcgattaagatatgcaagaatatctaacacaaagtccaacanttgcatcagcaacacccagtcagctccaggagggtgaagtcctgctctctagctgtatccagggctcttttcttgtggcattttaaaaaangtagcagtagttgca

SEQ ID NO: 608167 - DNA, 192 bp, Homo sapiens
aacagaggcgatgtgagctcaggctcccatccaatctacacctactagcagcgcggcactactccgggccatcaccgcccgtatatctacaccctacctgcctactagaagaggcatctagaactaccacgactccctattctactacctactctatacccattcatccctacctatcctacctacagatca

SEQ ID NO: 608168 - DNA, 262 bp, Homo sapiens
gtgttccaagttgtactgattcatcaaatggcgagcttgacgaagtgcaatttccacttcgtttggggcagcgccttgtgacttggccagcgccatgagtttggcgaccttgctgaggactttttgcttgtccatcattcacccccttcctgttggaggcggggggagagcgcctctgaccacaggcgaagtgtttcttcctcatcagcagagaggtgagtccgtcgacgcggccgcgaatttagtagtagtagtaggccgc

SEQ ID NO: 608169 - DNA, 1398 bp, Homo sapiens
taggaaacaaagttccactctgtgttcgcccaggctggtgtgcaggggcacaatctcgtgctcacgtgcaaccctcgcgcctgtgccgggttctccagtgtgatttctcctgtggcctcagcctttccatagtgtggcgtgggatttacaggcatgtgtgtgctaccagcccccggcataattttctggtatttttaagatagggaacaaggttttccaccaatgtgtttggccaaggcggtggctcttgtgaaaccgcctgtgtacctctcgaggtgtgactcccgcccgcctgtgtggcctctcccaagagtgtgcgtgggaattcacgcaggcgttctagaccacgcggcgccccgcggagcgcgggttttatatacttctctgtgtataggccatttttatcaccacaacttagagaggacacagagcggaaaagcggagagagggagcccagggagaggtggcgtgtctctcgttttgtgtccacaaacggagagtcataaagttgtgtgagagaaacacactctaagtgtgtcttctcccaagagggcctctgtgagagacaactctgtttgagacacctctctgtgagaaactctcggacacactgtgttgtatagccaccacaaaacgtcgtgtctccctcccacactctctcgagaggggggtggccctattaaaacaagtagtgtcaccattttgtgaacagagggggtgtgtgttaaacacggttttcacccaaaaatgtggtggggggcggagaggacccccttcaatattcccccccccaaaaatagtttttcaattatgtggaaaatatggggaagagcccaaaaaaagcgggggaaacggtcttgtggacccaaagtgccgttggtcatacaccatcttttttgtatcaccacaacaactgttggtaaccggccaaggtttccccctctggtggagcgccacgttgaaaagaacactcgttgggatttgttgcactagttgtcttcaaacccgcccacatcttaaaccaatttgttcggcgacgacacacaattctctcactcggggggcactccccttacaaccgcccacatttaacaccacacggcggtggtgtattacccagaccgccatgtatggtcttgttgggaaaaacacacacaatatgtcttgttcacacaaccacccctcttgttgttttgctcccccggtgagtagaacaattataccaccgattttcccccattttattcgtccccaaagataatccctcggagtagattaggggaacgaggaagtggtattatatctactcacaaaaaacacttaaacaaggatggcgagcggttacaaacagagacacacaggtgggaagccctcctatgtgggcgggacacaacgaac

SEQ ID NO: 608170 - DNA, 394 bp, Homo sapiens
  misc_feature (55)..(55): n is a, c, g, or t
  misc_feature (116)..(118): n is a, c, g, or t
cccgggaattggctttggtttgtgcaggtactttttctttgagacagagtcactncgtcacctgggctggagtgcagtggtgggatcactgttcactgcagccttgacctcccagnnntcaagcgatcctcccacctcagcctcccaagtagctgagactacaggtgtgtgtccatgcacagctaactttttattttttttgtggagatggggtttcactatgttgcctaagctggtctcaaactcctgggctcaagcgatcctcccacctcagcttctcaaagttctggggactacaggcatgaaatactgtgcctggcctggggaccagttgcattttaaggttccttggtgttcaaaaaccacggtttttagcctagattgagtttagatt

SEQ ID NO: 608171 - DNA, 475 bp, Homo sapiens
agtgctattactatggaaatcactaccaaaacattaaaatgtttctctttaaagagtgtttatcaatgctcaaacctgaaccagtcaacacagcacacaaaagcacaaaaaaatggaaaagcagtgcttaaaatcattcaaggatcattaagcatgtcaatccttttcttattcctaataccaaaagaagcaatcctaagcatcaaaagattgatcagtgtcatgacatgcaattcaattgagtttaaccatcatttaagtaaatatttgacttttgattttgtaagatcagccgggagaaaggaccagagagcaagatccaagttcaggcaagcttttattaaacccgccggctgctttatcacagacaaaggaggcagcagcagccagcttacagaatgaggggtttatattgaggagggagtcagagggagttctttggtatggccgcatcccggtgttgtttgctgattta

SEQ ID NO: 608172 - DNA, 251 bp, Homo sapiens
gaaaacgaaaccatgcagctctcaactaaagtagagagcactacttgtgattcatctatctaagacatcagtcgaggcgctggataggcgggggatgatgaagagagctctcatagagtagcatagtcatcagagagggggagcatcttctgtcaattcaatggcggtgataaccaaagatcacaagacactacttgaaatcctatgttggcgatctgggtaatcatcacaggtcataacttctaggtggc

SEQ ID NO: 608173 - DNA, 361 bp, Homo sapiens
atgatgagtggacacccctttcgatttttccacatagaaagcccttctatgctccccttataataaatcccgtggagggctggatcatggatagactcacgcctgtaatcggcagcactataagaggaggccgaggctgttgtggatcacaaggtcaggagttcaagaccagcctgaccaatatggtgaaaccccgtctctactaaaaatacaaaaattagtcaggtgtggtggaggcctgtgatctcaatctcagctactcgggaggctgaggcaggagaatcacttgaacccaggaggtgttgcagtgaaccaagatcacaccactgcactccagcctaggcaacagagactctgtctc

SEQ ID NO: 608174 - DNA, 846 bp, Homo sapiens
  misc_feature (846)..(846): n is a, c, g, or t
catacgccgcatatgctgaactgctggtcctggagaccccaaggcgagacctgcattattgaatcggcatatgatgctggtggacctgctcgagggtgggcctgcagaaaggaagatgtatgagtctgcatggcgccctgagcaagctcatcaggagcatcagaaagagggcatgcattctcgcaaggtgtccaccaatggccctacacactcgccacaggctgacagctgatgtgacatgcccgccaagccgtgcatgtcgccatataacatgtgccgccagtggtattaacaactggcgttgtcctattcccgggtgccctggtcccttgaggcggctgagacccagttgtgttcctccaggtgttgagtcgcacttttttgtaggatatttccccattgtatccctcatacgcactctacaaaggtctctgtgggatcataccataccagtgcctcgtggtgtgtattggttgcgcttggtcccttccgtcgcctcgcgcttttcgccgcccgcattactgagcacggcaagtgcctttagtacatttacattacgtctggctctatcaagggctatgtccttgtctctgcctcctatttccgatgcccgccaacatcggcacgctccttcctctgtcctgctccattttacccattactcgtgccgcgttataataccgcgacctccgatatcctcctcgcgactttttctcgacctttcccgcgttctctctttcttattcttgctttgtcgtccctttcgagaccgtctccaatggatgtggacccccgtttggcgcctctctatcgatctcctcacccagcgctgggcccgacggcatn

SEQ ID NO: 608175 - DNA, 295 bp, Homo sapiens
gacatgtgatagctgatacggctgtcttcctctgcacgttgaacagactggttaatatcctgctgccacgcgttaaagctgccgtcgaacgcatcctgtgaggcctgcaccggcgcggtcataaagtccgagagctggttgttctcaagccaggtcgcctggtggtccagatcgctgtaccactgttcaaagttcttcttcatggcggctttcagcgcgtgctctttctcgctgcccgccgcctgcgccgtgaaagcgttaaactgtgcgccagcctgtttcaggctgcttcgcg

SEQ ID NO: 608176 - DNA, 340 bp, Homo sapiens
cgcagacgtctttccacaataaggtcacacttccaagttccagagcagtgcttcgcggcttggcactatctattggggcacacttatcaagctagtcaaaagacaattgtccacttcatagacaaagagctggtcatatcagcgatggtatagaccaggggcccgccacattctgtctctaaagggccaggtggctatgtgggctctgtaggatagaccttttgtagcagaaagcaagccacagaggagacgtaaactgcacggtatacgctgtgttccggcaaagctttactggaccgtgggccaaggtagcaggtggatcacgcctgtaatctcagca

SEQ ID NO: 608177 - DNA, 280 bp, Homo sapiens
tgtgtcctccctaatccaggagtcggctgctaagtgtttcttcggtgatcgctgccgtttctgcacgacgtgggcgctacctggagaccaagccggccgacctgggcccccgttgcgtgctcttcgagaccttctgccggtgcccttacgcggtgacctgccgcttcgttgggcccacctgaggcccgaggaacagaacctggtgcaggaggagttggcggcccggggaacccaggcccccccgtccatccgcaactgccttggacaaaggcccttatag

SEQ ID NO: 608178 - DNA, 199 bp, Homo sapiens
tccatctcaaaaaaaaaaaaaaaaaaaacaaaaaaaaatttgttgggcgcgcgcgcctgggccctgcggaagaagagtttttgtaagacaccaatcgcggtgggggcgcgcgcgggggcccaagtggaggaaggtggaaactggggccaaaaccggggtccctaagggaaaccggggccgaggcacaagggggggggta

SEQ ID NO: 608179 - DNA, 1517 bp, Homo sapiens
gggaaggactgagcccagccagaggcgggcatgggcatgactgactggactggactgactggacatggctggatgtgtcccgccccatggcgatgaaagcgagaaatgaagaagagtgatacagggtatgctgcgtgaaaagagcagggacaaaaagatagataacgcaggagagggaggcagcggaaagagagagggagcggacgcaaagcgagagaggcggcgcaaggagacaaccgagagaggggagagggagagggcaggcagcaggggagagcgcgacgcgcagccgcggtagaaggcgagcagacggagcgcgtgcagcgcggaggcgagacggggacgagagcgaacgaagaacgcgggcagaggggcgaggcgaacgggaacggggaggggagcggggaggagcgcgaggggaagaggggacgggagggggagagggggaggggaagaaggggaggagggggaagaagagaggggggcgaggaggaggcggcgagagagagtgcggagaagagggtaggggaggggaggggggggggcggaggagacgagagagcgaagaagcggcgcggcgggaagggggatgagcgcggacgggcgagacgagggacaggaggagggggaagggaagcagagagagagcacacaaggaggaaggagacgcaaggggggaaggggcaggcggaaaagagagggaagaggagaggaggggcagcggagggggaggagacagagaggggcgaactgggggccagccggtgcggaagggcccggcgacgggacggggcgaagccgagcgaggagagagggggagaggcgaagtaaagacggcgagacgccggcggagcggagcggggggagagggccgaggaggagagggaggagggagagagaggcgacgggaacgagaggccgagggaggggggacgagggaggggggacgggagcaggaggggaggagagcgaggggcgcgagaaggaggacagaggggggggcgcgaaagcgcgaggcgggacagggggggagccgggaggggggagggagcgcgcggggcggcacgggggagggcgagggagagcgcgcgcagggcagagggagaaggagagcgagaggggaggcgggaaccacacagagaagaaacagtaagaaagagaacgggagggcacaagcagaacacacacgacgcagagggcgcgggacggggaggaccacacgacaagcagggagactcgacaaccagagagggaacgcgaagcagagggaacggcgagcggcccgccggcagccgcgcagggaggccggagcggggagaggagagacgagcgcgcgagaccgcagcgagcgacgcagagcgagcgcggagccggcataacgagggcgagaagggacggagagacgggagggagggggcggcgcgagggagccggcgagacacggggacgcatcgggggggcagacaaagaaggaggggggaggcgaggaccgggcagggagagcagagggggagagc

SEQ ID NO: 608180 - DNA, 487 bp, Homo sapiens
ccattcaacccagtacaaaatccaactgaagcccagcaagtggctcatgcctgttctatctctgaggacagttgtgattggatttagggcccatccagttagtccaggatgatctcatctcaagatcctaaatctgattacaattgcaaagatcctttttccaaataaggtcacatgcacgtaagttccggggattatgcttgcgtgggacacatcttttttgaggccgaggcgggcggatcacctcaggccgaggcaggtggatcacctgaggtcgggagtttgagaccagcctgacatacatggagaaaccccgtctctaccaaaaatacaaaaattagctggggcgtggtgcaggcgcctgtaattccagctacttgggaggctgaggcaggagactcacttgaacccgggagcggaggtttcagtgagccgagatcgtgccattgcactccagcctgggtaacgagcaaaactctgtctcaaa

SEQ ID NO: 608181 - DNA, 80 bp, Homo sapiens
ccgcctactactactactactactgctcgaattcaagcttctaacgatgtacggggacatgataatataattgctctccc

SEQ ID NO: 608182 - DNA, 143 bp, Homo sapiens
ttcctgtgccttctatagcgacatccaacctctgtttagctatacatgactggttctccatcgatttcagctgctgccgccgctgggcttgatgtgtggttgcctgggtggactcctgttcttcacgctctggtactgctaca

SEQ ID NO: 608183 - DNA, 662 bp, Homo sapiens
  misc_feature (270)..(270): n is a, c, g, or t
  misc_feature (273)..(273): n is a, c, g, or t
gaggatccctgcgggttcttcctgactgctggtgtccctgtctctgttttctggaagagttgtgtagaattggtgttagtttttccttaaatgttggatagacttcaccaatgaagccatctgggcgcagagtcttgtagtgtatttccgtagtatgggtagggttacctgtttcttcttgaatgagctttggtgtttatatctttcaagcaattggttcatttcatttaagttgtcaagttctgtggcataaagtcctccataatactnctnacacgagaaatgtgtggcacagaaaagggcttggttggacaaatttacaagggttgttaaacatacaaagtgccaaaagcctatagttattcattctattacttgttggcaggtaaatattttgtggaaagtatttgtttatttttatttttactttttgaggtggagtctcgccctgttgcccaggcagcagtgcagtggcgcagtctcggctcactacaacctctgcctcccgggcccgagtgattctcctgcttcagcctcccaagtagctgggactaaaggcatgcaccaccacacctggctattttttgtatctttagtagagatggggtttcaccatgttgggcaggctggtctcaaactcctgacctcaggtgatccgccca

SEQ ID NO: 608184 - DNA, 209 bp, Homo sapiens
ggtaccagcaggcttgggcccagataaagatgtcaggtctacagctatccagccaattcggtccgggttccgagctgacgcgggttcgacccgctgtccccgccgacacggacccccgtgtcgaggggccgtgcggtcgacctgctgtctggccgactcggacccgtgtcctagtagccgtggggtcgactagctatcccggcggactc

SEQ ID NO: 608185 - DNA, 117 bp, Homo sapiens
cctggcgagtattgagcccacttcacacacagcacacacgttcctgctggggtatgttgtgttgcgcatgtgtgtgtgcaggtgggtgcttgcgtgtgcacgtgtgtgctccgctta

SEQ ID NO: 608186 - DNA, 87 bp, Homo sapiens
attgacgtatatttgtctggactgaggttcggttacggttccctgttagcatggactttatttaggacccatgcttgggcctgctgc

SEQ ID NO: 608187 - DNA, 232 bp, Homo sapiens
tctttatgggaactgtagtggagcacatgtaggtgtttaactgaagtatgacatcaaaatctgtcatgctgatctcttccttttaggtagtttccttgattcctttcttactccctttgttaggaaatacacgggtggtgaaaactactggctagataatcaagtggtttgatttattccttgtccacctttgttaccctttgcccacttggacatctggtgaggcacgaga

SEQ ID NO: 608188 - DNA, 390 bp, Homo sapiens
cttgtgaaaacttcgcgtgcacagctcagtatgggtcccaagatacacagtataacctatgtgtgggtaggaagagtattcagtacaaacagggctggggacaggaaggggaagagaacttcagagctttcacgatcctcatctggttataggctgctccagaggccaaggtcccccatggaacaaactggcacaacgtgagggtaggccacatgggctcttttctttagcctttcattatataattttctcaacatagatctgactagtcatgtggctgggaaaatagttaattgtgatttttttttttaaactgcgtctcactctattgcccaggctggcagtgcaggggtatgatctcagctcgccgcaacctctgcctcccgggat

SEQ ID NO: 608189 - DNA, 216 bp, Homo sapiens
gctaagtcagttgtctcatttttttgtgataaggttttggaatttttagttaattgaaataaataatgctttaaatagaagtaaaaggtttataagtgttgcaaattgtagatttatcaattacctcagcaggtatcctcccatgtaattattagtgattagtgtaataagataatagattcaggtctcccaactatccctgggattgtcgcccac

SEQ ID NO: 608190 - DNA, 156 bp, Homo sapiens
atggttgctctatagtttctaacgtcaatactaagatgtgttcactatagttcaaattaaccgtggagaatacctctaattgcccatgcactatggtatttaggacacactaggctatgtacgaaccagcaacatcactctcagttctcagttaag

SEQ ID NO: 608191 - DNA, 201 bp, Homo sapiens
  misc_feature (5)..(5): n is a, c, g, or t
gaatngtccctcttcttaactggaaatcacacttgtgaggtatggtatccattatcgacagtggattcatgactgacttcatatttggtgtatctggttataaatttggtatagcatttaattgggcacttaatataaatccattggattggaatagtgtgtgtgtgtacatggtgtgtgtgtgtgtgtgcacttcagttt

SEQ ID NO: 608192 - DNA, 873 bp, Homo sapiens
taacggtccaccttggggccttacatgagggttaattaaactacaaaatgctcgacgggtccaggggtgaaggaatctttgttttggaaactaaaacttccaaggtattattattctttttttatgttagcttagccatcatgcaaaatttactggggaagcagttaataaaacacacattcccatttgaagggtttggtacattttcagtcctttacaaattaacaaagcaagtgataaacccggcacggtccgtgagaggaaattccttgtgcttcttaaagctgccagtcccggctttttggggggcctcagtggtgttattaaatttctggaagctcttttagctgcagttgtgagcattcaggacaaatcttcttcctcttcctcggtctcgctgtgtgtttaaaaacaagttcaaattttaagaaagggggtgtgttagcgtgttcgatacttcagtaagaattaaagaatcgtggtccgtggaagttttcgtggaaacattcagaaggggtgcggttcttccaggaatcttcctcggttgagcccgagaacgtgccccttccacgtttgaccgtggtgactgaggcctttgctgggacagaaaaggctagtgtaaattctcctttgtgcctttatccgtgcatctgtgggctctatatctggcaatttccttaaaatcttcactgtgctagccaaaacaaaacatttccttcactgaattccttttttaaaaatttccctaaatcttttcacgccttcgtgggtcttccagcagattctcccaggagtgccgcccatttggcctgggcacttagaggctcaggatagctgattgtggaactgcatcggctgccgtggatgtctaac

SEQ ID NO: 608193 - DNA, 110 bp, Homo sapiens
actacagtagtgctatcacagctcactgcagacttgaactcctgggctaaggatcctcctacctgagcctcctgagatagactaggactgtagggtctgcctatactgtt

SEQ ID NO: 608194 - DNA, 773 bp, Homo sapiens
atcggcacgaggaagcggcggtggcggtcgcggtgtatggcggaggagattttctggactgcgacttcctgaacaaccctggcaggagtgagcggctgttcagcctggggtgaggcctgaatgaaacgctccgtgggcccagtggctctacccctgctcctgccctgaccctgaccagcctccctcacgtgagccatgcgtgcctgggtagtgatgcatgacatcagaagctgtgagtgggatgatgggcctggatgctgagccccagctgtgatgccctgatggctcccctggatgtctccaccttttcctaccaagtccccagctgtttgaccttttcaacttgtgttctctcctacaagacggcttggagatctacctggaacccttgaatgtgatgcagtgttgattgtgtgtatcgatacttgctcatgtgtgggcagaatgcctttgttgttccttgcttgaacctgacctggggcctcaaacgtcttgtaccatcacttttgaatgagggtgccatggtaactcagataggttgccactgatgatttcagatggcccgcgcctgactgggactacccttcaagggagcgtatgccagtggcacggggctgcctgaattcctgaagcttattgcggcggtgaagttatcatagcgtgaggcactgaggacctgccaagaagtcggcatgtctcggacccgagggacagtgagttgcggtgaaccagcttctttaatccaagcttgaagtgctactgagcccgcactg

SEQ ID NO: 608195 - DNA, 619 bp, Homo sapiens
  misc_feature (43)..(43): n is a, c, g, or t
  misc_feature (71)..(71): n is a, c, g, or t
  misc_feature (74)..(74): n is a, c, g, or t
  misc_feature (77)..(77): n is a, c, g, or t
  misc_feature (99)..(99): n is a, c, g, or t
  misc_feature (101)..(101): n is a, c, g, or t
  misc_feature (121)..(121): n is a, c, g, or t
  misc_feature (128)..(128): n is a, c, g, or t
  misc_feature (132)..(132): n is a, c, g, or t
  misc_feature (134)..(134): n is a, c, g, or t
  misc_feature (165)..(165): n is a, c, g, or t
  misc_feature (183)..(183): n is a, c, g, or t
  misc_feature (187)..(187): n is a, c, g, or t
  misc_feature (189)..(189): n is a, c, g, or t
  misc_feature (215)..(215): n is a, c, g, or t
  misc_feature (218)..(218): n is a, c, g, or t
  misc_feature (310)..(310): n is a, c, g, or t
  misc_feature (322)..(322): n is a, c, g, or t
  misc_feature (331)..(331): n is a, c, g, or t
  misc_feature (340)..(340): n is a, c, g, or t
  misc_feature (348)..(348): n is a, c, g, or t
  misc_feature (355)..(355): n is a, c, g, or t
  misc_feature (360)..(360): n is a, c, g, or t
  misc_feature (363)..(363): n is a, c, g, or t
  misc_feature (366)..(366): n is a, c, g, or t
  misc_feature (374)..(374): n is a, c, g, or t
  misc_feature (386)..(386): n is a, c, g, or t
  misc_feature (401)..(401): n is a, c, g, or t
  misc_feature (416)..(416): n is a, c, g, or t
  misc_feature (421)..(421): n is a, c, g, or t
  misc_feature (424)..(424): n is a, c, g, or t
  misc_feature (426)..(426): n is a, c, g, or t
  misc_feature (442)..(442): n is a, c, g, or t
  misc_feature (455)..(456): n is a, c, g, or t
  misc_feature (492)..(492): n is a, c, g, or t
  misc_feature (579)..(579): n is a, c, g, or t
ccaaagaaactgttttgcagcctgtcacctcctctggcaggcngccatcctggtctcggagagtggggtcngcnccngactggggcggcggctctacantntccagaaactcacaggcagnggcatantgtngngctgtttggccttcattgtcctgacagttantgtcagctctatgttgcngcancnctgtgactagttccttatgtcctcgntcncaggcccagtgaagtagagccctaccctcttcatctttcacattcacatccacatttttcgatttgatggctttggttatatggtcaatgtngttttccctgcngtaatcaantatattttngtcttctnccctganggttnctncangatatagngaactaataacnggcccaccaaaaccngtatttgcttctttnccttnctncncgggtatcgggggatnccaaccgggatcnngttttttaactacggcgatatatcccggcatggctnggcgggggcttgaatcaccaagtgctttccaagcttcccatttttgctttccttcaaaatcaaagaagcttggtttaggagtattanaatttccaactttgacctgtttgtacctggcatacaggta

SEQ ID NO: 608196 - DNA, 267 bp, Homo sapiens
tcgagatcttcaagagtttggtcatcgagctggacaaagatctttatggccctgcaaccacctgttgagtggcatcggacacccacgacccaggagacggcttccaggtgaaagcgcttcctggggaccgtaggtgttgctctgacctgctcctcagtctggactaccagcctccccagttcaaactgggatccgccctagcccggctgctggggctgcacacacagagccgctcagccattgtccaggccctgtgacagatctcga

SEQ ID NO: 608197 - DNA, 131 bp, Homo sapiens
aatatccgctagctccaagtagctgggattacagcttcaccagcaatttaatttttggtaaggcagggtctctccttgttggtcaggctggtctcaaactcccgactcaggtgatctgctgctcggctccc

SEQ ID NO: 608198 - DNA, 345 bp, Homo sapiens
caaatatgtaaacctctacattatttctatgtagaaattatgatactctttaagcctgtcacagattttgttatttaatgcaaagaagcacatatattactatgggacacttttggtttgtttaaatatattgatagttgtattttaatgtaaagggtttcatttataatcttatacagatgatcccctacttacaatggtacaacttaagatttttaatcttaacaacggaatgaaagaaatacattataagaagaaactataggtcaaatacaaatacaacaataaaaaatacaatttactgaagtatataaataaaacatttgagatattaaaaatataagc

SEQ ID NO: 608199 - DNA, 171 bp, Homo sapiens
aggacgtaagaacgcaggtcgagagcgagctgggctctggggaaaggctccctgcggctggcgcaggctgtatgagcaagggtggacgctgggatgtgtgggcttccatgacatcttgaagacaaatccctcattctccttgtgttccccagagctgttggcacctccact

SEQ ID NO: 608200 - DNA, 393 bp, Homo sapiens
  misc_feature (225)..(225): n is a, c, g, or t
  misc_feature (229)..(229): n is a, c, g, or t
  misc_feature (234)..(234): n is a, c, g, or t
  misc_feature (236)..(238): n is a, c, g, or t
  misc_feature (240)..(240): n is a, c, g, or t
  misc_feature (251)..(251): n is a, c, g, or t
  misc_feature (338)..(338): n is a, c, g, or t
  misc_feature (358)..(359): n is a, c, g, or t
gtggagtgtatccaccagcaggtagtaggtcaggggctgaggagtgatccccagcaggtagtaggtcaggggctgaggaatgatccccagcaggtagaaggtcaggggctgaggagtgatccccagcaggtagaaggtcaggggtggtggagtgatccccagcaggtagaaggtcaggggctgaggactgatccccagcaggtagaaggtcaggggtggaggagngatntccancnnntngaaggtcaggngttgaggagtgatccccagcaggtagaaggtcaggggctgaggagtgatccccagcaggtagaaggtcagggctgaggagtgatccncagcaggtagaaggtcaggnntggaggagtgatctcagaaggtagaaggtcaggg

SEQ ID NO: 608201 - DNA, 771 bp, Homo sapiens
tttttgttttttttttcccaggaaataaaaaacatatatttaaatgcccaactatgcatccatatgcctcagcccagggcaggggtggggagtaaggtaaaaagggatgcattaagttggccctggtccccaaagagcgggtaaatagcttaagccacttcttcatctcccagcacagacctttcagaaacccccagaatatcaggagtgataaggtggatagggcctcacgtgctctcattaaaacagcctcaaacaacctgtttccccgaggagaggcaagcctttcgtgcctccttgggtccctccgtgcctatcaccattaggaccacaaggtgtcttctcgctctgtggcccagaacatctcgtgtgtgaaagggcgtggaatacagggacaagcgttacccaatcttctccatctagtaatcaactactccattaggctcctcgtgataccccattttgggagcacgtgttgaagtctcagctctcgtggaggttaggtgctgacgcagaggggggcacacgtgaaaattagagcctcaaagccccccaggggaagcggggcaatgggggaacgctaaatagtgcagagaaggtgttggccggaacaccctaattctgccagcagccaggtattctgcagaatactccctgggggcaggtttggacctcatctgaccccggtgggtctgacagaaataagctttgtattgggccaagcccagttaaagcacgggccaactgtggggcgccaaaacaggcggaatt

SEQ ID NO: 608202 - DNA, 151 bp, Homo sapiens
agcgacgcattcgtatgatgtatatgcaatacttacatatccagttaaaaggagccagtcaggttgttcccttggtttttgcaatgaaacaagcaaatcaatcttttcaatgttctggatgttgttggagatgataaagccagcgaagatg

SEQ ID NO: 608203 - DNA, 415 bp, Homo sapiens
cggaaggaagtagggaagcggttgtgggggtgaagctaggtcagcatgacgggcctctggattagctgagcgagcagcgagcattggaggtggtcgctgggtctaaaggaatgttattctgggctacaggctttggtcgaacctatagggaaaagagagaataattctggtattacattaagctgcgcttgtcctattataagctacatcttccacactctatgtagtgaaatggtgttgaagtacacgtgtattaatgttcatttgggttctattagtgtgctatggacgtcagggcatgtcatcttattctagactcatcatgctcttgcggtccggtcctcaccctagagcatcgcttttgattttaatccctgtgttccctcttctataccatgtcacctcttctagctta

SEQ ID NO: 608204 - DNA, 138 bp, Homo sapiens
aaaggttagactcctagaggatccccatgtaccatctcctgcaacaagagctgactgaggccagaaggctacaggatgtggaggccagtgcgccacctgcaaccacactgtgatggccctaatggcttccctggatgc

SEQ ID NO: 608205 - DNA, 546 bp, Homo sapiens
  misc_feature (161)..(161): n is a, c, g, or t
  misc_feature (243)..(243): n is a, c, g, or t
  misc_feature (252)..(252): n is a, c, g, or t
  misc_feature (268)..(268): n is a, c, g, or t
  misc_feature (481)..(481): n is a, c, g, or t
ttccgcacgcactcgggttttattgactacattgcaagcaaaagcatcgaacaaaaaacaatcatttaaaaacaccaaaaagcctgggggagcaaatgaaaacaaataaattaacactcctattgggttgtgtctgccagggaggatacaggcctcattcnctccgggccttgggttcccgggatttccactggatgtaatcaaagatgtctttttcactatccactgggggggggtctcctncaactccantgactcccaagggacngatgggggactcattaattgggaaacccttttctagggcatgagccctcatattcttattgaaaatatcactcccaggggaataaagaacaccacagtaatactgatctttggggatcaacctgatatcaattcttctgggggggtattctttttcatcatttttaccgggaagctgggaaacacccataaactttgtctcaccctttgacangggatctgggataaaatgaaccttttggaactggtccacaacctgatgtaacagtgttgggcttg

SEQ ID NO: 608206 - DNA, 211 bp, Homo sapiens
cggaggctgtaatgagccatgatcacgccaccgcactccagcctgggcaacagagtaagaccctgtctcaaaaatgagagagaggccaggagcattggctgatgcttataatgccgaggtgggtacatcacctgaggtcagagaccagcctggccaacatggtgaaatcccatctctactaaaaatactaaaattagttgggcatggtggc

SEQ ID NO: 608207 - DNA, 1347 bp, Homo sapiens
ggcaaaactagaaacgaaggacgcagtggagcctggtgccccaagcattgctcctgccaacatcatatttatttccttgtttgtgctatgctgggcaggccttcatcttgtcaccttatagtgtaccttggaggggccagggctgatggaaggccggacccaggttccatgagggcagcagtgcagtcgcggacttaatatggctagttgctacatacgggtgcttatattctacacacagagtgataacatgcataagtgtggcgtatgggcattagagacctgaatgatccccataatgatacaagaacatgcataaatgtggtgtcctccttgacagagagaacgcgagagagacacaaccacaacagcgaaaaaaagcagcacacaacaagcaaaaaagaaaccgacacaagacggggacaagaccacacacaggcacaaccagggccccgacagccacagcagtacgcacaacattgcagagcgagcaacgcaaagaggagcaggcaagcaggagtacagtagcagcgagtagcaacaaacgccagtgaaacagaggaagacgagcgcggggacgccagaggccgaggacggcgccgcagaaacaacaggggaagggggagatggtgagcgggcgagagcacgcgcgaggagaggcggaggccggagcggaggcaggacgaggagggggagggacgcggaggagagaggagaggaggacggagcacggggccggggggcggcacgcgggcacgagggggggagcagcagcagcagcgaggaagaggagatgaaggagtagaaaataggggaggaatggaaggaatgtgaagagagggagaacgagacgaagtggagatgtaagaatgggaaagatgagagaggagtacgaaagaggagagaagaaaaatagagaggggagaagagaggagatgaaaagaggggggatgaagagaaaggaggagcacagacgcacgacaccggagagaagagcagacagaagacaagaagcgaaggacggagagaggcggccgggagcgaggaagagggaggagagagagacaagagaagggcaagaacggacgacaaaacagcggaacggagcaagagagagccagaccacaggacgagaagagaggcaaagagagaggagaggggagaacagagacgaagaggagggaagaagagaaaaagatcagtagcaaatgaagagagaaggcgaggagaaaggaggagaagaaaggataagcagagaatgagcaagcgagaggaataaaaggaggaaagaggcagaagaagggggaagaaacaggaacaagggacaccaagggagaagagaagagg

SEQ ID NO: 608208 - DNA, 164 bp, Homo sapiens
  misc_feature (28)..(28): n is a, c, g, or t
  misc_feature (54)..(54): n is a, c, g, or t
  misc_feature (154)..(154): n is a, c, g, or t
  misc_feature (162)..(162): n is a, c, g, or t
acattggaagccctcatgagtgcagggnccgccacttgtccagagggccacgantggggatgtacttgaccccacagccatctggggatgagccgcttttcagccaccatgtcttcttcatcagcattgaattggtggccccactttctttganatgtggtntt

SEQ ID NO: 608209 - DNA, 266 bp, Homo sapiens
  misc_feature (38)..(38): n is a, c, g, or t
taggttttgttactctcattctcaattataaattatcntcgtctttctcacttatctaagtccttaaaaaccccaatactatacttggtattaacgaatttacaccttacgacaccttatgttggacgtacatatataaacctgtcaaatatatgttttatattcactaaactaaaataatacatacctcacactaaattaaaatattatcagtagtattttatgcatattaaattactactcccttccaattttgtttctcatta

SEQ ID NO: 608210 - DNA, 166 bp, Homo sapiens
aaggacactagagcacccctcttgcgtatacaagggggcctaagaagacccttcttaggccctctcacataccaagaggctctagtgccatagcagtagttcacaggaaggacaccaggagaagttatacctaggctactagacgctcatatccctctttctcaca

SEQ ID NO: 608211 - DNA, 237 bp, Homo sapiens
ccttatggctgtgttggtctttgaaacagaggctgtgctggtggtggtcacaggggctgggagtagttccatgaaccggaggttgtgctgcttgtatcagctcgaggttttgcgtggtctgtgtgagtggaggttgtgctgcttgatagcgggaagagattgtgctggattgtaaggggcagagacttgtagctggttgtagaaggcagaagattgtgctggacaagccattatagg

SEQ ID NO: 608212 - DNA, 795 bp, Homo sapiens
  misc_feature (511)..(513): n is a, c, g, or t
  misc_feature (567)..(567): n is a, c, g, or t
tagaataacgagacactatgaagttatcaagaatttgtcatgatcaaccagtaaaggtcgagcagtcttctggattgaatttgtcatgtgctgtaaaggagccaagcaacctcgggttgcagcccaggacctcacaggcttccagtaacactccttcaacgtgattgggttcctgctgtcctgtgtggcaactgtgatatttaccatcatgaaatgttgtatgttttgtgtctggaaatttgctagaactggaaagaagggaaacagatttgttgtatttgaagcttgaagttgggaaacctgatagatgggacttcttcagtttattccaacaagaaagattgtgatgcaagattcctttctttctgtgacagaatatctcttcaaaaattacttaccttggcaactaaaaaatttgtttttcagagatttaatacctgtttaatggttagaaatactttttgtcaagaaggaaaatactggcaaaaatattaaatagtataaagccttnnncaaaaaacaaaaaaaaaccacccaaccacgaacccaccacaaacactacccganaacaaatcccaccggcaaaactaaataaaaagggcctttttgcccctaaggggggacctttggcgccccttcctctttggaggggtaattcataaactctcgcccctgactccctgcctccggcttagggtgcggaaaacggtttaccttcattaaaggggggatacgggtttccccaaattccgggaatccccaggaaaaacttttaaacaagggcccccaagggcg

SEQ ID NO: 608213 - DNA, 149 bp, Homo sapiens
agatgaagcaagcggcccaaacacccagttgcgttctattagtatggaaccatttgcattggtttattttaagctttatctttccttgtgcatccggaccaagaaaatatcttggattatgagaatgacggcgccggtgggcttcatgt

SEQ ID NO: 608214 - DNA, 257 bp, Homo sapiens
  misc_feature (252)..(252): n is a, c, g, or t
aagtgtttctacaggataccccattttatctagaaggctgccttaccatattgtataacttttatccttaccttttttgcccttcttaataagctgtgtgcaacaagccagaagtcctggctaatgcgattacgcactgttattaagattgtctacagatagctattcttatgggctgtgccatcttgccacatcttagaagtttagttgaaatcattgaacattgtcttgtggatgagcagccttcagatnaaatg

SEQ ID NO: 608215 - DNA, 564 bp, Homo sapiens
actcctcgccatcacgtgctttgttgcagctatttgtttgagcccccccatctgtttacacaccatgtctctctcttggtgttgttacaatacaagaagacacgctccgtcacacacactcggtggttacaagaaaagaaaggtgtcttgtctggttgggtaaaatgattgtagaacatgtggcgagagacaaacggggcttagtacagggggatacaaaatggttcaaaactactctctccatcctttttctttgaaaacagcagttgtatagagtacacactacactggcgtgtgatctagtatccgacacacacacatggctggggacactcacacacctgtctgtgagagagagagactcgtgacaaaagatatatgagcgtccgccttcctccatccggggctggggtgaaggtatatctcaacagcatttttttctattcctcttatggattttctgtgtattcttcttcaatgtctccatggaaactagactcccccttttctttttgctcaagaataagacatacgtcttcgatacacaacagatgtccacaaaca

SEQ ID NO: 608216 - DNA, 782 bp, Homo sapiens
cgagaggtcgcgagttggtggcgcttcctgcttcctgcagtgctgcagcctccggccggccggcgagccagtgcgcgtgcgcggcggcgtgctccgtcagcgaccggtggagcggactgaccgtgcggtgtagggctattcagagccagacggatgtgagtgctgcgacgtgcagagtgccagacgccgacgatgctgacattgggggtacctgtgcgaggcatccttgacttgcacggcagtggactgctgagattggacctagaagacaaacggacgtgaagacgactatcgaagcgaccaattgggtcgctaccgtctactgaacggtcgggtgagcaggagtcttgagattgaacctcgtctacgtcgcaatgagaggaatcggaaattgtcttcccttctacttgtaggtccttatcaaatgaactggtggggattaggttgcgcagtgacgatctttccgtaggaggtgttccaattgaaccaggcgatttcggagccaggataaacgccattgagcttcgcattgcgagaggactgcacatatacgcagagattcgcggtacggacacgatgtgtcaacaggcttttacgcggcgtgcaggatgcgcattgggacccagagcgcatcatgggaagcacccagttattgcggaatcgaatggttcccattgttcattcatttggttttggtaccaatggtttcgcttgagaattccaaaggaaaattttgcgagatgcgattttccccaagttattgcaggaagccgaaaggctgg

SEQ ID NO: 608217 - DNA, 173 bp, Homo sapiens
atgtgatctgtttccagtaacacctattctcctgatgggggctccaatggggggggcactccatccactttaccaccctttacaaacacccaccctgtcgagacaagctcgtccctattagcctggtctagaccagtaagaactttcagcaccatggtcagcactgacactga

SEQ ID NO: 608218 - DNA, 191 bp, Homo sapiens
accatgagagctctctcctattatccaggtagcattgttagatatgttggattacaaataaaaaattattgcctaattcagtatttaaagtagttggattctataaactttttcctgttttaaaaaaaggtttagatttataaagccttctcagtggccctcacttctctgttttattgtcgttacagatt

SEQ ID NO: 608219 - DNA, 163 bp, Homo sapiens
tacgagttgtctctctgctgcaagcaaaacacatcatttgctaaatcccaaacaggtgcctgcatgtcaatagcttccatggcatattcaacttggtataagcgaccttctggagaaaatatagtggtcctggggtcatatcttcgagactgcctcgccaaat

SEQ ID NO: 608220 - DNA, 351 bp, Homo sapiens
  misc_feature (296)..(296): n is a, c, g, or t
aaggatgttgcgagaccacgagccaggtggccacgcagagcaaaccgtgggtgtgcacgaatcaccgcaccatgatgttcatggacaagttttgaagattagcgacacagaccctgaactgtggagggactgcctcgactggcagagcgggaaacgtcaaactcgaggaaagtgcatataacatactctgcattgttaaacaaagaacaggatcttttggggatcgtcctgcaagacctactcttttagaacaagtgttaaatcaacaacagctatttcagctggttctggagcanagacaacagcagtttccaggaacatcaatgtgagggaacttaccaagcatgtact

SEQ ID NO: 608221 - DNA, 277 bp, Homo sapiens
cacggtcggccgagaatgtgctccccgtggtgatgaacgtcctccgtccatgttcccatcgtcgtcgcccgaccccagctcacagatgtgctgtcgcgctgagctgctcctagcgcgcttgtccgcgtacttgcccatgaccttgaagtgctcgtatgtcttgttcccgtagataaacaccgggatacttgcacccctcgagagatcgaggtttgtctccctgcagccttgtcgtagaagtcctgggaccttgtcaggaggagtctccctccagctg

SEQ ID NO: 608222 - DNA, 209 bp, Homo sapiens
gagcaaaccctgtctcatactcacaaacacacaacattagcccagcgcggaggtacatgcctgtaatcccagctacttgggagggttaggaggataggaggaggtttctctctctactcacctctttactatactacgtagagctcatgtaatgttaaactatttctaacatacggtgaaccctgtaagttccctagtagaggcagcag

SEQ ID NO: 608223 - DNA, 355 bp, Homo sapiens
tagatttatttctagatcctttatattgtttatggcttttgtaaatgcaataatctctctaaaattttccacttggtcctgatatagagtaatacaaatgaatttgggatattgcttctgtattcaggaaccttatgcttattaattctaaaaattacctgtagatttttttggatttttctacaaagaaaaatcacatcatctgtgtatgatgatgtttttcttcctttccaagtatgggtttttatttctttttcttgtctattgtacttgctggactctcaagcctgtccaaccccatggcctccatgactttttcaaaaaaaagactagttctagatcgcgagcggccgct

SEQ ID NO: 608224 - DNA, 615 bp, Homo sapiens
aaagcaatactaggcaaagaacaaacagtgtaagaatcacattacctgactatatactacagaactatagtaaccaaaacactatggtactggcataaaaacacatagatcaacacaatagagaaccctgagataaatgtataaatctgcagtgaactcacttttgacaaagttgccatgaatataccctggggaaaagacagtctcttcagcaaatggtgctggggaaaaactggatatacatattcaggagaaaaaaactagacccctatctctcgccatatataaaaatcaagtcaaaatggattacagatttaaatcttagacctcaaactgcgaatctactacaagaaaacattggggaaactctccaggacattggactaggcaaagatttcttgagtaatacccaacaagcagaggcaacaaaagcaaaaacagaccaatgtgattgcatcaagttaaaaagcttctgcgcaacagaggacacagtccacaaagtgaagagacaacccacaggatgggagaaactatatgaaactacgcatctgacagcgataataaccggaatatataagaactcaaacattctgcggacaaaaattaacaatcggt

SEQ ID NO: 608225 - DNA, 459 bp, Homo sapiens
gcggcctcctactactactaaattcgcggccgcgtcgacttttttttttttgggacagagtcttgctctgtcgcccaggctggagggcagtggtgcgatctcggctcactgcaagaatgtccactcttgactcttctgttcaatatagtactggaagtcctagcccaaccaattaggcaaaagaaaggaatacaaggcacccaagttggaaaagaagaaataaaattatctttgtttgcagataacataatcttatgaagtcctaaaactccatcacaaaattgtcagaactaattaatgaagtaatgttgcaggatacaaaatcaatatacaaaatcaatagtgtgtttatacactaataaataatccaaaaacatttttaaaagtccacttacaattgctacaaaaaaatgaaacacttagaaataagttttgccaaggaggtaaaagatttgtaca

SEQ ID NO: 608226 - DNA, 131 bp, Homo sapiens
gtgctctagaggatctcacggaggagaagctggagacgtggcacgcgcccgggcataggaactatgctacgttatctcccacaaccctgagaccaagaagacccgtgtgaagctgccctcctctgtgctgt

SEQ ID NO: 608227 - DNA, 580 bp, Homo sapiens
cctcctgcctataccggccacttcccccaatgttcccaggccgggaccctcaccccgtgtacccgttccaatgccctcctgcgtcacctgggccgcccccttgggctctatgggaaggaccccccggaggcccccctggtggacctggtgaatgacggcctggaggacctcccgctgccaatacgtctccctcatctacccccactatgaggcgggccaggatgactatgtgaaggcactgcccgggccactgaagccttttgagaccctgctgtccccagaacccgggaggccagaccttcacttgtgggagacccgatctccttcgctgactaccagcctgctggacttgctgctgatccctgaggtcctagcccctggctgcctggatgcgttccccctgctctcagcatatgtggggcgcctcagcgcccggccccaagctcaggccttcctggcctcccctgagtacgtgaacctccccctccatggccacgggaaaccatgagggttggggggactctgagcgggaggccgagtttgccttcctttctcccggacccataaaatttctaagaga

SEQ ID NO: 608228 - DNA, 196 bp, Homo sapiens
  misc_feature (1)..(1): n is a, c, g, or t
nttggaggtcggaaggttgagacaaaattaccagcaggttagctttcttcttggcttaataaatagctttcctctccctgtgtcttcacatggtctttcctatttatctgtctgtgtccaaatattctcttcttacagggacactagtattattggattagggccactcctcgattaagcgttggtaccgagactc

SEQ ID NO: 608229 - DNA, 616 bp, Homo sapiens
ctgtgaagcacctcctcagtacgttttgcctacctatgaaatggcccgtgaaaatgcctgaaaaagaaccaccacctccttacttacctgcctgaagaaattctgcctttgacaataaatcctataccagctttttgtttgtttatgttacagaatgctgcaattcagggctcttcaaacttgtttgatataaaatatgcttgtcttttgtttaagcatttatgtttcaaacactaaggagctttttgacatctgttaaacgtctttttgtttattttgttaagtcttatacattcttatagtttctgaagacgaatcataggttaacagcacatgagcaacagtgccacttagtctatgcctcttaatttggggggtgggaagggaaagatgggtacttgccacatagtgtatcctttatgtaactggcactttctctctatataactcgatttgcactttgtgtatacttgactatccctgagtactttcaggaagactgacttaaatatatccggggtgagtaagatagatagggtataagactctgaactttatcatctgcagaggcaagagaaaactattttgacattgtgacttcgacctgtggaagatt

SEQ ID NO: 608230 - DNA, 543 bp, Homo sapiens
  misc_feature (367)..(367): n is a, c, g, or t
  misc_feature (381)..(381): n is a, c, g, or t
atctatttaaagattgcaatatataatcatttttaaagtatttgtttaacctgatgggttttccagaaatgaaaacaagtcagttctaaaaccaaagctgatatttagaaaatgtgaaaatgtaaatcagccctatccataatatagtttctctaagactttatcttaaagagtcattttaaaagaatataactattcataagtgtaactgctatcttaatgttttgaaataagttaaaacactttaaaatatgaatactgtagtttgaaagaaagaaactgggggaaggaaaagtagagaaagaaatgccaattccaaagtttttgggggggggggccccccccccaaaaagaagaggggggggcncccctttttttttnaatttttttttttgggccaagttttcttagaatgacttttaccagtttatgaattcttgtaaacagaatgtataatagaaatactgaaacactgttgcctaaagtggcattgttgactgctactgtgatgctactgtaatgtaataaattattaaatggtaa

SEQ ID NO: 608231 - DNA, 796 bp, Homo sapiens
gagcgggcccactgccaccggccgcgggactggctgggactggctcggccgagggcactgctcctcggtgcattgctgctcgggcgccgcagcccgcagccgccagcctccaccggccgtgcccctcccccgtggagccggctgtccgtcggcgcccactgcctggcggcagcggcggagccaggcagccccgcggcggccgagcgcgctcgcgcatcgggccctctggccttctttacctagggcagcccgcgccccggtgcgagggagcggtccttaccgagacccgcccggcccggcggtgcgatgagcttcttcggcttcgggcagagcgtggaggtggaaatcctcctgtaacgatgccagaagtatggaagcgcggccgcagcacaagacaggagagacggcgaacatactgacgaagactactttcctccttcttactaacgagcggaggacgagctgcgtcctccgagagagatggtgacgtcgcttgctcctcaaagaaccccaaacaagggcggctggagccaccagggccatcaagatcgagttcatcgaggccagaatcgaactctacttacgatcgcgggaaaccaccatgagtttgtgtccctggtgaaaggaccttggcccggcctggagagatcacccagtcgcaggccttcgactttgagttttacccacgtggagaaagccgtattgaggtcctacacaggggcagactgtgaagctcacgcttatttccttcgtgctaccatcagccgcccgctcaatgatgtcgtcaacgagatgg

SEQ ID NO: 608232 - DNA, 412 bp, Homo sapiens
cagccctctacagtaaatggccccaatttcccaaacatatgtaactcctgccatttcctgcagggccccaatagcatcaacagaatacttactatttcctgaacacaactgagctctggcttatgtttgtttgttcatttttgctttggtttttgcatcttggcgattatatttattggaagagttgtaggaaaaagcgccatttagctcaagacgacatgagctatctgcaaaccaattcatttccagagtggaaaaatcctcagaattacttcctaatatctgtatgcacggtcctctttcaaacgcttcgcacactaaacgcggcactctgccgtcccctattccccataccgcacaatttctttgcgtcagccctctttcctgccgggacacccggccctccctctcc

SEQ ID NO: 608233 - DNA, 113 bp, Homo sapiens
gatagccgacaggagctgggctcagtccttcagctacctcggccatctgacactgtccccattggtcgtttctcctaagcgggtctttgtgctctctttgttttgtcttattt

SEQ ID NO: 608234 - DNA, 929 bp, Homo sapiens
ggctgcagtctgtctgagggcggcgaagtggtggctcattaagatgaggcttctgtgcttctcctagtgcggcgtctgcgatggtccggagcgagggcctgggccaatctgggcggcgttgcccagcacagagattagcgatgcagtacgcccacgggggcccgcttgctcaaggtccaagatttgtgtttcccctgagggtaatacggcggggtgttggagggaggtacaatgccggggttaataagcccagggggacccaggatattccggcattgaagggaggaagaaaataacccttcccctcaaacaattatataggacccgctattagcatctattcctgtcagtcttccaaagaagtaagttattaacattaaggggcttacactaaattgtttcggaagggattcttttgtgggtattactttgtgggatttgaaggctttcttaagcattcttggggaggtgggggccaaagaaaaacttaagggttttatggcattgtattgatgggtaaccttcatggagcaaacagtgattggagaaacccagtgtgttattgttcacacagtgtgcattttggagattaatataaagtgattgtaccttggttatggtataaagcgttgaattttggtcacccttcaattccgatgaaacaacttgtccaagattctggacaacgtgaacgtgaaggtcaaatggcctatggcatcaattcccacaccatcgatatagaccactaataggcgtgaaacctttggctttagggacattgcaaccgggttgcattatacgcctgtatgaaacgaaggttgaccagccagagctactgcaggcgtgcctgtgaccatgcaaagtgtcagggggatggattgactgggcaatgtgttcccccaaaccagtgtggctaagaaatggttaga

SEQ ID NO: 608235 - DNA, 634 bp, Homo sapiens
gggccgccttttagagaagcaactcttgtgaaggtccccataaaataatgggggtctattcggggcaccacctttgtgccaaccccggggccccgatcttaagcagatacggttaagaccagacgcttaaaaatggcgcgagccgctttgcagtttttttacgaccatatgttaaattggaaattcatgtcataaaacgatgattggggagaaattttgcatcctccccattatggggtgcttcaagtcaccccctcgtagacactattcgggtctggaacaccctctttcccccaaatgagaatttttctctccgcctgacaatattcccgaggaaaccttttttttttttgagataaaacccccccatcttgcttaaatataggaaatcccccgtttctaccaaatttcttgccccaaattgcgctttctaatatcccttctaagtgcctccttgtgctctcttcaaaacgaggacacaccactttgttttttcaaaggcccgaaaagacacgcactagtgttaactatatagatgcttgcaaagaacgaccacatcaaagccccttgtttacagacagggaaattcttttgatcccgggggggataaaaatctcttcaaacccaacatgca

SEQ ID NO: 608236 - DNA, 627 bp, Homo sapiens
cgatcaagagggccgagcttcaagcacgcagcaatgcagctcagaccgttaagcgtacccacaccccccgggaaccagcagtgattaccctttagcaataaacgaaagtttattaaagctatactaaccccagggttggtcaatttcgtgccaaccaccgcggtcacacgattaacccaagtcaatagaagccggggtaaagagtgttttagttcccccctccccaataaagttaaaactcccctgagttgtaaaaacctccagttgccacaaaatagactacgaaagtggctttaacatatttgaccacccaatagttaagacccaaactgggattagataccccattatgtttagccctaaccctcaccagttaaatcaacaaaactgctcgccagaccactacgagccccagcttaaaactcaaaggacctggcggtgtttcatacccctttaaaggagcctgttttgtaatcgataaaccccgatcaccctccccccctcttgctcagcttatataccgcctttttcaccaaaccctgatgaaggctccaaagtaagcgcaagtacccccgtaaagacgttaggtcaaggtgtagcccatgaggtggcaaaaaatgggctcca

SEQ ID NO: 608237 - DNA, 317 bp, Homo sapiens
aggttgagctcaccagcactgtaactttctttcatgaattcccactgatcacaaaccccacaccaccatctcactgacaccatgttcaaccatgtcttttacttaacaaattccaggaactggccttaggaaatccaagtatcaaaccaaggttgtggagtattccacctcaggaaggaatgctgaacaactgatttacagacttgttgccccagctagaccaccaggtagcccattactcaaggtaaccattacaaccaaatagtgctaacctgcataccctacccctcacatgctttgccaagccccagctgcgg

SEQ ID NO: 608238 - DNA, 878 bp, Homo sapiens
tggaaagggggtttccccccgggtattccccgctactcgggggggtaaaagcagaggaaaattgggtgagaacccggggaggggggagggtgtgggggggaggccagaaatacgcgccactgggcctcccactcctcgggagcaacacaggaggtggaaactccgcggctccaaaacaaaaaaaagaaaaaaagaaaagtttcaagaagattttataataccttttgtgagaaagaggaacaaggtgtggatctcaaacgcggggaaaacaggtgtgttaagagggggataaatctctcgagacactttgaaagagctctctttattcttgtggaaagaggggatatttatccagacaacaatactctctccaaaacagcacgcgcgcgggtgtggggggaggaccacaccagctttgtgacacacgcgggaacatatggggggacgaaaacactacgagatctcgagggagagggcgggggagaacaaggggccccaacgacggtgggggagaggggggcctcaaaaaccgagacacctatagtagaccacacaacctgtgggtggaaaacaaaaacactgtggggcacacgagaggtggttttctcaagaggccacagagcgtgtattttcaccccacggggagaaaataacacattggcgcacacagcttctcaaccaacaaatctcttgtgtgaaccctctgtggcgcaaacaaaagaggggggcgcctcgtgaaaaaaagagagttgcaccaagagactcgccatggtgacccccccaaatggggagggaaagcaacccccgtaaaaaaaaaaaacttccccacaaaaggaggaccacccgacatacggggcatgacaacacaggaaaatgtg

SEQ ID NO: 608239 - DNA, 177 bp, Homo sapiens
ccaatatcgcgccaccgcactccagcccgggcgacagagcgtctccaaaaaaaaaaaaaaaggaaaaaaggaggaattaaaccgggggggttggccacaggggctcacgcgtgtaatcccagcatttggggaggccgaggcagggggatcacccagcttgggcaaggggtaccgagc

SEQ ID NO: 608240 - DNA, 418 bp, Homo sapiens
  misc_feature (13)..(13): n is a, c, g, or t
cccgccccttccncccctgggttgcaacaccccctcccccttcgaccatgctggattttccacaccgtttccctcgagctgaagttagcaggctagcatcacttaattccctggatgaacatggagtgctggcgcagctcattcctgcattactgcctttgctcgccaaccaaagcagcaaatgaccttgggctcaaggacataacttattactatgtcgaaggcttatgccgagcaagaagccgaagccacttgccctcctggaggagacctgcaagctccctgagcggtgggcgggcctcgtccgcaggtctcatcccacactcttgagaagccttggtcactacagtggtcgcacatgttcctcttcctgttcctgttgacatgtcgttgtttaaataaatctcacttgccacca

SEQ ID NO: 608241 - DNA, 580 bp, Homo sapiens
aggatccccgttgctgtcgatgtagatcatatgctggtcatctgtgcactcatcagatcgcggcaaagggtaagttctacaagggtgcaggagaaagcttagcagggaaaaaatatatgctgtagttttagcgttgtgctttgccgtatgaatgaggttatagcattacacaaagaacccctacaaagaaagagctgaggtaattgcctcatgacattagtaaatgatttcagcacataaagggaactggatggcagtaattcaagcagtctaaaagactctgaaaaaggccacaagcactaaaagaaccatagatagctaccaatttagagaatttaaattttctaattcacaagatagaaattagtgtacataattcaataagcaaattttagggtgactgacatcttatcaggtgatttgtgaacaaaagacaaattatttcccatgccaactatttaccatattttccagactatatgatactataaataaagccaaaatatctgacatattttactccttaatcctttttattaaatccctcaaaaagagcagctctagattttcatcagttcag

SEQ ID NO: 608242 - DNA, 935 bp, Homo sapiens
agcctccctgtgcctggcctggccggccggggtgaacatggctgggcgctctgagggtgtgctgctcgtgggtggcgcgggtgtgatgttccgtgttcctggttctttgtgcgtgctgcatcgtgcggctccgtggaagatggcggccctgggcgggtttccagtctgtggctccaagctgtgctgtgctgcctggagctctcagtgcagtggtgctgggctgctgtgctagctttgccttgtgtgccctgtgtgctgtgaactcctggtggcctccttgtgcgaatgtggcccgtgctcctggtgtcaatggtgctttgtacctgctcccctgatgccccgggaggctgtgccttatcctgatgacgcaggtaatgtatgccagtgcagcctgaatgacacctcagggaccttccatgtgggaccccccttggctaatggcgggggaaccccttcagtcctgacctggactggcccagtcaggggatggatcagtcccgcaagagacctgcccctcagcagatccagcagggtccagcagcaggcggtccaaacatcgaaaccacaaatgcaaaagcaaaacagaagatggctgacaaaattctacctcaaaggattcgtgaactggtaccaggaatcccaggcctatatgggatctcttggcttttgaaaggaaactggaccagactatcatgaaggacaacggctaggaatatccaagaggccttgaaaacgtcccatcaaagtccagccttgttccaaatattgatgcccactaaaccaaatgcaggacagtttctcttacctttatttaaggtccttgggtgatttgagctggacaaaagacctgtatgggccacacgaagcaatctggtagcaatggccacaaggaccggcacactagcgcagggagaccgaatggctatcagggtgac

SEQ ID NO: 608243 - DNA, 454 bp, Homo sapiens
caagagtcagagcctcggggaggtggccgccagcatgggccggcactgccgccggatggctggcaaggctgcctagttcccttgcagcagaaatgaacagttctgacttatagtgagcacggccctgtggcccttcctcagtaggcacaactacctctcagccagcccccgccagcctttggtttggggtctgggacgagctgccccatgtcacacgtctatgtgcatgtgcacacacactcaaacatgtacacacacgtgccctccccacctcactagactctccgggagatggggcaggactgggagagcccacgattggtgatttgggtgtgttgggatgaggcggagtgcctgtgggatttgtcccggtcagagcctcagggggctggggtctcagggcactcagcttcccaggcaataacagccgtggggtaataaatggtctctgcac

SEQ ID NO: 608244 - DNA, 128 bp, Homo sapiens
tcagctcggtaccatagctggcgggcacggtggctcacgtctttatggtttatcagtaccagtctcccaaatgaggaaagatggaattatataaccttatcttgattgagtacgctggaatggaattg

SEQ ID NO: 608245 - DNA, 505 bp, Homo sapiens
cggccattatggccggggttttgggatcgggtaaattatgagttgggtttgaatgacttgaatgtccaaccgtctgaacgagctggctatgcgtgtgaatcaattttgaagagacctgttttgcaaagaaaagacaggacacgtgtattcatgtatgtaacgagctctgtaaaatgcagtgctcctgtcggacaattgtgaacaagattaatacctcattctttgtgagcgtattttgctgctttaaagaatgcatgagatttatcaattacaacctaggcaacgaagctactgtctttgtgcagagagtgatacaaggcgtcctggcaaccaatgtcagtaataagcgtattaacgaagaaagcgacatgcttgatacagagcagagagtcaatgttcttgacaaggaaaccaaagagtttgtagtcgatgcaaattgacacctatgaaacagggttttacaacatcccactttatttttgaaaaagtaaccctttataaaaag

SEQ ID NO: 608246 - DNA, 105 bp, Homo sapiens
ctcgcaccggactcggcgtagctgagagcagaagcgtagcacgctgtcagcaggagtaaatctctttgtgggttggaagctctcaggttcctgcagaggaagctc

SEQ ID NO: 608247 - DNA, 910 bp, Homo sapiens
tgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagaagcaaggcaaaaatgagcaaagttgggaaagttgtgttccccgagactacagggatacaacgctactatgataatgaaataccaaagtaattcttgaaaggctggttgaaccaccagaaaggagttattgggggaatcatgaatgattgactgtaacaggggcttgcagggtgctgatgccagaaagctttctgtgccatggattaaggacttctgtccattgtgtccaggttcaagaccctgtgggtttggttcatacatttgtatggtttcataagaaaacagactgtgttacaaaaaacaaaaaagaaatgtgcggggcggccggaaattaaacactgtgggcggccagataatggagtcacaacacgagggtggtcacaaaaaggcggggaacagtgtgtac

SEQ ID NO: 608248 - DNA, 891 bp, Homo sapiens
  misc_feature (89)..(89): n is a, c, g, or t
ggtcttcctccctccctcccttcctcttactctcattcatttcatacacactggctcacacatctactctctctctctatctctctcanaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcacgatgtagcttaccgccaggaaaaggatgaaaacaaatggacggcatgtgaatttatccagcacaaagctgacactcctgcagagaaagctccaaccggcagcaatgtatgagattcaaagttcgatccatccctgatcactattttaaaggcttctggagtgaatggagtccaagttattacttcagaactccagagatcaataatagctcaggggagatggatcctatcttactaatcatcagcattttgagtttttcctctgtcgctctgttggtcatcttgggcctgtgtgttttgcgacccg

SEQ ID NO: 608249 - DNA, 479 bp, Homo sapiens
ccatacatctactaagagtaaagccattcctggatccagtcttctgactccaaacctttctactaggatgtggcacctttcttggtgatagtacagtgtgatttgagagtacagtgggctagcttctctgaagcttttaggagcctgcttactttcctggatctggaagtacaaatggtttctttctatagaatgatttgctccctgaccctatccccccttcaaaaataaaattcacttctcttccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtaagtaacagctagtccttgcacatgggtgaaggcaggccaaagggctacaaagtttggaagaagcaaagtgaggaaaaag

SEQ ID NO: 608250 - DNA, 410 bp, Homo sapiens
tcactcacaaggccacaccccactgcaagagaggctggagaatgcggactggatttaaacccaagaagaagaaatggttttctgaatagttggccatttactgacacaaaaagggtcaaagtgacttgcagaggagatgaattttaaatactataattatttccttggctgccctttagacagaatttatttctttttcttttccagttaaacctgaggctccttttgacctgagtgtcatctatcgggaaggagccaatgactttgtggtgacatttaatacatcacacttgcaaaagaagtatgtaaaagttttaatgcacgatgtagcttaccgccaggaaaaggatgaaaacaaatggacggtatgtagttcaactacattaataaaataaaaacttatgaatgct

SEQ ID NO: 608251 - DNA, 1521 bp, Homo sapiens
  misc_feature (372)..(372): n is a, c, g, or t
  misc_feature (863)..(863): n is a, c, g, or t
  misc_feature (1509)..(1509): n is a, c, g, or t
tgtgagtccggtgggtcctgggcccacgtaaccggcccggagccgtggactgccctacagacgtgagcaatgggacccaaggggtgtcgagcgcggcgctaaggcctcctagtgaccgcctgcccagcctcacgcattccgtacggcatacatagtagagcatttctgcagtgacggtccggcgcttcctgcgtagcttcgccgctttcctcgatgccactggaggctgggtgagtacgagtgtgagacaggttcggtgcctgcagcgacagtagtccccaaacgccgggggttttcagacactcggagagaacgcccttgcctgggctgctggatgtgcatcacggaccgtttgacctggtaatcccctangcgacgttttgtggtagtgccctgcgtggatggcagtgcgtgttggctggaggtcgcgagcggagacagtgcactcatagcgaagcttgctgtgcgcaaggtgtcacgcatacccgcgatcctgtagggctttcaaatccaactttcgtttagcaacacccacgcggagtatgtctccccgtcctgttgaacacacatcttaacgggaagagagatgtatgaaacccacgagtgtgtttgtcgtgtggtagcggcaaacaccatctgcccactattggtttgggtctcaaccccaggcgaggatcatcgtaccgtgtgaggagaagcccctgtttaattacgagatatagacgccgccaagaaaaccacttgcgggatcatgcgtgatacacttcctctcagaggggaaaaagcggcgccagcggaaccacacatgtcgttctttcccgcaaagtgtgtttccaagatcccccggcgaattgagaatatgngcggagcacaggccacggacaccaggtggactcaattcctaccccccagtaggaggcgtctctgttaacaccgaggcagtttatgttgtttccgcttccccccgtctcttttgttttgtgtctccccccaggatttgggaccactaaaatactagtacaccacccagggggacatatccatattacaggcggcgcgcagttaactcggggggcggtccaacataactaaggaggtggaagggtcctcctaccagcgggccatagtggtttcaagggcatctgtaataatccaaacggagcaatttatgtttggaggaaagaaggtgcactgtaagtagaggaagtaacgttagagaagagaagggttcttccagttcagccagtttgagcgagcagcaccccttttttgggggccaccaaccaccacctactttttgcgaagaaacaataaaaaaccaccgccacgcaagagagttttacttactactactcgctgtgggcgaagcaaaaaacttcttatctacccagaaagtaaaagaaatcacagagccagtacggttacttatcgcaccacctaggagcgagaacaaacacttgttgttggttgtgacgagcacccactagtgtataccactcagttgagttntacaaacacccc

SEQ ID NO: 608252 - DNA, 862 bp, Homo sapiens
tgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagagtgatccaagaacaggacctgttactttccatccattgtcatttcatagaccccttgaagcaacccagtggttggtagcagcaatccttgtgcagatgaggactctgaagctcagaaatgttgtataacttgtttaatacaaagcccacgctctttgtattccatcagaccatatcctgtagatacatatacattgctagggaagtacactatggcaactgagacacccctcacaaggtggtatcgtttataagaaatagcattatgtatttgtcatcattgcttggttgagtgtccaacacagaaataaaaataaacgggtggcctcgttggcctcagcggtggagctctgcggccg

SEQ ID NO: 608253 - DNA, 672 bp, Homo sapiens
  misc_feature (89)..(89): n is a, c, g, or t
ggtcttcctccctccctcccttcctcttactctcattcatttcatacacactggctcacacatctactctctctctctatctctctcanaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcacgatgtagcttaccgccaggaaaaggatgaaaacaaatggacggtatgtagttcaactacattaataaaataaaaacttatgaatgct

SEQ ID NO: 608254 - DNA, 850 bp, Homo sapiens
gtgtcagcctacatcgcatctcgggtgaattaaagagacttttgtgctcacactatagccttgtacaattgtctcttcctttaagtgtgctccgcataaattggttggcgacaagcccgcgatagggggagctcctctgagcaggagctctcctactatgctctaggttacccatcgtcttgcaacatgtacagtagacttcgcatagctgctcatggatctcagaccgagttccggagcaactccgagcgtctgtctatggatatggtgtcactaatagggaaagagacttgcccggcgacagcgcattttcagaaccttacagtatgcttgccttcccgccatagtcacaaaacccccgagttgcaactgtcctaccttgcaagacacttcaaggggcactcttaagcgccaaacattccaagagccccttctgtgaacctttggctttcacagccgaatgaaaaaccctgggccatctggggcccaagggcaattgccattgagccctgggggattttccctcctaaagggccctttggcccacagctttggtagcgggggccccctccactggggacaggctccttgactgggcccgaacattctttcaattcaggccaacttccggggagagcttccatggggagctcctcaaaagaccccaaaaaaggatcccccagacgagacttcgtttccccaaggatttctcccctcggcaatttgggtcggcgtcttgaaagaacctggaccatcttcgccccagaaagacgatcttcgggaaggacccccctttagagaacatatccggcgatattcgccacagcccgttcaggggaggaaaaccctc

SEQ ID NO: 608255 - DNA, 807 bp, Homo sapiens
  misc_feature (88)..(88): n is a, c, g, or t
  misc_feature (117)..(117): n is a, c, g, or t
atgatgctggcctcataaaatgcgttagggaggattccgtcttttctattgattggaatagtttcagaaggaatggcaccagctcctnctttggtaccctctggtagaatttggctntgtgaattccggtcgttggtcctggactttttatggttaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagagtgatccaagaacaggacctgttactttccatccattgtcatttcatagaccccttgaagcaacccagtggttggtagcagcaatccttgtgcagatgaggactctgaagctcagaaatgttgtataacttgtttaatacaaagcccacgctctttgtattccatcagaccatatcctgtagatacatatacattgctagggaagtacactatggcaactgagacacccctcacaaggtggtatcgtttataagaaatagcattatgtatttgtcatcattgcttggttgagtgtccaacacagaaataaaaataaacgggtggcctcgttggcctcagcggtggagctctgcggccg

SEQ ID NO: 608256 - DNA, 702 bp, Homo sapiens
taagccggtctgaaaagcgcaatattcgggtgggagtgacccgattttccaggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagagtgatccaagaacaggacctgttactttccatccattgtcatttcatagaccccttgaagcaacccagtggttggtagcagcaatccttgtgcagatgaggactctgaagctcagaaatgttgtataacttgtttaatacaaagcccacgctctttgtattccatcagaccatatcctgtagatacatatacattgctagggaagtacactatggcaactgagacacccctcacaaggtggtatcgtttataagaaatagcattatgtatttgtcatcattgcttggttgagtgtccaacacagaaataaaaataaacgggtggcctcgttggcctcagcggtggagctctgcggccg

SEQ ID NO: 608257 - DNA, 372 bp, Homo sapiens
ctgtaactcactgcttcaaaaggtgcggttgtgcctgtagtgatttctgggtgaagaagagcaagcgaagtagaaatacgcgtcgcttagcaaagagacgcggaggatgtggtcctgcgaattaaaaagccatcaacgaagattcgctttaatttgcaggacatttcctagagactctctaccctattgcgccataccgtttgggtcactagcctcctgacttcgctgctcatcagcgatcgggtttagcgatccgggtttcaggcgtgacactgcccccaacagtatcagctggctctcgtcagcttttagcgttttatggcggctgtgtgcgggagactttcgagtctacccgggatgcgctctggcccg

SEQ ID NO: 608258 - DNA, 846 bp, Homo sapiens
tgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaccatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggcatgcctgtggtcctgtcgcaagaggtggagtccgttcttgtgggtgctgctgttctgggtgcctgtgcctcaggggatttcgcttctgtacagagtgatccaagaacaggacctgttactttccatccattgtcatttcatagaccccttgaagcaacccagtggttggtagcagcaatccttgtgcagatgaggactctgaagctcagaaatgttgtataacttgtttaatacaaagcccacgctctttgtattccatcagaccatatcctgtagatacatatacattgctagggaagtacactatggcaactgagacacccctcacaaggtggtatcgtttataagaaatagcattatgtatttgtcatcattgcttggttgagtgtccaacacagaaataaaaataaacgggtggcctcgttggcctcagcggtggagctctgcggccg

SEQ ID NO: 608259 - DNA, 816 bp, Homo sapiens
tgatagaccacatggtacaaggccatgctgcttttccagaactacaagtaaaggccacagccagatgccagagtatatatgcatatttgaacagtcacctggatctgattaagaaggctcagcctgtgggtttccttactgttgatttacatgtttggccagatttccatggcaaccggtctcccttagcagatctgacactaaagggcatggtcaccggattgaaactgtctcaggaccttgatgatcttgccattctctacctggccacagttcaagccattgctttggggactcgcttcattatagaagccatggaggcagcagggcactcaatcagtactcttttcctatgtggaggcctcagcaagaatcccctttttgtgcaaatgcatgcggacattactggaagcaaggcaaaaatgagcaaagttgggaaagttgtgttccccgagactacagggatacaacgctactatgataatgaaataccaaagtaattcttgaaaggctggttgaaccaccagaaaggagttattgggggaatcatgaatgattgactgtaacaggggcttgcagggtgctgatgccagaaagctttctgtgccatggattaaggacttctgtccattgtgtccaggttcaagaccctgtgggtttggttcatacatttgtatggtttcataagaaaacagactgtgttacaaaaaacaaaaaagaaatgtgcggggcggccggaaattaaacactgtgggcggccagataatggagtcacaacacgagggtggtcacaaaaaggcggggaacagtgtgtac

SEQ ID NO: 608260 - DNA, 189 bp, Homo sapiens
tggtagagactaggtctcactatgttgcccatgctggtctcgaactgctgcacttaagtgatcctccaccatgagtctcctaaagtgctgggattacaattaccatgcccagcccttagaatattttaaagcagtctactggcctggagaataagccacatccgctgtcttaaaagaaatactgtatct

SEQ ID NO: 608261 - DNA, 106 bp, Homo sapiens
cacgcccattccacaacctacagatgtcctttgtccttttggctccttctttgccttccaccatgattctgagcgcctctccagccattgtggacatggagcgtga

SEQ ID NO: 608262 - DNA, 373 bp, Homo sapiens
agcagagcagctaaaaactctggtctccagagcactcgtctcctttggaggggttattaggttgggagaaatgtagatacttatgtattgtgtgtgtgtgtgtgtgtgtgtgtgtgtgtgtgtgtgtgtgtttaaatatctgtgacccaggctattactcctgctagagcaagagggagagctaagtgaaatccgactcattatctctgggtttctcataaatattccccccatatattctagaagcaagggatatgtaatagataaacaagaagaaatgtgcattaaaacccttaggggggccgagtgcagtggctcacgcgtgttaccccagtactgggggagcctgggcgagagaacaagactctgtctc

SEQ ID NO: 608263 - DNA, 368 bp, Homo sapiens
tacacaatcacgtgtagacatattgtatgcatacattcatatacatgcatccatatatatacacctctttacacattcgtatacatacgttcacacacacgtccatacatgtctacatacagacacatccatgtatacacacattcatacatctgtatgcacccacatgtctgtgtacatacacgtctgtatacacacacccctgtatacacacacatccatgtacagatacatctgtacacacatccacacacattcatacacacacatccgcacacacatctgtggggatcggggacagagagcattaagtagtggcagtgtggtaatagtgagtcttgttttggcgtcttttgtgtaaactgatt

SEQ ID NO: 608264 - DNA, 255 bp, Homo sapiens
  misc_feature (37)..(38): n is a, c, g, or t
  misc_feature (40)..(40): n is a, c, g, or t
  misc_feature (128)..(128): n is a, c, g, or t
  misc_feature (162)..(162): n is a, c, g, or t
agagcaggggctcagggagccagagcctagagccacnncncttccctgggattggcacccacctcctcagaaccatccaagccccaggtcaggggtggcagcagggaacacgagtgttttccatctgncatcacccgtctccctctttttgcctgcggtggnctcatggtcccattgttccttggagcccaccaggaaatgcttgggccaacttaaaagggaaagtgccaaaggaaaccacctaaatagcaaacc

SEQ ID NO: 608265 - DNA, 179 bp, Homo sapiens
ttaaggcatggtatgatgccgatgggtcggtaatgtgagtggatagtggattggcatcccttgctgaggatctgtgacggtgctgcgggcgacaggaagccccgtagcccaggacctcaagcgtgggcacaagggtctcggccagtagtgcactcggtgctcatgggactcctcaggga

SEQ ID NO: 608266 - DNA, 263 bp, Homo sapiens
ctcggtacccatccttccctctttcacgcaccacacatagacacaaacacaccacacacacacaccaacacaccacacacacccccgacacacactatacccacacaggacacacacacctcacacatcgcacacacataccacacacactacatacacatgcacgcacatgcacacacaccacataccacacaccacacacactacacatcacacacaccacacacaccacacacatcacaccaccgtgaagagggaaggat

SEQ ID NO: 608267 - DNA, 636 bp, Homo sapiens
tcccatctactcgggaggctgaggcgacgagaatggcgtgaacgctgggaggcagagcttgcagtgagccgagatggtgtcactgcactccagcctgtgagacatgagcgagactccgtttcaaagaaagagaaacgaccccacctctacaaaaaaatttaaaacattagccaggtgtggtggtgcacacctatagtcccagctacttgagaggctaaagtggcatgatcacctgagcctagggaggtggaggctgcagtggagccatgatggcgccagtgcgactctagcctgggcaagagagtgagacctcatctcaaaagaagagatagattaattacttagagaactgcgcagcgcaagagttcttaacctgtcaatccggagaagcccttgacagaatctatagataggcttcaggggattgaactaaaatggtgtgtacaacatggtgtttcgggtatcttccttggaaaaatcctgagtatgactttattgaattctcaaaggagcgaaagacccaaaagagtgtacgaactatcaccgatttggcaggaatagttggcacatgcctgtaatcccagtgacttggggagcccagcgagaaggatcactagaagtcagcgtcaagacgag

SEQ ID NO: 608268 - DNA, 953 bp, Homo sapiens
ggccgggcgcggtggctcacgcctgtaatcccagctctcagggaggctaagaggcgggaggatagcttgagcccaggagttcgagacctgcctgggcaatatagcgaaccccgttctccagaaaaagaaaaaaaaaaaaaacaaagacacaaacaaaaaatatagcgcgttatttccgggaaccccttaaaaaacccccttcttaattaattaaattaaccgtgaatttcttaacccttcaaatatcctgggcaagagcccagcgcccaattttatccggtgtgaaaccattttcaggaaaaaaatttctaactttctttaaataattaaaatctccttaaaaatatctcctttaattataactttcacggggccacaggaacttaactcatattttaattttcttctcttctcggaaaccaaatttatccccaacctttggggttatcatcacccggagggggcacccagccagaagagcttgaaggcagggcacattatttccttatttttatacccttagttaggctcctttccccttaatcaattggcactggttttaaacacttcacaaaacccctaggtctcattaaaacattctattagtcactccctcagtggcccaagactattaaattctgtgaggccaccaccttattatggcctaggtccaccacatgccttttattggaaaggatacctttaacggaccagttatgaatccttaaggccatggtgaggccccatcgtgggtaatagacactgcgggagactttcacaagggcgtggagataaaggccaacgtattaaaccggaaaaaatggaccctcttgtgatccataagggagattaaggcgccgcgtgcaagccaagcgtggtgcttcaagcgggggactacacccgcaggggggtacgacagaatctacaaacacacagcccccgcacggcagtag

SEQ ID NO: 608269 - DNA, 345 bp, Homo sapiens
  misc_feature (333)..(333): n is a, c, g, or t
  misc_feature (342)..(342): n is a, c, g, or t
aacaactgtttatatgcattcttaaggcttgaattaacaagtctcatcacatcatccacattgtttagtggctaagataatggactgtggcatctgtctgatgtgagtctgaatgccaactttgccatttactttgtgaccttgagaaaagtatttaacacataaagattatatgaggattcagtgagataacatgccatgtgtggccattctgttaatacttattgctgctattaccgttagtttattgggatgttgctgacaatactggaaatctgttgacaggcaaaccctcctgctacaaacatcaggcactctcctgcccccggagcngccgggggnggg

SEQ ID NO: 608270 - DNA, 930 bp, Homo sapiens
tttcagtggtgtactgcattccggggtgcccaggtttcggcccaccaagtggtgtgtgcccgcccgagccgcttggtgtggctccgcccgctgtgacccagaaagttccccgcgggccaggcctaatgcggccgcgttgatcatggcccccgttttgctgtggcgcccggggcgattctgattcgcacacggcgtgttctctcaacagccgggttcacgggcgacatagtcacaaccgttgtcgacgcgccgctttttccaatctgcgagtgacgtctgtccgccgcgcatatacgcgggtgctcctctgacaagaggttctttctcaccccgcaaacacgtcatatgatgaccgagcccccaccaaggcgtgtatcccccgcagccaaccttcgcggagtggcgaacccagggaaagggataggggaacgacttctccaaaattttggccatcgccaccctatatccctgcctggggcattggcggaataaatttaaaatcccccccaccaaggggctccgggctgtattaggagcaaagatcataagaagacacgactcaccaccaatcagttttgggggtccactcctcttccactccgtatataggcttcgtggcaaccccccgagtctgagaacttccccccactttcaaaaaccatgaggggctcttgctcggcgtactacaaccgaatgtgatattgcgaacacccccccgattcgcctagagttttgctggggcaccaactgaggagcacccaccccgtttggaccttccgcggttaatagcacccgccccctccttgtcggggccgccgacacaacctctcggcatactcccggcggggtgtggagcccccaccacacataactggtgctgtccccctctaacaaaaccccgaagcggggggattctttcaaaacaaaaca

SEQ ID NO: 608271 - DNA, 217 bp, Homo sapiens
gaaaggggcagaacagaaaaaagagacgaccaaactcatagcatcatgcaaagtaaacagcataacagaagtaaaataagaaggcaacgctagaaggaaagtacagagcatataggcggcgcacgccacattacgattcgcctgctagcttctcctgtacagtcgtttctttggaaggcagtggattattctcttgcatctcgtctcttctcttgta

SEQ ID NO: 608272 - DNA, 152 bp, Homo sapiens
gtcattttaccgacataaaacatggagccaaaaaaaacaataatgggactaataaaaactcctagggtttcctgtcagatttaattttacccagtggcaaaaaattttttcaattggggctttaaaaaaataattaaaaaaacatgtatata

SEQ ID NO: 608273 - DNA, 607 bp, Homo sapiens
atagataacgggctatgctgaaattaccattggatgactgtcctctatggcagtgatctcatggctcacttgcaggagatgctaaacacggtcaccaaccagcccgctcaatgcacaaaaactagaatctgaagactatgtgtcccaagctttgcttgaggctgtccgcgaggacaagcctcatgtcaaaccctatttctctaagaccattcgcgatttaaaaggagtggacggaagtgctgctagatttgactgctagattgaaggatacccagaccccgaggctgactggctcagagatgaccagccaatcaaggagttccgccacttacacatatactacgatgaggaccggaactgctctttaattattagagatgaccgcggcgatgacgatcccaagtacacctgcaaggctggaaacagtctaggagaagccactctgcacagcatagctcattgtggaaacgatggaagaacgtgaatgtgaaggggaagaggaagaagagtgaatcgcctccatagaacagcagtttctaagtcatattaaaatgactatttctctaaaactcaaaataaaacaaaaaaacggcctcgctggcctcaa

SEQ ID NO: 608274 - DNA, 198 bp, Homo sapiens
aacctggcacccactaatctactgtcttggtagactgctactcgggacatttcatataaacagaattacacagtatgtggcctgtggtgtctgatttctttcgttcagtgtaatgtttccaagactcatccatgtagcatatatcagtaccctgttcctttttatggccaaataatatttcagtgttggggataacat

SEQ ID NO: 608275 - DNA, 485 bp, Homo sapiens
  misc_feature (429)..(429): n is a, c, g, or t
tattagaaaagtaaggctccacagtagcctgatacatagaaaacctggtatagcagaagcagtttctggtgggcactgctgctctgactacaaacagagctcctgagatgttagagaaaaggaagtttacttttcttattttcagtgtaactgtatcctctagcagaatcagagtaagtcaagaatacttgggaagtacagattttgaccccaaggatggatggatatataaaacatttctaacaaagaagaagggagctaagagatgacagatattaatacttgtttctattttagcttaccaaaggtttgttcatttaatcaaatcacacaatacaaggcatatagaaataactttaattaaaaaaactatgtagaaggttataatatcagtcatgacaaagatttgaatttatttgctgggacaancttgtatttttctggcttttgttctttttctttaaaaataaatgtacagtaaaact

SEQ ID NO: 608276 - DNA, 1102 bp, Homo sapiens
ttgcctagtgtggcggctctcgtgggtcgcttggttcagatgctctgtcctccgttctcggggtgcggcttctcctggccgtattttgtatcatctctagtcgtatgtgtcctttgccttgcctctgctattgcgtgtgggcgttcagtctgcttatctgcttcagtgtgagttttcccccaatggtggctggttctccctgtgcagtcttcggctccgaatcctgtgtttggagttgcgtatattagtcttattgtagttaccttggagatacttctatgatgtttgtctctgggagggtctgtaatgccttatctttactgagatatggtgtccattgccattgaagtcaaatggtattctcaggcctctcagaagtagaactgaaatgatactcagcctgtgacgtgcaaactgcgatatctgatatcgaccgtgtgtgcattcacgcgagctatctctagatgtgaggagtgtgcccgacagttgtttgctttttgtgaaagtgtggttttgcgccctatcctcttctccatcagtagtttccttaattctgagacagtgaacgcatcgcacttagctaatcagcgtataaatccttgagtcatgtaagcagccgccctgtgcatatgatgtggatcaaacacggttctgtttatttcattgtgtttgccatgttacgtatgcgctcaagccctaggttgtgcatttgtggccgcagacgatggggccagtgctcacttcgctaccgctcaggagctgaaacttgcttcagcctgaaaagggttgggatgcagttgttcagtataaagggcattatttgctattcattgttactttccgtgcaaaagttttcgttcaaagcaacgaagtcactaggagcagcagcagaagcaaccgcaaaggctgtgttccctggagaaagcgtcatttcgttatcctaaagtatggaaaacacaagttcacaaagctggaaggtagcttatttatctatctaccgtggggagcatgtaacagagctctgtgtatacacagcttcacacccacctagattgttactaacagtgggttgggttttatacattacgtaattttgagagaa

SEQ ID NO: 608277 - DNA, 245 bp, Homo sapiens
aacatctaaaatacactgcgtacacgtgtgcgtgcacaacaacacacacacacacacacacacagctcttcatttatcctgcgccatgcagatttactctcattgtggaatctgtccccttcacacactgtatatgcacagagcacaagagaggctatctctagtcacttcaccagcgaggcttagactccgtattagaggccaccgtttcatacacagtgttgctaagccctcactattctgtt

SEQ ID NO: 608278 - DNA, 216 bp, Homo sapiens
taggaagtgcactgataatgtatttcttattacagtgtactatgggggtgggagatatgcgaaagaaatgtgtatttttgctagattgcctaccttctagagatagataagcacaatacttgcattggatccaataaccccagttaggtcatcatagattagtatttaagtttgctggtacattgtgtgtgttgtgtgctaagataaaagatccat

SEQ ID NO: 608279 - DNA, 595 bp, Homo sapiens
aggtgtaactccacagcgacaagttgtacagactccaaacacagttctctctactccattcaggactccttctaatggagctgaagggctgactccccggagtggaacaactcccaaaccagttattaactctactccgggtagaactcctcttcgagacaagttaaacattaatcccgaggatggaatggcagactatagtgatccctcttacgtgaagcagatggaaagagaatcccgagaacatctccgtttagggttggtgggccttcctgcccctaagaactgatttcggaaactggttctaccagaaaatggccgagaaggacgctgggaagaacgtgaacctagatgactacttacattttggcaacgatggctggcttgatggtggaatgctcgaaaagcaggccatacgagatgcagagcgtgtaccaggcacaatggaaacggaatgccataaagctggtccagaaaagatctgccaaggacccatcagaagtaaatggaaacctattctaaagaccctgtaaatgttagaaccggcctttaacagattttacagcaaaagtggaagaacttaatcacaaaaaga

SEQ ID NO: 608280 - DNA, 551 bp, Homo sapiens
caggctctctaccttgtgacatcatttctgggatgctgaggacagacacagggctggaggggggtgggccctgttgatggcaggaccctccctgggactaccccatgtccccacagggtgaacgtgggctgcgggccagccgaggagcgggtgctgctgaccggcctccatgctgtcgccgacatccactgcgagaacggcaagaccagttggggctggaaatatgtgagtcacccacctctgaccccaggctagccttggacctgaccttccaacacctcctccggacaagcggtcaccctatagcctttcagatggcataggccgagctcacacaagtcagcatccctgaccacattctctttatctggcacctggcggggggtgtagaacttttctctaaacccatcccttctctcccaggcgctgggatccccataagagagttaggatataatcagagtcaccatttagggaaggtttatgtgccttgcagggtggtgtgccgggggtctattatctcattcaatcattgcagggatcctctaggt

SEQ ID NO: 608281 - DNA, 393 bp, Homo sapiens
atcagattattaagggaataagccatgacgtcactagcagcccacggcatcacttcaagagtagagtggcttggtgaagatcttttaaaaaggcagtaggcccggtgtggtggctcacgcctattatcccagtcactttgggaggttgaagtgggtggatcaccagaggtcaggaggttcgagaccagcccagccaacatggcagaaccccatctttactaaagaatccacaatgacgcctaggcatggtggcacacgccgtgtatcccagctacacctgaggctgaggcaggataattgcttgaaccggggagacggaggttgcagtgagccgagtttgggccactgcactctagcctggcaacagagcaagactccgtctcaaaaaatggg

SEQ ID NO: 608282 - DNA, 222 bp, Homo sapiens
ctagttttcatgaaacctatacttgtcgggctgaaattttaacatgctaaatgttttaactagtcttaaagcaagtacgattgctgcttcaaaaacttttctttattcattaatcatttaatgtgtacccaaccccttcaaacacatccgtggtttataatgttacctgttttaaaatgattctaaaagggcttcctgttaaataaaataaaatccccctca

SEQ ID NO: 608283 - DNA, 183 bp, Homo sapiens
tctggctgtgctccccagtgacccccacgtgaggccgggtgtgactgcagctgcgtctactttttgtagttgccaaacgtggatggtcaggcggtcatgtgccgcattcggaaagtgggctggctgcaccgtccacagtagggcacgggagttgtcgaatgcggctgatgccgttgtagtagg

SEQ ID NO: 608284 - DNA, 155 bp, Homo sapiens
acactattattgtaaaagctgcattttacttctacggaactgggctgtcgtaaataactgaagtcattcaacaactactgactccctattaattgcaaggcaactatacatgctgatgtttgaagtccaaagaagcacagggaggttattggcat

SEQ ID NO: 608285 - DNA, 210 bp, Homo sapiens
cacgcctccaggtctgaagtgctgctgcagcacgggttctcatgctgtcacttctgtatgtgagcgaagtttcacgatagcttcatcttgccacctgctctggagttgccatgattttttcagtaaagggcatctcctttatcatcagcaagggtaaaagacagctggagcctggaggagtccctgaattttctggtcatccaactcttc

SEQ ID NO: 608286 - DNA, 1497 bp, Homo sapiens
tagtcatggctgcgtagctgttcatccagtgtaatcagacgcagagtatgatcatagtccttcctggtcctgtctggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 608287 - DNA, 1334 bp, Homo sapiens
cactttggcgaggcagtctccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 608288 - DNA, 506 bp, Homo sapiens
ggtgctctaccggatctacagctactcaggaggcagccctctaggagtagcccagatttctggcttgggtggctgtgaggaaaggagtagccttttctttttttcttcttctttttttttggatggagttttcttgtggcccacactgaagtgcaatggtgtggtcttggctcactgcaatttctgcctcccgggttcaagcgatcctcctgcctcagcctcccaaggagctgggattacaggtgcctgccaccatgcccggctaatttttggtattttaagtagagacagggtttcaccatgttggccaggctggtctcaaactcctgacctcaggtgatccgcctgcctcggcctcctgagtagctgggattacaggagcccaccaccacgtctggctaatttttggtattttaagtagagatggggtttcactatgtgggcaggctggtctcaaactcctgacctcaggtgatccgccctcctcagcctcctgagtagctggg

SEQ ID NO: 608289 - DNA, 505 bp, Homo sapiens
gaaacaatatatgacgcattctcccttgaactctacacaatatatttgtcaaactgatgagcctacttctaacctcccttgtgtctgtatgtaattggatagcagacataccccgctcggattccgtcttagagattgaaactgcagtactatccttcacttagtgaacatagagacgttgccctagcgcgactgcacgccgtaggcatatgattatatatggatatggtcgtccgatagcccgatttgacaatctccaggcatggcccccgctcaatgactggcaacactaaacgatacaccccacataacaaagcaagacaagaaaagagacacacctgtctgtgtgggcgccgggcacgtcctgggccaagcaagcaaaagagtactccttgccagaggcagcccaaattggaatgtgtgcggctacgtgcctgagccccccccaggagggcacgcggccagcaggagtgccaagaaaaccaggggaccctcaaccgggaca

SEQ ID NO: 608290 - DNA, 3215 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtgaaaaaaaaaaaaaaaaaaaaatcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 608291 - DNA, 1166 bp, Homo sapiens
  misc_feature (525)..(525): n is a, c, g, or t
agcggaatcgtgagaaggaccggttccctccgtgctgcttcctccccgttgcagctgctgggtgtgcgtgtgcgagtgtgagtgcaagtgcgcgcgcgcacagggtgcggagtgtgtgtgagtgtgagcgtgtgtctgtgtgtgcgtgcgcgtgccgccctgcctctgcccgctccccgggcgcggacgccgcgggattctcatggggcgattgcaggcgatataccacaccacgccagatgcgatctggcgggcagcgcgtcgcgacagctggcgaagggagactcgctctatatcccgaatttcctcgtgaacgcacttggcggcggtcgcttgacgccgtaacttgcgtcagagaggggacgatggccgtatacgatggactgagtcgaagatccccagcgttacaggactgttgaaaaagcctcgaccctgggacgccaaccttggcacgcggaattagtaaccctggcagcgcacgaagatggtcatatccgtactagaaaccggtcgtattctcccctntaagacggcgaccaacgaaatcgcgcgatgatatacgcaatatcaatccaaacggtcgatctgaggacattagttagtagtagacaggcaccgaggcaacccaatcgtcttgtgacacgcggaagtccttcgtgaaaaaatccagcgcctgtggagccagtgattggcctgttttcacattcatggtcccgggctcgttgtcgtgggccaggcccagtgccgaatgtccgagaaaagcctggcagcgggaaccttcgccctgttccaactcaggcccccggctgtgaagagggaaaaacccttcctagttcaaagcggcgccctacccctagggaaacagtcgccctcccttttacaacacccacttggcacattccttaaccaaaaagatgggggctataaacacccacaataattttcccttttgtctccaataaaatatcgcgtaggcctatgtggccattaccaaccttgtggggggcccacattagagggcaaaggccatggcacaacaataggggcccattcccaaggaaagatcccatgggtttccgcccaaaaaaaggtccgacattaacggtagagatacacatggggctcccaagcgaacattcttggagggggtcacatcccctttataa

SEQ ID NO: 608292 - DNA, 3112 bp, Homo sapiens
  misc_feature (2673)..(2673): n is a, c, g, or t
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaactcagnctccttgtcttcaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 608293 - DNA, 420 bp, Homo sapiens
  misc_feature (14)..(14): n is a, c, g, or t
  misc_feature (42)..(42): n is a, c, g, or t
tccaaataagtaanttttaataaaactaattaaattacgttnatcctaattttccttttcctttccctatttgcaaaattgcttttcaaagaatcccaaaatctgtcccaggtgtggtggctcttgccctgtaattccagcactttgggaggtcaaggcaggcgaattgtttgagccccaggagttggagatcagcctgggcaacatggtgaaaccctgtctctactaaaaaaaaaaatacaaaaaattagccgggcacggtggagcatgcttgtggtcccagctactggggaggctgagatgggagaatcccctgagcccaggaactcaaggcagcagtgagccatgatctcatcaccactgcagtccacagtccagcctgggcgatgggagtgagaccctgtctccaaaaaaaaaaaa

SEQ ID NO: 608294 - DNA, 3104 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 608295 - DNA, 1333 bp, Homo sapiens
ggaggttctagagaggaggaaaagcctgcaaagagggggccgtactggggccaggccgcctaggccagcatgtggtctgcagtggggtacgggggcctgaggccgtcgccgtaggtgtcgatggggtagtctccatccatgtccatgtgcatctccagcgggtcaaggggcacatcgctggagtacatggggcggtaggtggcatccaagtcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 608296 - DNA, 2694 bp, Homo sapiens
  misc_feature (2676)..(2676): n is a, c, g, or t
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccttgtgcctctgnagtcctgtaatcagccac

SEQ ID NO: 608297 - DNA, 2707 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcacaagaagggatccgtctagagcaccacacac

SEQ ID NO: 608298 - DNA, 2893 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggcgggcaggtgacacggagtggcttgggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacaga

SEQ ID NO: 608299 - DNA, 366 bp, Homo sapiens
caagatatgtatactggctgggtgtggtgactttattgcccataatcccagcactttggaaggcagaggtgggtgaatcacttgagtccaggacaccagcccaggcaacatggcaaaaccctatctctacaaaaaatacaaaaatcagcctcccaagtagctgggattacaggagtgcaccaccatgcccagctaatttttgtttttaatagagatgggttttcaccatgttggccaagctggtctcaaactcctgacccaaggtgatccgcctgcctcggcctcccaaagtgctgggattacaggcatgagccaccaaacccagccattgaaaaacatcttgataaaatgtctagtcatgataaa

SEQ ID NO: 608300 - DNA, 2606 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttttgggaatgtttctcccctcttttttgcccgggagggcccggctaaaacccccccccctttggccgctaaaagctaaaatag

SEQ ID NO: 608301 - DNA, 152 bp, Homo sapiens
ccaagacgcaaacctctttttcctggccacgggggcccccagcctctctctccgcctgcaaccccggctctaccttaatagtcccaatcccaagctatctgactccaaaaattctcggccttcttccaaccaccaccgcttgtagggactcc

SEQ ID NO: 608302 - DNA, 1006 bp, Homo sapiens
cggacgcgtgggtcgatcttcccgtctcaaaatggacatgactggatccacggatgtacacgcagagagccaggaggtccaaccgccgtagacggaggaaggaattaaagatgtcttccaggacaagttttacttatatggagacaggtggaaaccataagttcgagctataatccagtaagatgaaggtgacagacaataagtcaaccgtcaggtgacaagaagtcaagtggagaagaggaagaccgccgaaagaacatctgaggaaactaagcatgaaagaacgtgagcacggagaaagaggagaggcaggtgtcagaggcagaggaaaatgggacatggatatgacagaaatacactagctacatggacaaatgtgtgtcaaggtgcgcaagcgtgcggcgggggcagaggactactacagatgcagagatcaccccttctgcaagaaagcctctttgcagaccgaggttcagaagtggctggctagtgtgagcactcgtcattcttgaggatgtgccctaatttggacctacctcatagacgtgatgctttaataaaacgggatgggccacgcagcacctccgtccaagtcaactaacattctataattgataactccctgaggcctcaagacattcttccgagatgtctgtgctcacgcccctttcaaccctccagtctcgaccatcaggcggaatgatgatcatccagaaacctggcggagtggttgtctaatccccattccatgctcaggcggatgataatctcaagaaacgtccgagatgtttggttcatccgcttcaagctcaggatccacctcagggatgataatctcaagaacacttccggagtgtgttgttcattccctttcactcaacgggaggatattcccagaactaggggatactcaagtgtttaacaaaaaaggggcggggaaaatccggaggcaatctcgcccggttttaaaaggccaaagggaaaaagggggtaaagaggaagtatg

SEQ ID NO: 608303 - DNA, 141 bp, Homo sapiens
gttttggctttttaaacttcaaatttgggtaggttaacctgccaacgtggttcagtgtgaatagtgcttaagttgaaaatattgtaaaaaaattatattttttccagaatatttaaaaaaattaatgatagtgggcctgta

SEQ ID NO: 608304 - DNA, 409 bp, Homo sapiens
ttgctgaaaagccgtatacaagaggtagtttctcgattctgaccctcctcccgctctccaccctcaggcaggccctggtgtctatagtttgcttctttgggtccatgtgtactcaatatttagctcccacttataagtgagaacatgcagtatttggtttgctgtgcctgtattggttcttttaggataagtgacctccatctccgtccatgttgctacaaaggatgtgatcttgttcttttttatagctgaatagtattccatggtgtatatgtaccacattttctttatccagtccaccattgatggacatttaggttgtttccatattttttgctattgtaaatagtgctatgatgaacatacacgtgtatgtgtctttatggtacttgggtactacgcttgggca

SEQ ID NO: 608305 - DNA, 841 bp, Homo sapiens
ggaccatcttggagagtttgttccgtgtgccgtgcttattgctcgatgtgtgcctgcctgagtctgaagaagctgcctggttggcatcagtgacgctgatctgcgtgctatgtactggctgtattgtctctagaggtgggtagttgttagtctattattattcctgcatgcatcggagggtggtattctgatggagttagagtcgattttgatgaagtaaatctagtggattacgtcggtatttagctcctgctctattgaagtttatcaatagtgtttgtaatctagatgcctcataagatatagtaaaattgtcgagacagatgaaattgtagatgaaggcagtctacgtctgaacagaaagattatgctagattggatacaagacagctggaagacgtttttaggacgattcgtgatcttgaggatatcatctttcgtatggttcatctgatagagtagtacgaatttgctctaccagcatgtatttatatatgcctgtctgggaccttattgtttcatgctcgacattgattgtgtgcaagttggacattattcttgttgagattatctcgattcaaatatatctcgtatattctacaactatagaaatgtaatgaaagtgattaattgtatattagtacccaatctgtaacaatttattggggggatagaacatttcttgactagatatgaagtgtatgttgatattcctgaaggctagattctcgtactttctgaggaactctggatcagtgtgatctccgttgacctattgtgtgctttgccgtttgaactacgagttgtgtgatggttgatttatgggaagtatggttggtga

SEQ ID NO: 608306 - DNA, 141 bp, Homo sapiens
ttaattcctttttggggggggcccccccaaggccccctttacccggtttggcccccggttttttgttgccccttgtttttggcccctgttttgggtttttttgaataattgaattttcctgccgggggcccttaaaagcca

SEQ ID NO: 608307 - DNA, 793 bp, Homo sapiens
ggaccaagcggacctaatagacatctacagaactctccagcccaaatcgacagaatacacattcttctcagcaccacattgcacttattccaaaattgacagcataattggaagtaaaacactcctcagcaaatgtgaaagaacagaaattataacagactgtctctcagaccacagtgcaatcaaactagaactcaggattaggaaactcgctcagaactgcacaactacatggaaactgaacaacctgctcctgaatgactactgggtaaataacgaaatgaaggcagaaataaagatgttctttgaaaccaatgagaacaaagacataacgtaccagaatctccgggacacatttgaagcagtgtgtagagggaaatttatatcactaaatgcctacaagagaaagcaggaaagatctaaaatcgacaccctaacatcacaaaagaactagagaagcaagagcaaacaaattcaaaagctagcagaagacaagaaataactaagagcagaactgaaggagatagagacacaacaaaaacacttaaaaccacaaatcaatgaatccaaggagctagttttggaaaagataacacaatagatcactagccagactactcaagactcacagagcagcaagaatcaacatagatgcgataaaccaccgataaaggggatgtcaccactgatcccacagaacatacaacgtaccatcagagaatgctataaacacctcttcattaataaacctagaaaatcttagcaagaacctggcttaactcctgaacccata

SEQ ID NO: 608308 - DNA, 116 bp, Homo sapiens
acgaaggggggatggacacacgaaagggggatggacacacgaaaggggggatggacacacgaaggggggatggacacacgaaggggggatggacacacgaaggggggcatggacac

SEQ ID NO: 608309 - DNA, 233 bp, Homo sapiens
ggcctctgtctgctcaggaataagccaggcctgggagggggaggctgcatcctgtgtgcctccagagcctcctctctgccccctgggattcacatgaaggagcagcagctggagcgcttctgcgtgtaatcccagtactttgggaggccgaggccggcaggttgcttgagctcaggaattcaagaccagcctgggcaacatggcgaaaccctgtgtctacaaaaaatacaaaa

SEQ ID NO: 608310 - DNA, 780 bp, Homo sapiens
ggcttcgggtgcatggggactcctcggggcctgcagaccgactgcgaggcgctgctcagccgcttccaggagacggacagtgtacgcttcgaggacttcacggagctctggagaaacatgaagttcgggactatcttctgtggcagaatgagaaatttagaaaagaacaactgttgacacaagaagctttagcttgggcttggcgatattttatacctccatacaccttcctgatcagagtggtgcttgtatctgctatatggattatataataccccaagtgtgtcgaacgcaaaataaaagatcgagagttgccgtgaaggattgggatgaagtttgaaaattgtcagcaagatgttagtaaatgcacagattttgatgcagcattatattttgtaggaagctaggactagacagagcatttctctttacagggaaatgccagaattgggtgtcatagtaggatgaaggaaaatgaattccccgagcgtgaaagttacagaagaatttaaggaaccaagtgatcgtgtgagtgaaacttatcacttctgatgtatgagaggaaatgcgtgaatgttcatgatcatgatcagaacaatgaatggaatgtaaatataaagtcgataaggtccaagacagactaaaagcatatcaagagttgatgaaggggatgaatgatagtgacaatattgaagaagataggttttgggagcattcagcagggggaccaagagacagaagaggaatacatacctatagaggtcacaagaactgtgtgac

SEQ ID NO: 608311 - DNA, 311 bp, Homo sapiens
aattgaagacccccaaaaaaagtgaaccagccagttcttgccttaattgatgaggttcccccattgtgatttgttggtgcccccccccaattgtttttttgcccttgggacattttttttttggaggagtttcaggagttcccccccgagccccttgtgaccccgggcccgggccagcaaaagaaaaccccctttaattttccactacctacccaaatcctataaaattgccccccccctttttccctttgttgacccctttttgggattcagcccacttgcacccaagtgaataaacagccttgttgtta

SEQ ID NO: 608312 - DNA, 248 bp, Homo sapiens
atcatggatttgctggtgcagtacaactaggcttaatagggacatggtgaaaacctgtctctactaaaaatacaaaaattagctgggcgtggtggtgcagacctgtaatcccagctactcaggaggctgaggcaggagaatcgcttgaacctgggaggtggaggttgcagtcaagcctgcattgcaccacgggactctaagcctgggcgacaagagccaagactctgtctcaaaaaagacaaaaagga

SEQ ID NO: 608313 - DNA, 495 bp, Homo sapiens
  misc_feature (456)..(456): n is a, c, g, or t
  misc_feature (466)..(466): n is a, c, g, or t
  misc_feature (469)..(469): n is a, c, g, or t
  misc_feature (471)..(471): n is a, c, g, or t
  misc_feature (474)..(474): n is a, c, g, or t
tcgaccatgcctgagagctctttaggataaacctagcagtggaattgctatgtagtacgggatattgcatagttttgtcagtttagacattcaccagtaacacatgtgttacctgatttgcacagtctcatttggtattgtcagccttttaattttttcaatttgatgtacgtgaagtattgtcttactttaatttgcatttccctgattataaactactataatgagatgggtcatctttttatattttcattattattcagattttttattggactttgtcttagatttattgacttgaactcactcttctatattaaaatactcatctaagtcactggcctaacattgaaagcctaagatagaaatatatgaccaactgcaatttaaacccaggcatcctgtaattaaataccttgtttaccatttgttcacatttaataagtagtattgccnattgtattanaananatnttccaggacaattgttaaaaa

SEQ ID NO: 608314 - DNA, 414 bp, Homo sapiens
  misc_feature (27)..(27): n is a, c, g, or t
  misc_feature (67)..(67): n is a, c, g, or t
  misc_feature (188)..(188): n is a, c, g, or t
  misc_feature (217)..(217): n is a, c, g, or t
  misc_feature (332)..(332): n is a, c, g, or t
  misc_feature (335)..(335): n is a, c, g, or t
  misc_feature (344)..(344): n is a, c, g, or t
  misc_feature (346)..(346): n is a, c, g, or t
  misc_feature (385)..(385): n is a, c, g, or t
  misc_feature (409)..(409): n is a, c, g, or t
  misc_feature (411)..(411): n is a, c, g, or t
tggccaatggaattcgcgggggaaagnccatgtccctttctccccctcagccccttccccgttcccngtttacatctcaaggggaaaagcgcacgcggggtctcccagcaccgtcaccaccgctgtgctgtcagcccaggcgcttgcagcggcgccctttcggccctggggcagttcctgagacttcnctccgctggcttggggatgcgggggtgcnaccgggcccggccaccggcggcggacgcgcgtggcggggcggggcagaggttgagaaccgctgactgcgaagtccgggtgcggggaagggaagggagcgaggtgcgggggaggcnagnaggccggcnanccctaggcggctactccttgtcgtccacgaggtcggcgnagctcctggagcactcgcaggcgngncgc

SEQ ID NO: 608315 - DNA, 306 bp, Homo sapiens
caggcgcactgacccactcctgtaatcccagcactttgggaagctgaggctcgtttctcctcactgctttcctgtcttgagcacaggagttcgagaccagcctgggcaacacagtgagatcctgtctctatttaaaaatatacatatatatatttttaaaaaccaggtgcagtgacgcatgcctttagttgcagctacttgagaagctgaggcagggggatcgctcgagcccaggagttggaggctgcagtgagctgtggtcacaccactgcactccagcctggggaacagagcaggaccctatct

SEQ ID NO: 608316 - DNA, 215 bp, Homo sapiens
ctcctgattgtgtggtgtatgaatattaagctagcttatgaagtggggatgatttgtatctgaatgattggttgataaatagattaccattgggctatggattctgtcacataacttgcatattgacaacagtgtctatagatagatcttacaaggaagggtagccaaaccgaatggattctttaaggtctattgatccataacaccacacaatt

SEQ ID NO: 608317 - DNA, 2098 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccccaaacgaggcactcccgagtccgctcattggtaccgacacgattca

SEQ ID NO: 608318 - DNA, 1213 bp, Homo sapiens
aagctggtacggccggagatttaaggatcagagtcggagcagccgccgccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccaggcgggggctgttgctggtcaggtgcttgcccagggcctgcatcccaccagcctccacaatggctggcttattgctg

SEQ ID NO: 608319 - DNA, 148 bp, Homo sapiens
acgcagttaatacagactcaggcgtttgtgtataatatagtttgcggtttcgatgatgtggtcttatggagtagaaacctgtgaggaaaggtatatcctgctaatgcctagtgctgccaatggtagagggaggttagaagtgaagcgg

SEQ ID NO: 608320 - DNA, 1334 bp, Homo sapiens
gagaaataagttaggataaaggaaatttgaatctcaaaaatatcaaaagtaaaaatgtattctcaaaactttaaatttatgaagaatgatgacagtagaagccttcctcttcccttgtcaccttgagataaaaattctttaggcaggaaaagaaatggaagtcagaaaaacattagaataagacaataatgtgggtgtctgaaaaggaacaaatacttattcctcacatagggttagtgacaatgggaaaagggacgggagtagaagccacagacatatctaggagccctgaatagaggcgcagtctgcctcacctcctgaatgaagctgtactagataaccatgtagctttccctgtgccactctggcatgaaggagacagtatagtgaatatggctacaggatgtttcttggaaacatgccaatatcttcagaaatccccagccctttcccctaacccctcctgactaaggaaagcatgagcttatgagagaaaccctaggaagaacaacacagttgagacaatgtagcagcagcagtgggtgctgtgtcctccactggattcgccatctccgaggagaaactctcacagaggaaatgggtcagcagcgacctcatggctctaaacagctatgacatccatgaggatatttctaaccatgctacctgcatcagtgagtttaaattttaattggagaaacaatacaaaacattaacgcaataattgatacagtatagtttggtgcaaagaaccctaaatccaaatccaggactcagtactttgaagctagtatttgaaactttataacatgtgtgaagtatctaacatttctggccttactttactcatccacaatgtaggagtaataatactttccttgcagagttattgataaacatttgaataatcttgatattagtccatgccttacaccattgtaacatgaaccacttacgaacacattggggtcatattatcactgcatcaattaaacaaaatggccaccacatcaaatgaaaagcacattggattccacacaccccactacgaataagcgatcacgtgaaaacatgaggacatacgaccacacacaaaccgaggaaaaacaatagacggaacacacagaggcaatgactgggacggaaacttaacagaacaaagaagaatgaaagctaaaaactcaacaagaataccccagtgactcaaaatgacacagcacactaacacactctcagaacgacaaaaatatcggtaatacgaaaagagcacgaaagaacaaacaccacgacaaacaacaaaagaaagaccacagcaaccagaggcacgcagcaaa

SEQ ID NO: 608321 - DNA, 123 bp, Homo sapiens
agcggagtcgggcctgatggccctgaggcagttcggatgtgtcccaggaagtgcccatgtgtggtccgccgtccattccacacaacatacgagcatgtttgatctacgttacgataatgcgta

SEQ ID NO: 608322 - DNA, 440 bp, Homo sapiens
tatctatgggaagggggtgtatgatgaagatggacctttagtttaatggggaaagatggattatttaggaaatcttacctaaagcaggatccctacatcatccctgtacattcattccaccaaataaatcctagttggctttattgaattgaatgtaacaagggaagccgtgaaagttctagaaggaaataggtaagtgttttcaaagtcttaggctaggaaaagccttgttaagtacgacacaaaaaacagaagcataaaaaaaggacttctaaattttgactatgttaatgaaaattagtgtttatcacagcattgtttatttgaaacagcacgtctgttaatataaatgtatgtctgtggggaaatggttaagtagattatgataaatgtgtacagccacccattctgtatataaaaataaaataaactaccacttt

SEQ ID NO: 608323 - DNA, 1358 bp, Homo sapiens
atcccagcactttgggcaggcagaggccaggtggatcacctgcaggtctggcagtttgcagacccaacatggcccaaccatggtgcaaaccgctgtctctcacttaacacaataccaaagacattcatcttgggcatggtgtgtggggcgcctgtaatcccagctcacttgtggaggccgcaggccggagcacatcgacttgaaccacatggagtcatcccatgctacttgggccagccgcaggccaggagcacatcgctgtgaaaccaacggagtgcggacggttgcacgtcaaggccacagcatccatggctattctcacacgcactgggcagagcacagagcaacaacctctgtctgcagcccaaacaccaccacacaacacagtggtctacacatcatgcagcattgtgcagcacacgaagcacagacttgtccctgcattacaatacttgttcaccgctcgtttttgccaacaactagttcgcgtatcccaacgtacaacagtatacgctacttattcccctatgactgacaccgcaattttattacagaacagacgagattagccttcagagatagggatgacacaataacgaggctcagcatgcagatcatacatacgctactatggttgtaacagccacacgtcattacgcaacgctaagaaggttcagaccatggagagggttagactccagtgcataccgcttgagcgcttgcacagtgttgcaaatatacaccgtgactctactaccactaccgttgagaacagagtaagtaccctcttagttgaaataagaactcatacccagtgagttgaaagagctccacgtcaccccacagcccaggaccgcgatccacagctaacaaacatgcaatggaccctacaccacaagaggacagaggcaacacgaacaaggggaaatatagcacaaaaccaaggccgaaacacgcaagaatgtaacaacgggaaagcacacggacaaccacgtcacaactagcacagagatcaacacaccaccacaaactaccacgacatacacagcaacacaaacacaaccaacacgagcgcgcacacatcaaaacagtcagagcataggacgaaccgacatacagccgagacaacgcaaaaaacgctaacagcgaggacgatgaacgagcaaccaacagaggttcagagacacagaacaccaggctgaatggacaccacagccagcaggagcaaaaacataagacgcaacagcgcaccgagccagacacaacgacgcacggacaacacaaggagaagcaaagcccgacacagctccagcacacaacacgaacaaaagaaactggaagagtcctgcaacgactac

SEQ ID NO: 608324 - DNA, 300 bp, Homo sapiens
ggtcaacattctgaggaggtcagcagtctcatcagtggccttcttctctcccctcctacggcatcccaaagcccacctcactgtgccctctaaaggagatcttagagctccactgacagctatatcattcagggcaattgtttaccgcatttggtaaactagttaacactggctactgatagaagggagcttggcaattactgctcggggaaaactgcaaattgctgacagttctgacagtaatcaaagggtactttaaactctgtttcctgattggccctagagagtgacgttcctcat

SEQ ID NO: 608325 - DNA, 826 bp, Homo sapiens
atggctgaaggggatactcaccggcatgaaggccgactgtgattccccctaccccctcaaggcgatttagagccccctgtagggctgcatctagtaggactcaggccccgaagtctgtcccatggatggtccccgttgcatcccaccaccttaagctgtgcctcatgtgaagtctgatgtttagacggccctgacctgaggctggcgctgcatgctgagagacctggggtgccaggacctgctttactcctcattccaggcaccctgtgcatcggatgattgtacggagtcgtgccagcggatgattcgcgttggtatttttggtccccgcagaacgcgttggcggttagtgcaacatgaagattgcacatatgcaatgattcctcttgacctcagtctattctgcggacgatcgcctgtgcgctcgatggactgctccgacatggcatgcagacgacacgggttcacatgatgcttcatccatgggtgctgacaacaagccatatcggccagtgttttaaacttgggtccttaagtgtgaggccagggcctggggatccggggctcatggggttcaacgtctatgacagtgattgccttcaattggtggtgtttcatccttgcactgataatgctgcttgccgtggatgtgctgggtgctgagcaaggctgggagctcaggctctcaatacattttggacctgcctgcttaagccctccaggccgcccactgcccgtttgacttcgtgcttcgtcaacgttctgtggccttggagctctgtgtcacggcctttgaggcccagaagccagaccccaaaagcgcctg

SEQ ID NO: 608326 - DNA, 407 bp, Homo sapiens
gtgcggcgtgggggaaaaacgtcgctctacggggccttgagaactgtcagcaaactaaaggctccgagtgacacccaggacaacacagaggtttatacctaagtcgctaggaaagactatatcattattattaagatctcacactggtgtggtacacctactagaatgtgaaccaatagcaatacatgattagtaactaaagtctatggtttacattagggtccacccctggttccgtatattctgtgggtcttgacaaatacatcatgagcaacatatatccattacagtgtcatttacttaaccacataacaaattcagacttagcaaaagggcagccagagagaaaggtcgggttaccctcaaagggaagcccatcagactcacagcggatctcctggcagaaa

SEQ ID NO: 608327 - DNA, 861 bp, Homo sapiens
gcatctttgtgctgcggctcttcatgaccccagtggccatggtgcatgtcttcctcagtatcaacctcctgctggccagcgctggggctggggttaagctgcttcttcagcgatggacagtctctgtgaagatgaatgtgctgctcttcggccctgggttactgtttcttctcctcacagcagttaggcttccgtggggccctccccaagtctgggaatctgtgctggcctacagagtggtgctggggctgcccttcctgctggagaaccccagtggctacctgtgccgggtcccgtttgaacttggtcgacagtttctgttccactggacagtgaactggcgcttcctcccagaggcgctcttcctgcatcgagccgttccacctggccctgttgatctgaccacctcacgctgctcctgctgttttgcctctgcaggtggcacaggacaggggaaagtatcttgtcagctgctgagggatccctccaaaaggaaggttccaccccaggcccttaacccaagccatgatcgtttctagcctcttcagcctccaagttcattggcactctagcttcaggcgctccctcccactaccaagttctacgtcgtggtatatccacacagtgcctaacctctgtggggcatgcctgcaggctggtcacacacctgctcaggtcgagtggtgcttggggctcatcgagcgtctcctggaacacaatacccttctcacattcctgaagtctgttgcctgcacatattgccatgccgtcatctggtgcagtcttgggctgggcccggactttcccaagagcacccaaacagaagaaggccactgaagtccaccccttttcctcaggact

SEQ ID NO: 608328 - DNA, 416 bp, Homo sapiens
gggggatggagcaaaaccgtctttgaatattgcacccggagggctgttggactccccattgtagaaattgccccctataccattgggggtcctgatcaaaaatttggggggggggggggcccggttggttttttaaaaccccaccttttttgggatccccccaaaaaaaattttaccccaaagggggtccttttgttttaattttggccacccggggagggggccgcccaaattcccggtttttttttcccaaagggttgggacccggaaaatttggccaagaaaaaagaaacttttttttttttgggggtccccccaaaaccattcaaagggtttttggtttttttttttccccattcccatttccaaagggttccaggggggtataaaaaataaacttcccccctttttttgga

SEQ ID NO: 608329 - DNA, 449 bp, Homo sapiens
ggtgttcgccctcttataatatgatacggggtaaatattgtaataaggggaacacacatcgtttgtgaagagagaagtaaatatattaccctcctctgcttgtcgtgttgtttttttgtgtctctctgtgtttaaactaatatataggggggggcacgacctccaatgcatcttctttgtgcttgtgtcgccgcccgagcgccgccctctcaatacatccgcaatgttcgctctttttgtgtggtggggaataacgtttttatagaaaaagagggggtaatattatttgttttattgtataggaaagggtggttgttggaaaatatcctctttgtataagaggggagatgcgagttgtatattgtttgttgatataagagaggagggttttttttttgtttcccccgggggggggttttacttttggggaaaaaaaaaattttattata

SEQ ID NO: 608330 - DNA, 934 bp, Homo sapiens
gcaagaggagaacacaagctacaatagtcagcctaacgaaggatgaagaggtggcagaaggaagaagataagccatacgtaagagagccggagtaaaaaagaggggaagaaaggaatgttgaatctaaaaaggaaatagtttagcttaaacaggggttacttcaaccatccgagttctgagagaagaaggacgatgatctagaaggtgacaagaatataactggtgggaggaactttcagtagtgcctcacagtaatggaattttctgaaaggtcaatcgattgagaatagaatgcagtagatcgaataactgcatagcaagtaggacacaaatggaaacctgaggcgaccagaagaacatgtaaatctaccagtaagtggaacccacatatatctcagttttgggctcaaagcaggttaatccagttactgaaaagagaatacaagttggagcaaacaagaggatgaagatcttgatacagactcattggacttgaatttcccccttggccccattggatggaagaatgttccagattctaaattgaggacttcattattcaatggcattactgttgttctgcattaacgaattttccctgtaagggtacacattaaatactaagggtccggcattcattccctgtttgagataggaaattatggcaaaaacgcgagagtttaatatcgagccttgtggttcaacggactactagaccgaaaatgagggggggaccatattatcctaaaaattttaactccatgtgggtggagaccccgtttttaacgcggggataaggattattcccggaaagaggggccccctgtatgaaaacaccgtggtggtaatcattctccaacactctaaaggttttacccaggaagaataaacggaacacgctgacagacatgtacgccatttataagcttttaa

SEQ ID NO: 608331 - DNA, 200 bp, Homo sapiens
  misc_feature (46)..(46): n is a, c, g, or t
  misc_feature (99)..(99): n is a, c, g, or t
  misc_feature (107)..(107): n is a, c, g, or t
  misc_feature (185)..(186): n is a, c, g, or t
tgtatgatagatgcactcatcagacaacagactatactgctcatcnaaatgcacagatacttgggaagcatgagttaaaaaagaaaacaaatccactgntgattatntctacttgggcttatcataaagtaggaataaagacttcactctatccatgaatactatcacagagaaaccgtcgaatnncgaggggtacgagc

SEQ ID NO: 608332 - DNA, 344 bp, Homo sapiens
  misc_feature (200)..(200): n is a, c, g, or t
aaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctggganaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctc

SEQ ID NO: 608333 - DNA, 105 bp, Homo sapiens
gtgttctcgccagggggtgcgaggaacccacctaaagcttttaagcaggcaagaagctgtgaagtaccagggtcctgggactttcagacacattgaaaacatgat

SEQ ID NO: 608334 - DNA, 135 bp, Homo sapiens
taaaagagcaggtgttcgtgagagagtaaggaaagcatttggacaatggacagcattgcaaggactgcaggcaggaaagagaacgggcctttgaaggaaacatggctgaaggcaaatgatggggagagtggtatg

SEQ ID NO: 608335 - DNA, 279 bp, Homo sapiens
taagcagttaatacagactcaggaacagcagcagcctccggtgtcggcccagtgatccgggaggctcagagtgtaggtacctgacggcttgattcgtccccaggaacaagggcctgtgagttgggagaggggcactctagagtgtgcgaatcttgtagacgagtgtgtgtagtgtctagggcacgagtgtagtatagcggtgtgtgtagcatgtaatatatcacggtgtggtaaaggggtagtgacatgtgtgtagtctagtagggtactagggcacat

SEQ ID NO: 608336 - DNA, 933 bp, Homo sapiens
  misc_feature (2)..(2): n is a, c, g, or t
  misc_feature (24)..(24): n is a, c, g, or t
gngcagtacaaaactcagataagngtccttaaattagcttaaaatgtccctgtcctcaacagggacatttttgtttttgtttaaaaaacagggatggttggccactgcacccagccctctactttgttttttgtgcctttctcttccatagtgtccataatgatcatgcattaattactttcatagcttaaaaaaaagttgaatgggaaaaatgggtcactgtgtatttgagaacagtactggatgcttcgtgtttggatgtgtgggtggatctgcttctttcttccatatgctctgctgtgtgctccctggctgccctgctttaattttattttgttttacaccctgcatatcttgatgtctgcttttttcctcaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608337 - DNA, 771 bp, Homo sapiens
gctatttctcacacaattcacacacttacatcaggtgtgtaaggaattccacttcattgcactgactttctacatattagtggggctctgcacgatcttggtttctactgagtggattcactccattctgtgattttttttccttacgggtcctgcctcagttggcggaatggcggccacgggagccaatgcagagaaagctgaaagtcacaaaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608338 - DNA, 655 bp, Homo sapiens
cagttgacgtgggttttcctttcacctaaaataaccattacaagtaagatactaagtaaaaaacatactcatttctacttggtatatgaaaataatatatgtttgatgtattcagtgaaattccagttaactcataactctttgaggccatggatggagaggtggcattattagtctctacctccagtgcctcacacaattcctgggcacagaaagagacatacaattcatgttgggtcaatcaaagaatgattgatcattggcacctcctgattctatttggtggtcagagaaagtggcaggacttaagttattttacatataaacatttcttgcaaaatttggagaggatgttttgatggcttgagatcttttaatttctttgagttactttcattgtccttcccaccccttccctctctccactctgaactgcatagggcctgcctgtagtgaactactcacttcttctgactccaaggaaggccatatcatgtgttttaagtaccccataaaatttatcttcaaagtaaagcttcctttgccaagctcacaaatgatggatttttgttttccttcggcctgagggtcaaaagaatgggcacttttgtatgtacagtcttcggggccatttcctccctcctatctactgcct

SEQ ID NO: 608339 - DNA, 159 bp, Homo sapiens
ggggagtttcccggcccgatgtctgatcaaaccgtggtgaactgtgtttttacacggtatttttcccacgaacacccccagccggggtaacattccataatgattattctcggcatcgacccgggcctgcgcacgacgggatacggcggggatcctcta

SEQ ID NO: 608340 - DNA, 390 bp, Homo sapiens
tcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608341 - DNA, 675 bp, Homo sapiens
  misc_feature (398)..(401): n is a, c, g, or t
tcttccgagcccctggaccagcgcctttccctcccgcactccatcctccggccccgcctgactgcatgggcagcctggtttcctgaggaggcagagaggctgctcctcagagctcgtgggttcttcatcccgtccctgtgaaatgttagacccccggcaccttgccttgatgtggtctttgtcctttgcagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatccannnntgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcaggactttaaaattctaatggtagtcagatttcatgtcactaaacagaaatctgacataggacaagcaaccat

SEQ ID NO: 608342 - DNA, 1377 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608343 - DNA, 1019 bp, Homo sapiens
ccactcaccagggggccttgttaaagcagattcctgggccccttagattcagcaggtcctggtgaggccagtgaacttatatttttagcaagttcattggtaatactgatgttgctggtctaggggccccacttgaggacctctgctatagacagtgcactaatgggggtctctcttctctggctgcagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608344 - DNA, 1662 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
  misc_feature (1385)..(1388): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcatggtatgggcattccttctatctcaatcatgttgcatgagctcataaagctgctgtactatgcccggtgctccaacgtcactatcatccgcattggcacttctggtgggataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtccaaaatccannnntgtgtggactttgagcacactttacacaagaatctagaaaatcagatcgcgattaagagacagagaatcttggattaaccgcatgggagatgttcttccttttgaagtttcattggagcattttcaatgatgttagcctgatttggggtttcttcaagaacattctaccaaatttttgtactatttctagggaaatttttcaggactttaaaattctaatggtagtcagatttcatgtcactaaacagaaatctgacataggacaagcaaccat

SEQ ID NO: 608345 - DNA, 987 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaaaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608346 - DNA, 1267 bp, Homo sapiens
  misc_feature (25)..(25): n is a, c, g, or t
  misc_feature (36)..(36): n is a, c, g, or t
  misc_feature (53)..(53): n is a, c, g, or t
  misc_feature (73)..(73): n is a, c, g, or t
  misc_feature (100)..(100): n is a, c, g, or t
  misc_feature (112)..(112): n is a, c, g, or t
  misc_feature (120)..(120): n is a, c, g, or t
  misc_feature (125)..(125): n is a, c, g, or t
  misc_feature (181)..(181): n is a, c, g, or t
gacctcgcaagtggttccctcattngagtgctccgngcgcacagacccgcgcnccgcgcgtccgcgagcctcnccgagagccgtcccttcgtccggcccntggagcattgcngtttgtcngccgngtgtcgcagtgcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaatgattgccccgtcagacttttaaatccaaacatagcaaaaatgaaagaagatattctctatcatttcaatctcaccactagcagacacaatttcccagccttgtttggagatgtgaagtttgtgtgtgttggtggaagcccctcccggatgaaagccttcatcaggtgcgttggtgcagagctgggccttgactgcccaggtagagactatcccaacatctgtgcgggaactgaccgctatgccatgtataaagtaggaccggtgctgtctgtcagtcataggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608347 - DNA, 939 bp, Homo sapiens
  misc_feature (6)..(6): n is a, c, g, or t
  misc_feature (133)..(133): n is a, c, g, or t
agtganaaagcagtgtacgtcgcatccgctcgcgacaacgcccgctcgcgactccaactcctctcgccgacatgctttccgttccaggcgaggatggcgccgcggggtgtagctggtctctctgcgcaggccngagtgggcccagaagaagcgaggaactccgcagctcgtcgacacgtctcgtctcctgtcccaattcagggcttggtgaggtgactcgcggtcgcgggtgactcgccggcaggacactgcctggaacgcctggagcgcctcccactgcagacgtctgtccgcctccagccgctctcctctgacgggtcctgcctcagttggcggaatggcggccacgggagccaatgcagagaaagctgaaagtcacaaaggtctggagcccggcactgtggtcataacagagcaggcagtggatacctgcttcaaggcagagtttgagcagattgtcctggggaagcgggtcatccggaaaacggaccttaacaagaagctggtgcaggagctgttgctgtgttctgcagagctgagcgagttcaccacagtggtggggaacaccatgtgcaccttggacttctatgaagggcaaggccgtctggatggggctctctgctcctacacggagaaggacaagcaggcgtatctggaggcagcctatgcagccggcgtccgcaatatcgagatggagtcctcggtgtttgccgccatgtgcagcgcctgcggcctccaagcggccgtggtgtgtgtcaccctcctgaaccgcctggaaggggaccagatcagcagccctcgcaatgtgctcagcgagtaccagcagaggccgcagcggctggtgagctacttcatcaagaagaaactgagcaaggcctgagcgctgccctgcacctccgcagacctgctgtgatgacttgccattaaaagcattgtcca

SEQ ID NO: 608348 - DNA, 886 bp, Homo sapiens
ggagtctttctctgttgcccaggctggagtgcagtggtgcaatcttgaatcactgcaacctccgcctcgcgaattcaaatgattatcctgcctcagcctcctgagtagctgggattacaggggcgtgccactatgtccaactcagttttttttttttttttttccccgaaacggaatctcactctgtggccaggctggagtgcagtggcgcaatctcggctcactgcaacctctgcctcccaagttcaagcaattctcctgcctcagcctgctgagtagctgggactacaggtgtgcaccaccacgcccagttaattttggtatttcagtagagacggggtttcaccatgttggccaggatggtctcgatctcttgaccttgtgatccgccctcggcctcccaaagtgctgggcattacaggtgtgacccaccgtgcctggcctaaattgggctttcttacgtccagacgaggtttcaccatgttggccaggctggtctcgagctcctgacctcaagtgatctgcccgcctcggcctctcaaagtgctgggatcacaggctgatccatctgtgccggcctgcttgctcttttttaaccctttactcttgtcacccgtgcagattctggccagtgcaccacgcagcggcgcttccattttgtttgggcgcgtctgctccccagcgttcccggcggacgactgtggtcttgacgcgcatacatggcgccccctacgggctgtgaacccccgggccacggctgtgcgactccttcccggccgtgggtctttcgggccgtgccggccccccccggcgcgtcgttgacggtcccccagtgtcgaggcgctgttggctctgctcgtgcctgtgcccggtccgcgcccggcct

SEQ ID NO: 608349 - DNA, 377 bp, Homo sapiens
  misc_feature (58)..(58): n is a, c, g, or t
cctggactgcctggggccctgccatttgcttcccctgctgtcacctggctccccctgntggggggtgggtttccatttttccctcccccccccctcagcagcatttgctttccatgccctccccatcacctcactgcccccaggccttttgccctttgtgggtgttgagctccccgcccccccccaggccctcatgggaaaaggctttccttttgggatggcggcgggtggtaaacccctttgctttttctagccctcctgggctggggttgggcccaaatccccaggcaggctttggagttgtttccctggtgatggggcccaatgtatagtattcagtatatattttgtaaataaaatgttttgtggctagggga

SEQ ID NO: 608350 - DNA, 1056 bp, Homo sapiens
  misc_feature (1016)..(1016): n is a, c, g, or t
tccactaaacctgggggggctgttggagatatggggtatatggcagggggttctaatattcgactaatggtggtagactagaattggatggcccctaaaataaagagaaacacctgctaggtgtaaggaaaaaatggttaggttctacggaggccccagggttggcgagttagttcccctgtgactacgggcgacgggtaacacttgttcaacctgtgtcccttgcctccggccttccacttattagcagatgcacagcaggattaggagaagcagggaggtaaggagctcaaaaagctatatgttggctaatagtgcgggcgaaaagggcccaatatgcggggagaccccgaattattaaggggcgcaacctaagatacaggtgtgccaaaaggccctccgaaatataatgcagtggagctaataacctaagtgaaagaaaagaactttaattaacacacaaacgtgacatgtgagagcgtgatgccacatcaatacagcgtgtttctgaatcaaaattttgttcgtactccaaggtacaccctataaaaaaaaggtgatttagcctaatgagcatttagggcccacaaagttttatccagagctatcgaaaaataaacaagagagatcgtctataaacaacagcatatgtgacgcacatagaaaaaactctatacccaagagatcatacattgtagcgggccccgaggacaaataaccaactcagggcgaattacattaagacgctgtatcacccccaaacagatgtgctatcaataaatgaagaggaagcgaatattgttgagaagagaaaagagacaaaattgaagaccacacgcacgcgagaatcgacggacaccagaatttcccccaccgacctctacataaccctcaccatcgagaaacaaacaaaaagcccgtttgataaggcgcacacaaaacgaacaattttattacccccccccacaatacatacaacaggatcaaatcaagaggacgaaagacaagacaaccantttggaaaccacccgtagttggcacccaacacacgaaact

SEQ ID NO: 608351 - DNA, 338 bp, Homo sapiens
ttacaacccacgatcacagatctatctgagcaagctgtaccagtacactttacagtcttaaaaatggaggttatatactcagaggcaatataatttgtccatattatatattttatctgtgcgtcatagcgtttattaccatgtgtttatattcacacatagtcgtgtgttaatatgctaggggggtcttttacatggttgttgggcggcaggttgtgacacaccatctgacacagaatatctgatatgaaatttagggatctcttaagtattttgggtgttgatgtatattttcctaatatttatgctgtctttatgatactctccagatttttaaa

SEQ ID NO: 608352 - DNA, 203 bp, Homo sapiens
tcttgctgtatatattttcccataaggaatcacctcgtttggttaaaaaataggtaatgtgttaggaagttccaaagatattaaaaatggcaatttttcaaaataattttttaagtgcactgatgacaaatgggaactaagcagtaagccagatgaggcataagttagaaaaatatggtgttgtttttctgtatcgtcgacgc

SEQ ID NO: 608353 - DNA, 197 bp, Homo sapiens
catagtcagttcagtgtaaatcatctgacgcaggcttatgcaggaggagaatgtatacatgttaacttatcactaacattagttctactatagggtgcatagataggtccaattgggtgtgaggcagtcagtcatatgtttgggcattcttcaggtagtgggtgttgcgcttgaacgctttcttacttggtggctgc

SEQ ID NO: 608354 - DNA, 917 bp, Homo sapiens
tggcattttgcgccgggtctgtgctggtcgcgacgcctggcgctccacgctgagcctctccgtgcagtgattaacccggcgggtcagggcggatgtgaaccagacatccagtagagcaactctgtgtcggagatgacagttctgccccgagcctcgagaggtttcgtgcgactcgtccgaaccagggaccacagcaggaaccttgcaggtatccatcaccggttgtaccacgttcagtgtcgctgtgtacctatggtgaattgtacgtgaagtgagctcagcatcggcatgatgtatggcgttttgtatatcgtagccagcaggacccatatgagacttataacagctcggagcatgaaccaagtaggggagaaatgaacatagctggtaagtgacagtgggtagaagtaccgatatagtgcaatagagtgagtatacgaggtctaagagatacgtgtagggagtggacgaattgatgtacattggggatgtttgaaggaccatatggagaaggaattactgaagagtaccgtggagaaaacgaagatcaggatctaggattccgcaaacgaaaaagctcgaggatgctacggaaaggtccaactacatcgtagaggtagcaaatacccatttggtcactagcaaggcaagagaatttgttaacaaccgtcaagcatatggagcgttcattgaccgcacaggtgaacgttaatagtacaaaaaaatgggagtgaacaccggtaaaattgtacaaagggaaaacaaaagtggagatacattcgctttgacttgtggggtttgtgaacaaatagttgtgtaattagtaaagattggtggattggggatatatgaaaaaggtatgcatataaatgtatgtgtataaaatttaaatataagagacgcaaaatataaatgat

SEQ ID NO: 608355 - DNA, 314 bp, Homo sapiens
gatgggctcatgtcaggaaacagtttccatcatatctgcaaatactctacatcacacactctagttaaaggcaacgcacataggtaaagctgatcacacgtccagagttctcagcttacggaatctagcttctggattttatgttaatttctgaaaatcagaaatgtcatctccaaaaaatgttacgagggttgtaaaaaataatcactttatttgatattatagttgtagatatggaatatattttaatgaaaaactcaaaacagcaaaatgccactcaccatcatgggtatagcaataggccgcatccaaag

SEQ ID NO: 608356 - DNA, 122 bp, Homo sapiens
cgtgtacgatgggcacacacacacacacacacacacacacacacacacaccctatctcctagcccctgtcagtgtagcattttctcagtccactaggtcgtgacactcgctcatattcctac

SEQ ID NO: 608357 - DNA, 127 bp, Homo sapiens
ggcctgacgattgaagagctgaatatcccctctattttgagtaggaatagatattgaatactccgccatacaattggaaacgcatcatctagtactagcaggcattatgattacccggtttgatatc

SEQ ID NO: 608358 - DNA, 540 bp, Homo sapiens
  misc_feature (178)..(178): n is a, c, g, or t
  misc_feature (181)..(181): n is a, c, g, or t
tcaaaaggagatgttgtttgctactatggaaaccggggggagcctgagcctattgtcttgacaccaggctgaccttcttcctataggaacctatgggctaagcaatgccctgctggagacgccctggaagaagctgtgctttggcaaacaactcttcatggaagcagtggagcagagntanactccctaaggacgtccttgtcactcagctcctagatgtcctcaacaatgaggaggcacagctgccagacccagccattgaggaccagggccaggagtatgtacagccaattctgaacaagtatgcagctgtgtgtgtccgctgtgccacctatggcaccagaaccaacaccatcatccttgtggatgcaaatggccacgtgaccttcactgaacggagcatgctggacaaagacactctcgctgggagaccaacaccctatgagttcacactacagagttagcccctgccaggttccaaggatgctgttctgaagggcaacgtggacaggaactttcacgggcactctgcaagtcttg

SEQ ID NO: 608359 - DNA, 470 bp, Homo sapiens
  misc_feature (4)..(4): n is a, c, g, or t
  misc_feature (339)..(339): n is a, c, g, or t
  misc_feature (346)..(346): n is a, c, g, or t
  misc_feature (386)..(386): n is a, c, g, or t
  misc_feature (445)..(445): n is a, c, g, or t
  misc_feature (460)..(460): n is a, c, g, or t
gtgngagggagaaggagaaggagaaggggggggggaggagaaggggggagggggattgtaggggggggaggggggggggaggaggagaaggaggagggtgggggggggggttgggttggggtgggtgaggagttggggggggggggagggggggaagggggattgatgtggaggtggggggtgtggaagaaaggtggggtgtgggggggtgatggaaaggggggttgtaagtggtggggtggggattgggtgttgtgggaagtggggtgggtgggaaggaagggaatggggaagaaggggagtgaaggagagatagaggagggggtttagtggggggangtgtatntgttgggggatgagggaatgaagggggtggagagatggantgtggtggtatgaggggtggggggggtgggggtggagatgggtaaaaagatgatggttngtggggtgaaaggtnttagggtaga

SEQ ID NO: 608360 - DNA, 818 bp, Homo sapiens
atcgagcacgagggctgactcaggatgatatggggcacccagagataggagatgctattgcccggctcaaggaggtcctggagtacttctgccatatggaggcaagtataaccggggtttgacaggttggatagtagcattaccgggagctggtggagccaaggaaacaggatgctgatagatctcccagcggagacctggacatgatgaggctggatgatgtgtgaacatgctgcaaagcaatttcattccatggatggcaagatgacaacatcatgagtaattcagtcaccttaaccacgaccggggacaagaatctagctgtgatattcagcaagcacgaggcgatggagtttggagtgcacaatcacatgaatgctaacactcacatggaaagcatgtatctaccagactgactgaagctctattgacgggagacagaaccatatatacacttgaaccatgaatcgagctctatccatgcagagattaccatatcaagacttgagaatagggcagaacccatggaaccgtccatacaaaagacgccccagggcaaatgttggatcatagatacagaataacactgaacaacagcaggtacaacatctaatatggtacaaggtacgaagaacagattaagaataaatcactttcctaacactgtacctgatagaatagtaaagacatggttacaattggaaagggaatataggatggagggaagaagggagaacaacaaatgagaaaagaaagaaacctagatgagaaaatgggaagaaaaaataacaaaataaggatgaatgaataggaaatta

SEQ ID NO: 608361 - DNA, 309 bp, Homo sapiens
taaatacattggctggatctgcttctgcatgtccgccattccggcaatacgacctgcgcatacctggtcatttcgtcggtgctgccagatggccaagggagatcgatacgaaagatctcatagccatcgtcagcgccaccacagaatacgtgtatgggtaggctaatcccacatccaatagacccatgtattctgggaaacgagaccatgtgcctctgccttgggatcaggccaactgagcttcgcgtagacgaggagggcatggacgtgatttggcctagccagtcaccgtaagcgaggcaatcgaat

SEQ ID NO: 608362 - DNA, 838 bp, Homo sapiens
agcggggactcgtggctgcggcgtcagccttcttcggggcctcggcagcggtagctggctcgctcgcctcagccccagcgcccctctggctaccctctgtgcccagtgcccgcaagctgcctgccctgccctctggcctgcccctgacgccgtgcctggtgcctgctggcctgcagcccctgtggctcgcgtatcgcgcctgacctgctccctggccctgccccctatgggcccccggctagatggtgcgcctgcccgcccgccggcccgcgagaggcccccgatgctggccccggacggaaagccggtgctggccggcgcatcaccaatcaagccctacacaagtctggcagagggcccaataaccactagccagcagagggccgccataccgaggacaaaaccttgggtgggacctgcacgaacagaaagccctggacaggaagcctgcgacagccgtatgaccgaggcagccagcacacgaaccgcgggatgagaacagccctttcatcaaacccaagaaaacagcccaaaggatcgggccacaaccatacaagaggaccgaagtgcaccgatcgcacacgggattcatcaggaaggccatggagcggccggggcccaaacggcgcaggcgaggatggaggtaacgaacacaaaaacagtccaaagaataaaaaaacacacccactacggagagaccaaaccaatcaagttcggaccccagcagaaaagcccagacacaccgagcccacaagcgaacgaaccaaaagaccgaggaacatacacgacgaagcaccaagaatcaagtccgcggcagaccagatgcaggaaccaagaa

SEQ ID NO: 608363 - DNA, 304 bp, Homo sapiens
  misc_feature (17)..(17): n is a, c, g, or t
  misc_feature (105)..(105): n is a, c, g, or t
  misc_feature (199)..(199): n is a, c, g, or t
  misc_feature (229)..(229): n is a, c, g, or t
  misc_feature (293)..(293): n is a, c, g, or t
aggaaaccacagaagancaagacaaagcacaagacaccaacggcaacagggaaacctggaggggccagcaagaagagtgtaggaggcccaagcaaaccagagagnccaagaccatagccaaaagggcctttggaacctggacaaagctaggccgccggcaacatataaatccagcagagggctgagaagcatctgtctnccatcccacaagcctgtcccaagatatggnccaaaatttaaaaatttgttgtaaactgcatgttttagaaaataaaaataaaagatcgtttgtnagtcatcccaa

SEQ ID NO: 608364 - DNA, 183 bp, Homo sapiens
  misc_feature (30)..(31): n is a, c, g, or t
tcaataatagttttgatgcatttgccacgnnatcccaccatcattcggatttgttcaacccaatgctgcttcaaaaaaatggtggaatattgataggtagtatgagctatgatttcaccgtccggcgatattaatgtggatttatttccgcttgtcccaagatcaatgaccaacaatttattg

SEQ ID NO: 608365 - DNA, 175 bp, Homo sapiens
gtgaaactgaagctcagaaatgtcagcaagcattcccgataaacagtaaatgtataaggtaggactaggcttactaaagaccatagtcatattaaagcagcagcacactacggtgctacaagataaaatacagccatagggccaatggcaattgttgtatgaaacattgtaactt

SEQ ID NO: 608366 - DNA, 116 bp, Homo sapiens
  misc_feature (74)..(74): n is a, c, g, or t
tagtggtcaactgtatcattgtttggatgcagagagtcacagatcgctgttttttgagtcgaaggttgtcaatncagaaagtcatctttaattgtaccattcagattactggagag

SEQ ID NO: 608367 - DNA, 243 bp, Homo sapiens
tgggcttgattcaggattaaaaaactggaccggtgaaggtgacagcagtcggttggagcgagcatcccccaaagttcacaatgtggccgagaacttgtgatggcacatggtggttttttaaatagtcatcccaaatatgagatgcgtggtaacaggaagtcccttgccatcctaaaagccaccccatttctctctaaggagaatggcccagtcctctacaactgtacctgtgtagaaatagaa

SEQ ID NO: 608368 - DNA, 409 bp, Homo sapiens
acaatttacaaatgagttagtaagtaacataagtaaagaaagaatatcaagtagcaacagagataactcaaacagttacaaaagagattaggttcccaatcagtatcacaaaagctaattaaaagaatgtagcttaactacagtactgaggttgtcacacacttaactatacgagatactcttgcttatatattcatatctgaggttcactgtttcaactaggatacattccgcccacacccacaccttggtccccacatcaagcagctcctcacagcaggaagacatccgctatacagacatggttttctagaagttagtgcttaggatttcacaggaggaaaaattcagaggttctaatagccttcggtaactgaggtagaatatggagctcccaagaatatcttcc

SEQ ID NO: 608369 - DNA, 460 bp, Homo sapiens
cccacacaagtcctgaaccacatcttatgcccagccccataaataatattgaaaggttgctcatagacacttggtgctttctcatacaccatgaaaatcgaacctccccctctacgcagttacaccatcaatccccattacaacctctgacagctgccgccgtagctggatccctaggagtctgggtacaagacaccacttttagtactctttctcatcttttcactttgcatttccagttttgccttgcacaaggtctcttatcgctctgtggctcctctacctacatgtgtttacctgctaaatggacaggcacatgcacactagttttccttactcccaaaattcaatttgcaaatgagaccaaacagcttcctgttctcctcatgacacgaacacttcactactagttttgtttttcttattattaatatagaaaggcaggaataggcctcaactt

SEQ ID NO: 608370 - DNA, 194 bp, Homo sapiens
ggtgcacacctgtagtctcagctacttgggaggctgaaatgtgagggtcacttgagcccaagagatcgaggctgcagtgagccttgatcacaccactgcactccagcctgggtgacagagcaaaaccctgtttaaaaaaaaaaaagttgaaaaaatcacttgaataaaataaaaatcaagtaaacatgttagac

SEQ ID NO: 608371 - DNA, 222 bp, Homo sapiens
ggacaaaggtaaagctgccagcacatagttaggggatgaatgagtgtatctccttaaaaaggctgggacatttagttaaccttttgttaaaggttttttattcagttaacagcttaaattgaaacacttttgcttttcagttccctgtggaaagtttggctttattgtagtttaaggcttagagaaatttaaaggaaaaacacccaaccatctatgggcagg

SEQ ID NO: 608372 - DNA, 458 bp, Homo sapiens
atcgggatccctgccttctcatctccctcagatggacgtccttgcccccaactcaaaagcatcagggtttgcagaaggctctggagcagcccgctcacctggcggccacctcccaaccagctcagaggcgcctctcgcagttcagagggagcagcacacagactggaactgcgttacgaggagcagctactgagctgggcaaacgttcaaaatggtttagagaagagaaacctcctcagaaccaactccaggtttgccccatctgctgacagcacgaagcacttccggtggggccgtctgtctctcgttctctgttgctctcccctctcctctccccagtgcctgccagtgcggccgtcactccctgggggccctaaagccgcctccagagaggccctttgctcacagtttgcaccttttatctcttggcccctaaggggtctgagccgcacagccca

SEQ ID NO: 608373 - DNA, 217 bp, Homo sapiens
cacgaggatcatctttacttccccattgaagaggtatttgttttgcacatttgggaccattaagacgagtttatcccccactaaagataactcacacccccaaactcaccagtctaagggaaccttcacagggggaaactaggaggctccagcactgtcaggtcacactcctttctacactatgcaaccctctagggcttcttccagggctgttgca

SEQ ID NO: 608374 - DNA, 972 bp, Homo sapiens
tgttttttcgtggtcattttaacaacaaaggaacaaagtttgattacgaaactagttggtataaaacagggttatacatattttggtaagcttggtaataaaaacagtaacgaaaaaaaaaggcagtaactagaaactctccaaaaggcaacctactcaaaaccaacggggctgccactttgagcttgtggacagtagctgcataaactctggctccttcttgaaacagctattctaagtaagcatcatcaatacattaacacacatttctataaagtaagacacatgggtgctgaagtacaacctgggggcctctggatctcacctatgaggagaagtctctttacaaaaccacatagggcaaaattgcagcttgtaaggtgaactacacatctaacaactatgccagaggctaactagcattacagtgttcaaagctatcacgactataccccattttaaaccatctgggtacaaaacttctataacattttccctctctcttgctctcttagtgtacaaaaaatactctttaactatactcccccgaaacgtgggtcagcgactacgcatacaaattacgattccctaactacagtacaaacaactcccccaacaaagcatgggcaaagccattcctatacactgaccaacacgggtcacaacaaacaacccgtgctgcacaggaacacgcccagggcgggctctgcgccagcacactcgcggcccccctggcacggcacacacaagcccccgcacgctccaccaacacgcgcgccccgcagcaacatctagccccaatagccttctcccccgggcctaacagccccacagacgtggctccttaaccagggcttctaaatcgcgagagaacggagggccctacccgccccaaccgaacacgaaaccccaaaacccggcctacctaagaaggcgcctccacaaacacccggcgcccctcacaccgcaccg

SEQ ID NO: 608375 - DNA, 193 bp, Homo sapiens
gtcaaaggtgataaaatcaaagaacttcgagagaacactcataaacacacatacaagacttttacaggaatgactgtaactcattaacactgaacagagttgttacttattggaggaaaaacccgatagttgttgagagtgacataaagatacataacttgatacttatatactgagtactaccatacagagg

SEQ ID NO: 608376 - DNA, 178 bp, Homo sapiens
ggcccgggtgaaccaggtattctttttttaaaacaaggacctgggtttttggggggggccggtttaatcccataaaaaaaaaggggcccttaaggtaaagccaaacctttttttcctgattaaatggtagatgtagcctttccaatataattcaataataaaaagtaattaccctcta

SEQ ID NO: 608377 - DNA, 411 bp, Homo sapiens
  misc_feature (272)..(272): n is a, c, g, or t
gagaaagcagaatagtgaccaattcaccatgatacagaataaagggatttagctttatatttttagtcattgtataatagtatattagaacacatttcaaagacttatttcatgcccttctgataaatacagaagagtaagacacaactattcaaacagaggaattttatacaatgagtggttgaattccagcttagatcaaatgaattgtatcaatgtatcttgagacaatgctatgtatcaagaagcatttcaattgcagaatatatganttaaaagctcatttttctttgttgggtgcagtggttcaggcctgtaatcccaggattttgggaggccaaagtaagcagatcacttgaaccctggagttttgagaccagcttgggcaacatggcaaaacccaatctctac

SEQ ID NO: 608378 - DNA, 818 bp, Homo sapiens
gcaggcaggagctagggccggatgaggcagggcagagcagactgatgagtcgttggaacaaaatgactccttttttttttctcttggtttttccaagacacagtctcgctctgttgcccagtctggagtgcagtggcgcagtctcggttcactgcaacctctgcctctcgggttcaggccattcgtcgtgcatcagcctcctgagagctgggactgcaggcgcctgccaccacatccggttgatttttgtatttttagtagagatggggttttgccgtgttggccaggactggtcttgaagtcctgagctcaggtgatctgcacaacctcgagcactcccaaagttactgggataacaggcgtagagaccacggtgccaagactggttcctgatattaagagacagggtaacacccgtgtatcccaggtgggagtatagtggtgcacgatcaatgacgtgtactcgcagacttgaactactttggttccgagcagatcctccccactcagcccgtctctcactacctagggtgctccaggcgatgactcaccgtgaccagactatcgttatttcaaaagtgtcgcgtcaggagaggaatctctcttgtgtaagacacaggctgtaacttgaaactcatgaaaatcaaagtagaacgcatccggacaaacaccacaaccgcaaaagtgcgggggcataacagcacgtgagcaacaacgatccacatggaccaaacggaaaacacgggaaccaagtaccagggaaagaggcaacacgaaacagaaaaagagacggctgcacaagagaaccagaatacaga

SEQ ID NO: 608379 - DNA, 623 bp, Homo sapiens
  misc_feature (13)..(13): n is a, c, g, or t
  misc_feature (273)..(273): n is a, c, g, or t
  misc_feature (306)..(306): n is a, c, g, or t
  misc_feature (402)..(402): n is a, c, g, or t
  misc_feature (413)..(413): n is a, c, g, or t
gggagccgtgtgnttttgtaatgttctgccagtccccgggagtctgagctgtatcagaaggaggtatcccattctgaatgccctgtgaggagcgcttctcgcagcctcgtggacgctagtgccgagcggctgcctagtggcatgcgctgctactgaggtgacggtcgaatcctgcaaccatgtccggtgacatgcccctagtcgttcgtacagtagcagctaatgaagtctgcagtgacaggaccttgcgatagatccacgcgatgcgatgcntgcctgcggcgcgcatttcagtgaacccccccngtggcggaaacctccctatttttggggaaaaaaaggggggggggggccccccccccccttttttggaggggggggggaatttttgggaaaccccgnttttaggccancaagcgaaatcctccacattgggagtgctccgagggagctcggcgaccgatcgaggaagaagcttaataaagcttctggactctttgctgaaaagataaaatcaaagaacaaagggagagagagcgccaagaggcagcggcgaacgggagtatccgcgaggcggagaggcaggcgggaagcgcagagcagccgggagcgggagcaattgc

SEQ ID NO: 608380 - DNA, 432 bp, Homo sapiens
tctgtacaatcccttaaaccaaagccactttctttaatcctatgaaggctgagaaaggtgaggaagctacagaagaaaattctaaagctgacaaaggttggttcatgaaatgtaaggaaggatgccatttccgtaacgtaaagtgcaaggtgaagcagcaagggctgatgtggaagcttcagcaagatctaccaagatattgatgaaggtggctactctgaacacagatttttcaatgtagatgaaacatccgtctattggaaggagatgccatctaggattttcatagccagaaagaagtcagccacttatggtagctcgcacctctcattccaggattttgggaggctgaggcaggcagatagcttgagcccaagagttcaagagcagcctgggcaacatggcaaaaaatacaaaaattagctaggcatg

SEQ ID NO: 608381 - DNA, 408 bp, Homo sapiens
taacaacctttctttcagagatcaatccagggatctaatccacatgcccatggatactagtaggggttgttacagctgagccacaataggaattcgctgtttattattctttaatcaagaggacagtacctgccttctgcaaccacctctctatctactaacaccctcaccctgttcctgaatgatgtttttatcctttggaaagaacaaggctctgatgcagcaacttttgtttgtgtttcctgtgtgtctcttgtcacaagtgtatttgaggacattggatgcattcattttctgtaataaagtttctaaatcaatcttccaaaaaagtaaaaagaaaaaagaagacagaagcaaaacagaaaacataaaaacaaaaacattcctgctacttgggacatatgtatc

SEQ ID NO: 608382 - DNA, 168 bp, Homo sapiens
ctagaggactccgaaaatgacatagaggcaggttgggagcagcgggaaaacggtggttctgacatcagtgggtaaagacgtgtcatgtgggcctttaggcccgggggacaagtgaaatataaagatggggtgacatgcatcacactcagacctgcctctagtcatttt

SEQ ID NO: 608383 - DNA, 277 bp, Homo sapiens
ttggtagggtcccagggtccctaggcctccacttttgagggcagcccctttggtgccaagagctctcctccaactcagggttggctgtgtttctttttttctctgaagacagggtcctggctccagttggaacactttcctgaaatgcacttacttttcagcttttgggatcagattatcatcaccccccccctccaaagaatttttacgcaagaagagccaaattgactttttaaatttggtgtatgggtattaaataaaattcattttcaaggct

SEQ ID NO: 608384 - DNA, 1235 bp, Homo sapiens
cggctactctctctgtggcccctctactgtcccccgtgtttcttggggggtcttcttgagccgtttgctcttagacactgcagccccggcttggggagccgcttctgttctttggtcgctccctcctctctcccttgattgggccgttcccctggggccccccgggtccgtcaaagcccccgcgctcttggtgggccggcccaatgctcccctgggaatttctctgtctgtttgtgtgtttccccgcgcccaagtttaggggccccacccctttcttcatgggggaagtatccccaaccaaagggcccccttttttggggattaaccacccttgcggcgaaggttcaaaccctttctgttaggggtcttttgggatccagggggcttttcggggcgcccctgtcctgcgcccgaccacatgttccccagatttcttgggccccccataaagccccggggccttgttgtggtggaccctcgttgtgttaggggtgtccccaccgcgctctcctgtcccttccccccccagggatcccacggaagcccctctggcgctctcccccctcttcttatgacagcgctttttccccctcgagggcgcacagtctctctcggagatatctctgtgggccccccaccttcggggcgctctctgggggggacacacaggcgcccctcgcgctcttgtctcccacagcgccctctggcgctttacccgggcggaagcggagagacgccctctgagggctctctccgctccacaggcgccccactcttgccacttcttcttggccacatgctccttcggccgcgtgtggtatttccaaggcacgttttgtgaagcaccctcgtgaaaattggggaagaaagggagattggtggcccctctcgggccacaggagagggagaagggcactttgtgggaaagggccacggaagggaaagaagctgtccacatgcacaccacacgcccactggccacaggttggcctctttcttcacagcctctccacggtcgcccttgagagcccctctttgcaagggcggctgcttccctgaggcctagtttttttaacgtgaatttttgtaacacattcacatttttttgtaccacgaataacacacggagtttctgagctaatccaaagctggtaatttccccgcacatgtcttaattcttgcccttccccccacccgtttgttaatccaaccataaaaacatgttttttttttta

SEQ ID NO: 608385 - DNA, 315 bp, Homo sapiens
aggggggggggggggggcccaaattcttttccaaatttttttggggtttttccaagccctttggaatttttagggccccccggccccccattgcccctggtttttttgcccccagggggggggttaaatgttcccccccgggggtttttttaaccagggcccctttggggggcagggggtcccttcccccggcctggcccttttcccttttttctttggggtttttaattaaacaagggggttcccgggggccggggggcttttccccccccccccccccgtgggggttaagggggggggttttttggcccctta

SEQ ID NO: 608386 - DNA, 274 bp, Homo sapiens
actcactgtctgggtacaacgcgagactcttctcatagaataaaaaaaaaaagatcccgttttcctgcaaaggaaaaaatcctgtgtcctctgaatcagaagttggtgcctggtccatctcatgcctattggattgtccccagtttttcatgagtttttttttcttcttaaattcaaaatcctaggagattgccctcttttcttctctggacctatcagtcttcagcttgtccccatttatcacgaccttcttcagacaggtgcagcgtaaaat

SEQ ID NO: 608387 - DNA, 907 bp, Homo sapiens
gagggctttctgattcggtgtctcctcattttcttctcttgctggctgctatgtacgaacgtgcctttcgctcacccattgtgcatgctgagtgcttccccagccatgtgtaactgtgattggtcaaagcgaaagtcaccagtattctccagaattactcaaatactggttgctctctatctgagcctccctcttcatacagcctctgttttcctgtcggccgaagttagcctgtgctgagtggtaaagagcgggcaactcgggagaggaaggttatcgtctctgtgcgagtggccattaatgacacgctcctcgtgttgtgtgccgtctctctctccatctgtctactagaagagatctctaagatgtccttaggcaacatttacttggagggtccaagggctctccgtgtgtcacgtgactgccatcggtgtccccgtgatactgctttacacctctcgggcctgttaccacctgtcatccggtcgtttctcggaacaagagcgtccatgcctttgattatgactgctccacatgtatcagacccaggcgattgcagaatcagctgggagatgctggatagtattattgggcggcgtgtcctcgttgggacgttgttactttcccccttagcggtaagattggtccgacgttgaagtcctacaggcattaccaaccagtgaatggctcggccctggtcggccgatttttgtttgaacgccgagatgttaagtcgtatgacctgcctgaggatgcccaggacacggaggttgtcgcaaatctctcttggggcacaaacgccttcacggttagcgaatttgttgtcaacacctggagtatgttgtgcggcacccacacccggggtggcgttcaaagggtggcgggacacatcacacatgctcctgac

SEQ ID NO: 608388 - DNA, 756 bp, Homo sapiens
cttctctggtgtcttcttcacgatctggggttcgctctggcacctgtgttaggtgttgagatgctcgtgacactctcgtggcattagatactgctgtccttgtgatcgtgttccgctcttgacctgttttcttccccctttgattcccgcgttgtttggagctattccgttgccgtcttcctgctccagtagggccttttccctagcccagcctcctgttggccaggcctaaggctggtacaagagctggcaactctcactagatgtgtctgctatggccgagagaggtgccggaataggcagaggtatagcaccgttccccctatgaagagacgcgggaaaggcctacagtggcccacataattgcctgactcacacttcagactacctcttaatgcctgttggaagggactggagctagcatggactcccagtcgctggtggatgtaggaggccacagtgagcaggtggccccagctgggctttcccaggtcaggaatgtggagccccaggcaaaggtgcagcctattgcatcacaagctccaatccaatgtctaggaccttcaggccagtctgcgagatgaggttcccgtacgcttttacttctcttcattgaccaaatcaaccaatcactacagctgctctggttctgctttccaaagtagcccaggtcctgggccagatgccgggaggtgctatccatgagtgaacggcagtgtcttcctcacctggatgggtcccacacttgtgacctca

SEQ ID NO: 608389 - DNA, 615 bp, Homo sapiens
tcgtgtcaaagaacatctcccatcgaagggtcgacgattcagagtcatatcccttgaatattcaccaatccaactgtctgggcattgtttctctgtagccttggttctttgtaaagctttaaatctttgtctgcttctgaatcctctacatgttgattgcaaaaggataatttttttcctttgttcttggtacctttcactttcactgaaggctttccatcttgcttgtatgcaaatagcagccatgtgcctgcgcctatagtaatctctccatttctgctggataacgatggctgcagcccgtaactccaagtaccgctgcctctctaagtgagcacgccaggaagcttggagaagagcagctgcactagccataacaaaagcatccttctgcacagctgcatctctgacttgcttctgatttaggtaattcctccagaatctctggataataacagatgcttgtctcagatggaggaaatgctgcctacacagcaagaccctgaaccatcgctgcaacaatatgattctgcggagcacctcttggtgaagcagatcttgtaagtgctgtcgttcctgctcctttagaaagaccatggtttttccaacttgata

SEQ ID NO: 608390 - DNA, 846 bp, Homo sapiens
  misc_feature (134)..(134): n is a, c, g, or t
  misc_feature (475)..(475): n is a, c, g, or t
  misc_feature (481)..(481): n is a, c, g, or t
  misc_feature (532)..(532): n is a, c, g, or t
  misc_feature (536)..(536): n is a, c, g, or t
  misc_feature (540)..(540): n is a, c, g, or t
  misc_feature (562)..(562): n is a, c, g, or t
  misc_feature (579)..(580): n is a, c, g, or t
gctgactctctccccactattaccctattgtcctgccacatctccctctccgagagggtagagataatgatcaataaatactgagggaactcagagactggggccggcgtgagtcctcagtatgctgagcgccngtcccctgggccacttttctttctctatactttgtctctgtgtctctttcttttctcagtttctcatcccacccgacaagaaacacccacaggtgtggaggggcaggccacccttcatgtggcttcttgcttttgaccctgcaaagggaagaggcagggctggggattgaaccagactcaaagtttagggagacatcgagatctgatttttctagttgaagcataagccctataattcttacagttcaacatcgtcacactgagcacatgctggagattctttattaatgagagggtcaaaatcttcttctctttcttccattgacagtttcatagaaacnactatntttttgcacccaaatttcactggataatatgatctttaatggataatttcnttanaatnacaagtacatcctgtataaatngttgcgggaagtcaggnnccccaaacggagggaccggctgaagccatggcagaagaacgtggattgtgaagatttcatggacatttattagttctccaaattaatacttttataatttcttatgccagtctttactgcaatctctaaacataagttgtgaagatttcatggacacttatcactttcccaatcaatacccttgtgatttcctatgcctggctttactttaatctccttaatcctgtcagctgaggaggatgtctgtcgcctcaggaccctgtgat

SEQ ID NO: 608391 - DNA, 669 bp, Homo sapiens
  misc_feature (218)..(218): n is a, c, g, or t
cgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttgtgatggatggctgggtgatcttccntgaagatcccctagaaatgtttccatgaacagcatggatgtgtcattgccatgctgtccatgccttgctataatgtgagtgaccttgggtgccagtgagacatgtggtgccttgcatcctctgtgccccagtgcatgtgcttgtcttgatgcagcatgaactgtgccctgggctggttggggttggatgtgggtgaaaatgggccaaggggtgtgacctgcctgccagtgcaacgcctgccctggggggacaacatggggcaatgccctgcagaggacatgctgaccacgggtgggaatgcctccccatcccagcaggagaagcctggctccaggggccttggggcttgcctgccctgagcctctgcgagcatgagggacgtggagcgatgcgggtggaaaccaggcggtcagccagcctggaggaagcctggccagggcggaagatgctg

SEQ ID NO: 608392 - DNA, 892 bp, Homo sapiens
  misc_feature (211)..(211): n is a, c, g, or t
  misc_feature (229)..(229): n is a, c, g, or t
  misc_feature (238)..(238): n is a, c, g, or t
  misc_feature (257)..(257): n is a, c, g, or t
  misc_feature (260)..(260): n is a, c, g, or t
  misc_feature (291)..(291): n is a, c, g, or t
  misc_feature (325)..(325): n is a, c, g, or t
  misc_feature (328)..(328): n is a, c, g, or t
  misc_feature (340)..(340): n is a, c, g, or t
  misc_feature (348)..(348): n is a, c, g, or t
  misc_feature (359)..(359): n is a, c, g, or t
  misc_feature (362)..(363): n is a, c, g, or t
  misc_feature (371)..(371): n is a, c, g, or t
  misc_feature (374)..(374): n is a, c, g, or t
  misc_feature (385)..(385): n is a, c, g, or t
  misc_feature (396)..(397): n is a, c, g, or t
  misc_feature (399)..(400): n is a, c, g, or t
  misc_feature (402)..(402): n is a, c, g, or t
  misc_feature (404)..(404): n is a, c, g, or t
  misc_feature (417)..(417): n is a, c, g, or t
  misc_feature (435)..(435): n is a, c, g, or t
  misc_feature (471)..(471): n is a, c, g, or t
  misc_feature (477)..(478): n is a, c, g, or t
  misc_feature (501)..(501): n is a, c, g, or t
  misc_feature (545)..(545): n is a, c, g, or t
  misc_feature (565)..(565): n is a, c, g, or t
  misc_feature (567)..(567): n is a, c, g, or t
  misc_feature (569)..(569): n is a, c, g, or t
  misc_feature (579)..(580): n is a, c, g, or t
  misc_feature (582)..(582): n is a, c, g, or t
agcttgacttctattttctgtgtagtgaaaacaatgtcatttatttggtttttcacctcagccctctcataggagcatagaatgttagggtctttactccctaatgatgtctgattggcacatcaagagttaactctgccttctgggccaaattcgaaataaccagtccatttttccttttttttttttttttttaaaatgggggaatgtntctcagcacagttgcggnttcctaaanccctgaaagcatctggtgnttnattatactcggggtgtcactcactggttgantgtctgcacctacgtttccacctcctccccctcnttnagccagcctatngataaccntaaagattatnaanngtgggttnggnatctcgttaanagacagaatgnntnncntngtagtatttctgntagcattcagcgctgctngtgggctaacaccactggtgttttgttccatcatgngctctnnaggtcaaaagcctcatttaattnggggggattggattttttttttttaaagagaagaaaaaaaaatngggcgcgtgaaataaagggngngntttaaacagnngnggctcttagcttttttcccaattaggccatttcacagggtcctggtttgacacgggccacggagggtctcgggttaaaatttaaataggttgcattgagaacattttataccccattgggtggggttggaaattggtttttcaaaggcattatggtataaaactgggaattggggcatataactccccggttgatacagaaaggggtcattttctcaataggttattttgactgggggcccgggaaatttggaagtgttaggtgggttctgggagcaatttttttgaaagaatttggggctaaggggata

SEQ ID NO: 608393 - DNA, 664 bp, Homo sapiens
  misc_feature (135)..(135): n is a, c, g, or t
gactgtgggtaggctgcgtgctagcttcggcgcggatccctgggcgtccgtacgtcggagtccttcgtcctccagggtcccgtgttctttgcgccggagcgggaagccagctatctctgcactcgctggggtttngttgacatggctggctttcctcaaaatgagtgttagtgtcaatttgcttcagacctttcagcaggtttttggtgccatttacccttcataggaagagaaataacttaacaatttgcagagatacagtgtcttccgaaaataccagctgttgacttatcctaaaaagtgagagtacacccccttgtctgaagagctagagtgggataacgtggaaaactaccagtgagaatctagtgtgcgagaagaatgtgtttcagcaatctcaagcagtaaggatgaagatccggtcgtagctgccagcagagagtgcatggagatgtggacgatggttggcagagaagtagcagagcacatcactgaatgaagagctcaaaaccttgatggaatgtgtttctaacacaggaaatataaattatttaaaatattatatggcgaaggaaaaagtgaaaaaggtaggcaaataacaaggaattgacacggggtgtcagggacgaagcgaaaatatcaagcctgctagaaacagggggag

SEQ ID NO: 608394 - DNA, 460 bp, Homo sapiens
tgactgttgtggacgtctctagcaggatccccgacggtctgtacccttacttttatgcaaagatacaggcaagtaagtctgacagcccggcagattactgttcctcagatttccagtacaactaatttagtcttatattacaattcaaagaccggtatttccattataattattattagagaatgaaccaattatatttttcttgtttagccaactacattgtatgttagtgtaatgtgaaaaatagattactgaaagttttccaatctttattcttactgacttttggtttccagaaaagcttagacctgtaaatactacgccccaaaaattctttactaactgcggtaacagaagatcttcaataatcttaaagggctttcttcagcagccggattactatgaatcgtatcctgacggtgggtctattcccctatatgtataccgtaatatatctgta

SEQ ID NO: 608395 - DNA, 100 bp, Homo sapiens
ctggagtgatccccgggctccctgccatgtactgtgcccttcaacgtgtatcaggcacggtggtgcatgctttcaacacgaaaccatctccttgtaaatc

SEQ ID NO: 608396 - DNA, 165 bp, Homo sapiens
  misc_feature (9)..(9): n is a, c, g, or t
  misc_feature (15)..(15): n is a, c, g, or t
cagaggacncagctnacgaggatataataaacaagctcgaggtccccttcagatctaagaagtgttaatattctaaactgtcagaattataatctttcttttatataaagtttaaataagtaatattttggcagtgcctcgtaagcttggaatcctcagagcacc

SEQ ID NO: 608397 - DNA, 233 bp, Homo sapiens
gtactgggtgttacgtctgtgaaacatgaagtcgtatttaaggactgcttctccctggatccacatgagctttccccatcttagttgttttctaaaagataaaaaccacatagccacgttgtagttagacctagtaagtatccgtgcttgcttaacaagacaatttcagtttggctggctcaacttcaatatacgtgaattatgtcataagtaatcttttgaaacaaggtaat

SEQ ID NO: 608398 - DNA, 918 bp, Homo sapiens
cggacggagccgtgcgagttctctaccctgcttcgcgagcgggcgagcagaacgcgagtcccaggatccccggcattccagttctcttccactgcattcccccggcgcgtgtgggaccgaggtggacatggatccgcagaggtcccccctattggaagtaaaggggaacatagaactgaagagacctctgattaaggccccttcccagctgcggctctctcaggaagcaagacgtcaagaggaggcctgaccagatggaagatggccgggagcctgagaagaaacggaccatgaggccatgggtgcgacgagcaaaattaccacatcccacccaaagagtgccatccctcactacagtgccacagcacacagagggcagaccacagctcacaaggtttccaagaaggacaaggaccccggtgtaccacagcgtagttgccacagggcttgaggagccagaagccaggtcctgctgtccctgtccagaagtctggcacatgatggtgtgcctcccatggcaggagggcaagaacacccaggcaaacgttcagcctgggacttacagggtcagccatgtgacctagatgcagcaactaaaacggtgccgcgagaggactctagggtggaccaggacggaaccagcagctgtcaggaccagctcaggagatgcccagcagccaggtcaggcccggaggagcagagcgcacaccacctgcaggggtcctgcagccaaggttacgggccaaggccgaccacggcacacaggagctgaaagacctgccggctggtccggaacggaacacggggacccgccagaaggcctgcgccccacccagacacgcgactcgcgaacggcacatgttcaacacaacaagaagaggcaacaccacacacgacaccccaccgggcccccaaaac

SEQ ID NO: 608399 - DNA, 1583 bp, Homo sapiens
ggctgattgagtgagcgcgcccaggagtctacatgcctactctgtgtcgactctggctctagcaatgctcctggcagtagagcacaattttcccagacaaccactggtgcagtgatggacaggtgcatgggtgcaattagtggcgtacgctactgtgcgtgacgcatccgtgactgcgtacgaggatagctagtaagtgaagcattgacgtccccattcacggttgggagcgtacacagtgaccttgcttggtcgagttagcgtcggaaaaagagcgtgctagaccaagtccccctagcgattagtacccatggtctcatgctcaacctccagacgagacttataggccgcattcacaagtcctcattccactgaacaagacttgcatgacaaacttaccgcacatcctagttagtgagttggacaaaactaaatcctggcaatttccccgccactaggagttgggatcgctacccagatcctaatccgcgaggaagccttgacctattggggaaactgtttgagttaaggccattgaacgattgccatggccaggcgggtcatggggttggaacacctatttactttgtaatcgaacccatcctttctattgttcctcgtggacaataccaatttaccagacacctcgaagctttttggaagggggcacctttggtcccccattgccctttgttgcaaaccattacaaaattgggccccttactatagaatttggcacatggctggaatcaaatgtgggaccgctctttcctaagcgccttgtgaaacttgtagagcgcaaacgccaaaccatggggaaatagacgcccgaatatgcaacggtctagggcgcacgaaggccgttttgtcaatggcaaatggcctaagggctccctccaaggttggacgccccaagcgaagaaaaagtccccccccgagttgcctctgttcggacacaggtggcttccacctgattggaaagttccttggtcggtgagtcaacttacttccccgttgggtgattggggggtcgctttaatcatggtgtgcgcgatctaggttgcccacggtcctggttcccccttaacctcgtcaaagtaccctaggtgttaggacctccctttcccacgcaaagggcgaagaggggaattggacccccttgtgtgttaaccaaaacccaatgggttcttgtgtgcagacgcccttattatccccctgtaagatatcggttatggcgcttttccgcgaaggaaatccgcgcgcatgggtttttgccccccaaaataccctcagagaggaaaaatgcttctggaaaggaggagttgcctaccgtggacgagccggctggtcacgttgcgccatgtttttcaccgagagggtatgccaaattgccaaggcctccgtgtgtgccaatttctagtcggacaccccgaccccccctgttgaagagggacaacctctcgccatttggacttgtggttgagccctcgtgttgtgagaatatccaaccgcccagattatcacgtggggggccaacctcccaagtggtgtggcgtccccattgacacgacggctttcgcata

SEQ ID NO: 608400 - DNA, 852 bp, Homo sapiens
cgcaatgagtacgttgctgtggtcgcggcacagacgagcatgtggtagatgtcaattcaaagtcttgattcatatagagagctggaacatcaaatatatatgtttatctatcattatgctacgccagtcagtgctataaatttctgtatgcaaagaaatgttcgttaaggtgtcattcatgtttcctcagagtgacgctttattggtatgttgtataataccatatgtagtgaagactcggcatcattattccatgaaccagttctaatgcaaacctatgtatgtccattagaaatggaagttattttttaatcaacaatgaggcctattataaatttatcagatgaatctagatagctttatagcatataaaatatgtcaattgtgttagcaggtgcacatttcaccactgaaattagaaatatttgacagtctgttctgcataccattctgagtctacttttctgtctttagaagaatcgtaaatttcagtgtcctttatttgactcaggggatatagctgtataagtaatagggcccaagatgtgcagtagagtctgttaatggcatttcactgttcattccctttacaccggttataacaactttccttaatgtaattatcagtgcacggctatgtattctcatgctaaactccggggttaaatagtttccctacaggatcctcctggaggtggggatttgcgatactagaacgggtacgtcttttccacccctggagcgatacatggccccgcaacctctcgcactacacctgtcgccttccattcggtcccgccctttcccaaccgggctcgcgccaagggcggtctcacacgcgccctcaaaccc

SEQ ID NO: 608401 - DNA, 826 bp, Homo sapiens
tccggcaatcagagctgcccactactgtgctttgtgccagtgccccctgtgtgctgctgttcctgggagctcagtgcctgctggctgctgggaggaagcactgcgtggcacaacaatgtatgggtgtgtgtgtgcacagcggcaccagggtgtcatgtgggcctgccaggctggcgtggcggcgtgggctgcggctcttacctgcctgaggaggctgcctggctctgcgtgttgctggagttgcgcctggacttcccagcttggccagtggctccgcaggctgccggctccacccctcagattcatttggattcaaggtttggctctcaacagtgccagctgcactgtcatcctaaagtacttctgtggaagagaacatggtggtgtcactgttgtaccagtgatgacacaaaatcccagatctacctgacgggcctgcgaggcgttgaagattgtgaagcaatagcctaagggactggctggcttcgagcagggcatcggaaccaggcctcctggcactggcctgggtagagccaggccgagcaccagatgacccccagtggaaccctgtgacagtcctgccagggcccaggccatcccaaccgacttccatctcatggaccctccagcggagaagcctgggagaggctggcgggactggagatcaaacccaagttgctgaaagtcacgcacaggcgagttctccctggagtccatcctggctacctgaaagctgcgtggactgggaactggctgacctgggctgcctgggagagtgcctgggcctggagtggctggcacctatcaggcaacgcgcacaccaaca

SEQ ID NO: 608402 - DNA, 125 bp, Homo sapiens
ctgcgagttgttggtctgcgggttccaattacagtttgcgcagccagggagacctcagccagagggggtgcctgagggtgggagcgtctgctggccctggtctctgaggcaggcatgtgtctgcc

SEQ ID NO: 608403 - DNA, 1315 bp, Homo sapiens
  misc_feature (117)..(117): n is a, c, g, or t
  misc_feature (274)..(274): n is a, c, g, or t
  misc_feature (304)..(304): n is a, c, g, or t
  misc_feature (323)..(323): n is a, c, g, or t
tagtacccaatactaacttggaaaggctattactaatgcttagcgacctgaaacataggctgatcgtaaggataccagattatcagcgacaggtctcaactaacggatggtgaggcncaccgtacaggggcatgagctaacacattccttatcggtcaagagcagccaataataacactcatctgcaacctacagatgcagcacgccctaatagaccctcgtgctacatacattactttattaccacttgctaaataaccaccagccactcagnaccgggtatgagctcttggaccaactccgncatctagtcttcacctcantgaaatcacactccgcgtgccccccactgacactcaatggccgctcttcagcctcgaacattaaaacacatagtgacacgcctcttcatggaacatcttcttaacgctccacccttccttcatgcccttaacgtcccgtgcttccgtccaatacgtcgcttcatgaagttccggggaggggtcgcagggcaagtcaagggaaaatccagagatcttgaacagccacgctcgtaatccgcgtcgccatttaggcgaaggggaaatcatgaactcacacaacacactgtgccagttcacttgccacaggttcagaaaccccttaagaccccaatccctatctttctccatttaactacacatcaagtccagcgttagattctatactgccttgcgtactctttttagaggaggggctctaatcaaatttctttcataatctaacaaaacaaaatgtgaataccacaatccattcaaggaactctcaccctgtggtgaaataaaccactgaaatcacctaaagagcgcactcacatcattgccagttcttaggcaatccctgtcccttaaaatccaacaaggacccagtactctgaacattccgcctcaatcttagatactctctcgcctttgtataaatgaggtaaattcaagtcctttcatgtacttcaagaaggctttaccagagcgatccgaaaataacggggccagacaagggcccccctatatcgggacccataatatcctttccaagtaaggcgccgaaaacataaccagcggaagaggcgggttgacgtgcattacaaataaaacaccaagccctttaggagggaggcgttaaacacaactcatatccaccataggggaaacccaacccaattatagaactcggccacactacatgcggcgctggcaaaattatagaagacgagagcgcttaattattaagggcagcccgaagaaaacctgtaccgttgttaaaaacatcccccggg

SEQ ID NO: 608404 - DNA, 256 bp, Homo sapiens
gttgagactgcaatgagccatgttccattctgggtgacagagggagaccctgtctcaaaaaaagaaaagaaaagaaacatactcttcttgtgttgactggagattttttccacctctgttactttttttatgttccagttttccatagttggtagaatacattagaataagcgctatctagtcatatatgaaggtatgtatatatctagtttacatgaagctatctagtttataagcaccagagaatcacagatat

SEQ ID NO: 608405 - DNA, 343 bp, Homo sapiens
gattcaatcagatgcatgaacacttgaagtactttgtcataaatgtgaggattaggccaaaattcacttctttttgcataagggtgtccacatgttccagtacccattgctgaaaagctatactttctcactgaacggactttttcacttagtcaaacatcacttggcatttttgtcgggcactatttctggactttctcaccacgtgtccaagctctctgtcagggtaacttgtaaaaacaccaggctcaactcacacatctgaatcaatgaaccagtggttgggtacctggtttattccgtgatcataggttgcagaatgtgtacaccaggctacaccaaa

SEQ ID NO: 608406 - DNA, 219 bp, Homo sapiens
  misc_feature (1)..(1): n is a, c, g, or t
naagctggatccgagccgcgtcttcgacctacaccacagctcacggcaacgccagatccttaacccactgagcgaggccagggattgaacccgcaaccacatggttcctagtcagattcgctaaccactgcgccatgacgggaactccatcaatttgcttatattttgttaaggattttcacatctgtattcacaccgcttttgtggtgatcctctaga

SEQ ID NO: 608407 - DNA, 1206 bp, Homo sapiens
ggccacgttcacccatggcgtaggaccgccaaacagctactcatgctgcttaagctggcccagcaatgtacagaccagagacaaagcaagagaagaagcagagactgttggcccgggtccgagaagaaggctgctggcaaaggggacgtcccaacgaatgagaccacctgtccttcgagcatggatgttaacaccgtcaccaccttggtggatgaacacacgaaagctcagctggctggtgattgcacacgacgtggactcccatcgcagctggttgtcttcttgcctgcgcctgctgtcgtatagaatggagtggatccctctagctgctattcatcaacgggaagaaggcaagacgtggagaccgttctatgtccacagtgaagatccttgcatccatctgatcgaccgttcagcacaggatgcaaacatccgtgcaagacgataagcgcgctttgtgcttagagcctggctgtgataggctatcagcgaccatattacatagtgtacagcatacgagtgagatccgccgatcaactgtgggtggcaattgtcctgggttcctaaggtctgtggactcgatatcgccaagcctcgtaaaaggcaaaggctaaagcaacttaccacttcaactggtgttaaatgttacactgtgtgagcttaactgtaccagtagaaatttagctctgaaatctacattccgaattttgtccttccggaatctcgagcatcaataacccccccgagggcccttcaaatgttcggcagcgcgggaaaaaacgaaggcgaagcgccttgcggccctcgtgtggcagttaacccatgttccctgggaagcccagctccctctcttggtctccaaaacggggggtaaaattctagacagggatctccccgtaataagagaagactcgctacaacgacgcagaaaaagccccagggttaccccttggcttatggaaaacgacgacaacgcagaaaggcccctcacagaaggtaagagccccaacggtacccactcaacccgacaggaccgctaacaaagagcgcaacaagcaccaaaagtggatggcacaaactggacaagcaacatggaagaggaccacaaagcaagtcacgatcactaacacgggggcccacgcgaccaagaaaccaatcgaaaccgacatcgccccgtacccggcagcccgccgacaccaaccacac

SEQ ID NO: 608408 - DNA, 982 bp, Homo sapiens
tctcgggtgtgggcgcatctctgacggttgtgggttcccccagaggcgttctagggcgtccagttgcccgggcccccggatggttgccgccctgttgtgtgacccagggcgttccgagggccttttagtgggattccttgttggggttcacgaagagattctctcgcccgggttgaaatgttggaggctgtgggtccctgagtgtgccttttccccagcggggtattctcccctttggggcgcgaattttttgagataattacgggtctgtttttcgtgtctcgctccagttccgggcaatcctttcccccgggagagaggtgccctctttgaattccaacctttgggtggctccaaggtgatgataaccccccattaaggtcaccaatgtccccactaaagagggccacaacctgttttatgattcccccggttttaaatttttataaacatgaaattggtgtccaatctataaaagcgccgcaagtttaccagagacacaatacacatttctccaaattttttgttatgggtagacagataaatgtagtttctgacaaccgtgtaatagaattttggggtacaaaagtttgtctccaattcctttccccctttcccattggaggcacacaaagctcttatttcttcaccacatgacaacatacaatgtttgttgtgacacccatgttactctccctggcaccacctctttttccaaccgtaagagtttcccataccaagaacagtttaaaaacaccctggggattttattctgcgtgcgaacacccatcatatggtttttcaccacttttttcaatcaatttatattcattgtggttatatttaaaatattttccccgcttttttttttttaaaccttttttatccaaaagagctaaaggttttttttaccaattttaaatttttacccctaaaaaatggaggtttacccctatccatacatccctttgtaaaattttta

SEQ ID NO: 608409 - DNA, 117 bp, Homo sapiens
atgtctctcgccaacattgtgcctccaatgcaggcatggcactggacattcatgtagtcaccgagagcaagcagccccttctgggatcgtgacagccaactctcttgtttgggagcc

SEQ ID NO: 608410 - DNA, 1159 bp, Homo sapiens
  misc_feature (515)..(515): n is a, c, g, or t
  misc_feature (1159)..(1159): n is a, c, g, or t
gtagtgtgggtgatatgttgtggagagagatgggctgggctgtcagtaatagtccgcggggcgatggtcgcgtcgttccagttccattggtccatccgatttctggatcacttcacctagcatactaaggcctaccactacataggttgtcgtgcacagttaccaaggctcgtgatacgccccagtgttacactctagttgctcactaccattgactcatactatggtggtaatatggcttgagtaccgctaacacttgcagtcaagaagcgggagttggctgtgcacatcatgttgtaattggacgaccttaaacaagtgaatttccattgggggggtcgggagttagtggtgtgtggcatacacacagcttttggtgaacctgccatagggtggagtcagctcaggggtaaaagtctcagtaagcagcacatagttcggagcttgttcgcttagagagtgattttgagcaattgcatttagcagcactttacggtcacacccactcagggagntgtgagcgctgggagaggccaccgatactccttgacttttcattcgagacaatgcggggaaactcctggacgcgaaggaactcacatgggatttgtcttaactacacagggacacctggaattgaatagtgcttaccaaagagcacatcccgcgtcacaaggtggatagcaggttaccgagtaccacatacatccatgttagcttgtcggggtactctgcaaagcacacgtttgggagtgacaaaggcgcgtaaacaagacatcgtctacagtatggaggtttagagtaggagcaggacgatcggtggatctagttggtagacacatggaaatatcgcctcccgaaacaggtcggataacttctgcgcctcagacaaacatgtgttcgcctaagggggcacgaaggaccttggttatggacttttgtatcaggcacactgtttggcaactttaccaatttcggttggaactccgcctaagttcttgtggcagacagtgtgcgtgggaagatacatttagtcagcaaaacgttctatcaatagcgtatagagacaactacattacttggcacacaggaagcacattcaacggaggacgttcgccccagaggcacagagggaacaatgattacggtatagcacggn

SEQ ID NO: 608411 - DNA, 203 bp, Homo sapiens
tgctgtgacatcatcaccgtctgtgtgatgccatcgccgcgtacgcgtgacattcactatgtgtgacgtcgacatggcccgtgacgtcgtcgctgcatctcggcgtgacgtcatgccaagttccccatgtctgtgtgcgacgtgcagcatctgcacgacgccatcgctatatctcttcggtgacgtcacatggccactcaata

SEQ ID NO: 608412 - DNA, 234 bp, Homo sapiens
cctgtactgagattgtctaagctgtagatctgcttactgtaggtctgtctgcactgtaggtctgtctgagctgtaggtctgtctgaccttatggtctgtctgcacctgtatggttgctctgacctgtagatctgctctgcagctgtagatctgctccaccaactaagaactggcattgagcaccacccactgtgaatctgatgaaagagctgatctacatgggtggtacctgat

SEQ ID NO: 608413 - DNA, 196 bp, Homo sapiens
caatgctactctaatatttcctctgtctccagctgtttcatgactccatccctgccatgtgtgtgccttaccatctttttaagcagagcacaggcctgggcagtggctcatgcatgtaatcccaggctttgagaggattgcatgaggtcaggagttcaagactaacctgggcaacatagcaagaccccatgtctac

SEQ ID NO: 608414 - DNA, 470 bp, Homo sapiens
  misc_feature (432)..(432): n is a, c, g, or t
cagagttggtgcacagctctctctctgagatcagagtctgatcagcagctctctcctcaggaccagaagcctgagcttatcccatggagctctgccggtccctggcctgctggggggctcctgggcctgatgtctgctgatgctttgagcaccgattctggtgagctgtgggtcccacccactcagctactcgggcctctggcaacagggcatggggacatcatatcaggctacatccagtgactcagacttcagcatatggctgtctggggcccgtgtcgtgagcttcctggtcctgtctgcttcgcccctcactgttccccccaggccacggcccgcttgtctcaaccaccgcagcctttgctgcagccatctccatggtggtggccatggcggtgtacaccatgcgagcggtggtgaccatgcctccancacccccatgattccagacgcttcttctttcctgtgtc

SEQ ID NO: 608415 - DNA, 897 bp, Homo sapiens
  misc_feature (37)..(37): n is a, c, g, or t
  misc_feature (41)..(41): n is a, c, g, or t
  misc_feature (89)..(89): n is a, c, g, or t
  misc_feature (92)..(92): n is a, c, g, or t
  misc_feature (107)..(107): n is a, c, g, or t
  misc_feature (128)..(128): n is a, c, g, or t
  misc_feature (140)..(140): n is a, c, g, or t
  misc_feature (143)..(143): n is a, c, g, or t
  misc_feature (148)..(148): n is a, c, g, or t
  misc_feature (152)..(152): n is a, c, g, or t
  misc_feature (160)..(160): n is a, c, g, or t
  misc_feature (169)..(169): n is a, c, g, or t
  misc_feature (188)..(188): n is a, c, g, or t
  misc_feature (198)..(198): n is a, c, g, or t
  misc_feature (207)..(207): n is a, c, g, or t
  misc_feature (217)..(217): n is a, c, g, or t
  misc_feature (224)..(224): n is a, c, g, or t
  misc_feature (243)..(244): n is a, c, g, or t
  misc_feature (252)..(252): n is a, c, g, or t
  misc_feature (254)..(254): n is a, c, g, or t
  misc_feature (256)..(256): n is a, c, g, or t
  misc_feature (259)..(259): n is a, c, g, or t
  misc_feature (266)..(266): n is a, c, g, or t
  misc_feature (268)..(268): n is a, c, g, or t
  misc_feature (271)..(271): n is a, c, g, or t
  misc_feature (280)..(280): n is a, c, g, or t
  misc_feature (284)..(284): n is a, c, g, or t
  misc_feature (301)..(301): n is a, c, g, or t
  misc_feature (316)..(316): n is a, c, g, or t
  misc_feature (324)..(324): n is a, c, g, or t
  misc_feature (328)..(328): n is a, c, g, or t
  misc_feature (339)..(339): n is a, c, g, or t
  misc_feature (350)..(350): n is a, c, g, or t
  misc_feature (369)..(369): n is a, c, g, or t
  misc_feature (371)..(371): n is a, c, g, or t
  misc_feature (403)..(404): n is a, c, g, or t
  misc_feature (434)..(434): n is a, c, g, or t
  misc_feature (438)..(438): n is a, c, g, or t
  misc_feature (444)..(444): n is a, c, g, or t
  misc_feature (460)..(460): n is a, c, g, or t
  misc_feature (464)..(464): n is a, c, g, or t
  misc_feature (529)..(529): n is a, c, g, or t
  misc_feature (535)..(535): n is a, c, g, or t
  misc_feature (597)..(597): n is a, c, g, or t
  misc_feature (610)..(610): n is a, c, g, or t
  misc_feature (615)..(615): n is a, c, g, or t
  misc_feature (634)..(634): n is a, c, g, or t
  misc_feature (657)..(657): n is a, c, g, or t
  misc_feature (798)..(798): n is a, c, g, or t
  misc_feature (889)..(889): n is a, c, g, or t
tttatctctggcggccttgtagtcgtctccgagactncccncccctccttccctcttgaccccctaggtttcattgccctttccccganacnactatcatgaccccnaggctgccggtgttgtctccncctcggtggccncgnctgtncctnctttcgcngctcctgcngggggcggttcctggcccnccccggagcngcgctttcnacctccccgncctcccncccgtcaacttctgccacnnagaaaaananancgncgagctncnacnccgaaatanaacnatttgtcaacacacttnattcactggaatcanttcttccntatnaatacacagcntttgatttttnccaaccatcacaaggaaancncccatctcaaaatcttggtcaggtactattcnnggaaagaattgaaccttcaccatataactntacntttaanaacaaggagacctgtnagcntcgtcttcgtacaaaaacataccatacacagaaagctcgaagacaaacaaaacttacaattcttnccaaanaccatgttattgaattatcaacatcactggattctcggataatatccctctcacgtcgtgtnaccatcgcttgangcatngctcaccagcgttctgctnatcctgggatttcctattgggcnggtcacattacagataaaggccatgcaaaagatgcctgtgttattagttcagatttccatgaaagagatacattttacatcttcaaccatgttgacatcaaaatatactatcatgttgttgaaactgggtccatgggagcnagattagtggctgctaaacttgaaccgaaaagcttcaaacatacccatatagataaaccagactgctcagggcccccatggacataagtanaaggatct

SEQ ID NO: 608416 - DNA, 293 bp, Homo sapiens
tcgcgaaacgtgttatcccacatatttcagaatgaaaaaaattaaaatatagactataacaatgaacggccatatttctttaataagcacgaatcatctttcaaacattattctgctgataagacttagtttttacttccctgaatttcactgccaccaataatagcacagtcttttccattttttcacttcaatttcagttctgcaatggtccatcatattccatatggcgttcaatcattttcaacaggtacacaaagggtcacacatttatccacattttcaacacgtgt

SEQ ID NO: 608417 - DNA, 227 bp, Homo sapiens
tagtgaaccaccattttaagtgtaccctataagtcggcaggccaactcgcgcccttgggaaaaatcactggtccataacagaaaccatgtgttacaaaacgccccaaaccagcccaaacaccaaccaaaaaacccaaccactcaccccggcccgccacccgccaccgccacccaccccccacaaccacatagcagaaacacaacaaacgagaaaacacaacaacaag

SEQ ID NO: 608418 - DNA, 116 bp, Homo sapiens
tgtaccgactgagaccagagagagagggacacggagacagagggagacagtgcacaaagagacgcagagagaacgggacctcaatggtccccttttcctggcgatactccagtggt

SEQ ID NO: 608419 - DNA, 436 bp, Homo sapiens
agaggagccccacctcgcacctccttcacagtccccttggccccctttgctgcgcagccccgcattggcccagccctaggggaggtgatgctctctagtaaaaaggagacaagagccgccaacaatagaaagacaaaaaggttcatctataccagctccagcaaacaagcacgagcgaaatcttacaatagtagaacagcagcaattcaatcaaagtacaagacacacataagggacaaagtattacacaaaatacaacacagaatcacacataatattacactccattaattcttcaactaaaacagagactaaagactaataaaatcaaaccaaacaacaagaccacagacgacaccacacagtaactacaatctcgacaacaagatacagccaacccagacacaaaccacgacacaaacataacaccacacag

SEQ ID NO: 608420 - DNA, 235 bp, Homo sapiens
  misc_feature (3)..(3): n is a, c, g, or t
gancaagagctgacgcagtgaatatctttgtcacctgggtctttggtagagtgttgaattcgccccaattccacgttttgacgggctcggaccaattttgactgtgaattccagtcggagggtctaccctcggcgtagggccggccgacagaacagggaaatcctccagcagatgctgacctggcggaatccgatcggactggtcgcctgaaccgcgaccgttgaaaactctggt

SEQ ID NO: 608421 - DNA, 130 bp, Homo sapiens
tttttttttggcggggggggggaaaagttttacaacggttttttatgaagcccggtttttaaatgaaaaaagacaaatgtgttttgtgggggcaaaataaaccaataaatgtttttttttttccctttta

SEQ ID NO: 608422 - DNA, 193 bp, Homo sapiens
aggatccccccggatatgtaatactgtattttggacaggggcaggttgtgcggcagactataaaacataaatcacgtacagttacagcttttatggcaccctattgtgtgccttataaatgttgcaatccatatcacgctgcagtggttcagagctattggaaatcaggggaaaaaatctattcaaaagtttt

SEQ ID NO: 608423 - DNA, 413 bp, Homo sapiens
  misc_feature (413)..(413): n is a, c, g, or t
ggaactactctgccgtaggtggcacacgcatcagccacgtcacagcagtgcggcattcattaactaccttgacttagagtatggtaatcccttcatggtcattagcctgtagtagctctctattccgtactgtccggacacgctcataagctgacccatgtataccttcatgtgccgaccattggtttgcccaccattgtggcttgcacccatagtattatgtggatgaatgctgctcttactgaagccgatatcagaatggggttattactgccataacactctatccgagcttggatatcgactgacagcttgacccaacgcacgctttagggactaccggagacgcgcaggatgacgctgtgatcatagtacaccagacatagcttcagcggatggtccatatatctccn

SEQ ID NO: 608424 - DNA, 682 bp, Homo sapiens
agcggaatgcctcggctcctggcgggagtgccggtggcgccccgcagtccgcttgtccggtacttccctctctgactactcctaacccggagcctgtctctgcagaggtcacggggaggcagggagggcccaagcacgacgtcccacagtggacagcgggagcggcagcgtactgggttcgcggagcccccgagcccccaagggctagaggagcgctcgggagaccaaagaaagctccgcgagcggctgcgcgcccatcaataggtgcggggctcggagccgacggcagaccgtgcgccgtcggctgcgcctaaggtgcgatacagcccgagcgtacggagagtaccgtgtgcccacgagtcacccctgagaaccgccaacggcgcagatcaccctgctggctgatggcctaacgtctggccacgaaacgggttcacaccgcaaaatgcacgcacggcccccgcaagagaacaaggcgaaccagcgcgaggtccccacagtcctccaacacgggcgctgcgtacagaaggcgcaagacctcctcgcagaagcgaagacccacgcatacacaacgaaacgaacccgccaaggccgcacggggcccctcccacgactacagcaattgtacacaccaacactctgaggcggatgcttgccctggctgcacccagacccctgaggg

SEQ ID NO: 608425 - DNA, 114 bp, Homo sapiens
tcaaaagggccctggtcaaataagtggatctcagtttttaagagtcacgctcttgtttcgtgtttagtccgtaagttaccatgctaatgaggtgctgcacgatgaggtgatctt

SEQ ID NO: 608426 - DNA, 281 bp, Homo sapiens
tgaccatatactctcgcccctgagaaaggattgcacatttctcaaaaatcaggaatgcttatatgtgtggcactatttctgggttcttcataatgttccagtgacctatgtgtctatccttgtgataaagccaatcagtctcttgcttaggttatgatgagtccttacattgaatagactgattcctctccctctagtcttcttttatcaaaagtgctttgactgaactagaaccttgtctttcttgctgtgtgcaattgttaaacccgtctatatctcca

SEQ ID NO: 608427 - DNA, 114 bp, Homo sapiens
gtgctctcgaggatccccctcctatctgaatccagatcgccatgactgacaaaaatgagacggatggccttgtactttgtcgcaatcactggcgatctggattcagataggagg

SEQ ID NO: 608428 - DNA, 729 bp, Homo sapiens
taggaggagaagagaactacaacacgaacaagacggcggggggggaggcgagcgccccgtggtgcggtcccgcgctctttacaagaggtgctaggtaggcccgcaaggggtgtgcccagtctgtggcctctccgccgccttccgagtgctctacacccaaccgttgacctgaaaaccggcaattcgatggttgagatctaaaccgaagccaattagggcagggttggttggaattacaaaggaggaaacccctggatattataggaacccagagagtttgggttaaccaaaatggcaaagggcaaatggaagggcctataataatacaccagaagcccaccctttcgacacggattttgaccccccccccttgggccgccaaaaattaataaaaggggcaaaaatatggcctttttttataaaaaccgcctttgtggaaatggccaagcacaccctcgtatattgtctcctcaccccccatctcctcccacttatgaggaacaatgtgtctcaaaagaaactcctcccgagatgggtgaactccacagagttatagagtattatttatgccagaccttctcagaaatttgccctcccccgccctctataccactttctcccccaaagaaatcacctgggccttaaggggcccaatcggtttcccttttaacccccccccccaaatcttttaacccttttaaaagaaaaaaaaatgggtttcaaaaaaaa

SEQ ID NO: 608429 - DNA, 81 bp, Homo sapiens
gccgtgtattactgtgcgagaagggatatctctggggcccttgactactggggccagggaacgctggtcaccgtctcctca

SEQ ID NO: 608430 - DNA, 150 bp, Homo sapiens
agagcaggtggtcggtggcatctacggggttatgaacaggaagcggggtccacgtgttcgaggagtcccaggtcgccggcacccccatgttagtggtcaaggcctatctgctcgtaaacgagtcctttgggttcaccggttacctgaggt

SEQ ID NO: 608431 - DNA, 403 bp, Homo sapiens
ttcccaaattcaaactgatgtaaacaacagcagtctgaggaatagggctagttttttccaaggctttaaaggtgtttagcaatcatcatcatagttaaacgcttacaacgtaatagctaccattcattgaacatgtatcatataatggcccactggataagttcactatgtccagtgtttcctgtaatatagctatcttgtcaggcaaatgatataatgcccatttaacagatgaggataactgagactcagaaaggttagccgtaaccatgttctcagtgtctcaatagataagcaaagtttgaactctagtctatctgcccacattgagccacttccctcctatataatgtatccatatacacagcatgctttagctaagagcctgctaggtatttcaaat

SEQ ID NO: 608432 - DNA, 733 bp, Homo sapiens
  misc_feature (85)..(85): n is a, c, g, or t
  misc_feature (201)..(201): n is a, c, g, or t
gattgttgttccccgaatgaattataagcatcggaaagcggtgggtagaggtgttaccggtaagcgcgggcgacaagggctgttncccgacagctagcatgatgcggtgcgcactactatagatcattgctagtcgtaatgcattcagtaacaagcattggtcaacgatcttgataatcaagcgctcaaggtggttaccanacaagaataacggtagaaccgcgtcattggagcataggaagacatcaacgatataccttttagatacatgacaggggatgctgggagtccacggagggcatatgccttgtggcttgtcatgtagggactcctttgaaacggcatgctaagcaaagtggtattccaggacattctccaaggcgactcaaacgagtgtatcactaaagtccgaatgcagtttgattgtggggactagccaattcgtgtccgcaataagtctcttggggattgtggtcgcgacaaggtagtagacgctgtcaagggagcaaggcgaaaggccagtgcgatagaaagcaagccagccagggacactgcatgcctaaaatgggaacaaagtggatgatgtcttacaatgagaatgtctggatccatggaccaaacttccattcgcgcgcaaattttactgcaccggcgggcaattcttcacaaattatccacatccagctaccaatggtgggccctatcacaagcggattggggggctaaaaagtgc

SEQ ID NO: 608433 - DNA, 666 bp, Homo sapiens
ggttttctgaaagtaaaacaatttatgcgaacctatgtctaaattcactgttgttactatgtatgtttttttccaatgcttcttataagactaaatgattagaagtacctaatagtttgaacagatatgtttttatttaaaagagtagaataacgctttcagaattactgagttttttattccagttgtagcaaagatttcaaaagattgtgttcccagttaagtggtagtaatttcctttagttattctgtatccttaatggtgttctctctcctctctctcatctcgtctctcatctctcgtctcctccactcgcggttcccacactcgttctcatttctccttttgctcttttcttctcttttcatatattatatgcgtgccatagttctaggaggaaacgggttcaacaacattgtttaacactatgatctgtgaaaatattgaagaatgtgttttaggtagagtggtcagtgtgaaccttacagtaaagtatagaaatatatttagtgtggaatgtcaatgccaggatctctcattaacaatattttatctcaactgtggtccctgtgatacatctctgagtgggcaattccagaaatcttagtagcccatgttaagcttctattttaacttgttcgcggggagaaataagaattagacct

SEQ ID NO: 608434 - DNA, 190 bp, Homo sapiens
gcaagaattccattttatggaagctatacagaaatggatcctgtcatcattgcttctgaaggagtagagaaatttaaaatgaaaatttgaattattattgttgatacacgtggccgccacaacaggaggctctctgtttgagaaatgctcagtgctatgctatccacctgatacatgttatgtgatggat

SEQ ID NO: 608435 - DNA, 170 bp, Homo sapiens
ctaatctagaggatcgcttagaggcacaaggaggctgctgcggatatgggtacggcccggcgcgagatttacaccctctccgcagcaggcctcttggtgcctctgccgtccttggtgcctctggcttccttggtgcctctgggtgcctctggcctccttgaggcctctgg

SEQ ID NO: 608436 - DNA, 1002 bp, Homo sapiens
taacaacccccgtgttcctgtgggtgggtgtgggtttaatactaagtttgaaatgatttctttatacggggaaaggcccttgtggtaagtataggcctttattttctctcttgttcctttcgtccagggaggaatttgtgaagttaaattagaacccgaccgtgatttacctccggttcgtgaactcaaatctcccgttaggacttaatctcgtgtgaacacaaaccaaaccctttaattagccgggtgtgccccatctcgggattgttccgtgattccaaccattcgaggtctcgataaaccccttattgtgtttgatttgtgagcctctctaaaattagggatttgcgcccggtttatctcccttaggggtataacgttgttcccgttgtgggctccaagtttatttggggactccattgtggagttattagttagtgtccgctttgggacgtgggtgtgaagctctttgccatttgttccgtgctctcggaggttggggggtctctgactcccggaggttcgccccccaaaccccgaaattttttataagtgccaggttttgcggaagtttattagagaccctggtgggttttggataacggataccgggtttgggcttaaattaaattttaaagccctccaataggggatccttcttcgttctttgctggtgttcttgcaccgccttcttctcaggggccaggttcaacttcccccgtggttttacaccgttctgagcaaccgttttacccccctcgtgtggaccccattctctacggttccccctatttttaagggacccacggtgtattattccaaacccttttccccaggttaaggttcaccggggcccgttaaacatttttgtccctgtggggcagcgaggtgccccataatacctgggcactccctaaaagagtcacgtttatggggaaacacaggcggggataaaatatgtcagaatgctctacaaattttgtaaacactttcctaaataga

SEQ ID NO: 608437 - DNA, 524 bp, Homo sapiens
gattatagaggatccccacctggtatctcagacagtatcgacgagggcaggcaggaggatcccttgaacccaggactttgatatcagcctgagcaacatagtgagactcatctctacgaaaaataagaaataagctgggtggggtggctcacaccgtgtaatcccagcactttgggaggccaaggtgggcggatcacctgaggtcaggagttcgagatcagcctgaccaacatggtgaaaccctgtctctactttaaaaatacaaaaattaggccaggagcagtggctcacacctgtaatcccagcactttgggaggccaaggcaggtggatcacctgagatcaggagttcgagaccagcctgaccaacatggagaaaccccatctctactaaaaatacaaaattaatcgggtgtggtggcccatgcctgtaatccctgctactcaggaggctgaggcaggagaatcgcttgaacctgggaggtggcagttgtggtgagccgagatcgtgccattgcattccag

SEQ ID NO: 608438 - DNA, 262 bp, Homo sapiens
cggtcctatagggcttggagggtaggctgctctgcaagaaagggtactgaggggtacgacggatgacacgatgggctggggatggctgcccgacgtcacgatgcgtgggttgctctgaagcatgggggcaaacaccggctgtgagcggtagtgggccatggggctgcaatcagtggctggctggcctgggacacctgctgacgggtcagtacggggatgtacggaagaactagggcgtggcatccacgcagaggccgggccc

SEQ ID NO: 608439 - DNA, 427 bp, Homo sapiens
  misc_feature (283)..(283): n is a, c, g, or t
tggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcactgcataaccctcttgctggaccagagaaggaaggagtgagacaccagggtattctccaggggccagcagagtggtgcaagttgagngagtggcagttattccaggccctgcctccctgatgataacaaatgcattttctctgaaggttttactcctattctagaccttgttgctttttaaggacaaggctattctttcatgtaaaataaaatattctactatgcaaccat

SEQ ID NO: 608440 - DNA, 431 bp, Homo sapiens
  misc_feature (251)..(251): n is a, c, g, or t
tggccgcgtccgtgctgagcgccgcgctgctggcccccggcggctcttcggggcgcgatgcccaggccgcgccgccacgagacttagacaaaaaaagacatgcagagctgaagatggatcaggctttgctactcatccataatgaacttctctggaccaacttgaccgtctactggaaatctgaatgctgttatcacgtatgtatcagttcacactcagttctgtttgctttggggcttgtttgatatganccttaatgctctcatgtctaaagcccttcacaagttaatttcagttttgcagctaaagaaacaaagaagctatataaagagtcggaagaaatacagtcaggggaggatgcctaggaatgcacagctatctaatttttgtcttttcatactactacatccttttaaaagggccagtttctc

SEQ ID NO: 608441 - DNA, 341 bp, Homo sapiens
  misc_feature (266)..(266): n is a, c, g, or t
ggaaaacccggtagacgatgagactcagacaggaccaagggacggccccacagacaacggtagccctggccagacggttgttttgtcttattggtttttatgactgtgggatatccctactgctgcctaggcctgagcttgacacctcctgggctccaagcgagtctcacccacgcttagcctccgtgtgtagcatgggattcatagcattgggagcctacaatgccctagttccagcagggttgtgctccttagcactggcaccntgcatcagtctcaagatgggtggggaggtcctgccccaactggggcagtcaccttgcccagatccctagaaggac

SEQ ID NO: 608442 - DNA, 155 bp, Homo sapiens
cggtaggatggcgattttggtctggtgactcggtgtgtggtacacgccgagacaccaaactgcacacgccgagtgcccagacccatgaggtcaaagtcgccgatctgaagcatcggcgataacggactgctcagtatggggattcggcgtgtgca

SEQ ID NO: 608443 - DNA, 228 bp, Homo sapiens
tgctcccagcgtggagacgacggcattatccagtcccttctcacacttgccttcggcgctggtgggcacagcgtcaatgagggacacggggatctcatcattttgcaggctgctgcctttctccttgtcctcggggaaggaagctgcctggctctgagagtcctcttcatctgaactgtctctaaagccaggtggaggtgcggcaatggccatgttcaaggaacgaca

SEQ ID NO: 608444 - DNA, 269 bp, Homo sapiens
gaaaacggcatgtgcatgcgagaccaagctccccaccctgcggagataggaggctcgcgcggagaacgtgtgtgttaggagaactcggtgagtgaactgttctttctcgttagtattaatgtggaatccccgcctatcacattgtgcacactttatgggtgtgcaaatgacacaaaagatatccacatgccctacctgtgaataggtgtgtatatccacatacccagcgcgtcatgccacgtggtccataaaccgatgatgcttgagga

SEQ ID NO: 608445 - DNA, 591 bp, Homo sapiens
attacagatcaatattatagtactgaatatgaaaaaacttcccagcttgagggtacaacaaataataaggcattgcaaactctagaatcatgattttcatgtgagcttaatgcagaattacggccattaaacataaacacttgcattacatttcttcgtgattagaacaataaaatattcgactgttaccagttctcctttaacaatatattgttaagtgctcatattggaaccatattgctgatgctgccgtatataccctcaaaaccaaaacacaacacatactgtataaaatttataagcaaacaatgagttgtgacattgatattcaactgaaggtgttaacggatttttacctttgcagacacccaaaagaaaaagaaaatacatatttgtgtgactgttcctgacttaaatgacggatacagggataaacacggaaggaagccttgccaagttaatcactgccaattgccaatgatgactgctaacaacaaacagatgtgtttttcttttaaaggaaaccatagagcagatcttgagacacatatattgctagttctgcacaggataattacaagcagaagacaa

SEQ ID NO: 608446 - DNA, 367 bp, Homo sapiens
cgccccaagacgctgagattacaggtgcccaccaccaggcccggctaatattttgcatgtggtggagtcagggtttccccatgttgatcagactgggctcagactcctgacttcaggtgatccacctgcctcagcctcccaaggcgctgggattacaggtatgagccaccacgcctgccaatttgcatgctttttacaaggagttcggtgtctcctgcccagcccactgccactggactgccctgtattgcaagtcccctcaataaaccttatgtctcagttgctggttctacggctcttcttcagcctctcgaacatggtgccatccctactgaagtcaatgtggtctgacatgacttgtggcgct

SEQ ID NO: 608447 - DNA, 485 bp, Homo sapiens
tcaagcggaagatccgggatgagagcctctgccccccaacaccatgagccctcagccttttctgttatgaggaccaggaggctgtatgcttgatatgtgcaatttcccacacccaccgggcccacaccgttgtgccactggacgatgctacacaggagtacaaggtggggaacgcccaccacccacccatctcactgtgggtaaacaggcagaaccggcagaggatgacatactccctagctcacacatcctaacctcctactactcactttgtattctcagagctgcatatgcaggggcacacagtatgtgtgatcagttgtcctctagcctgaaaaagagcaatggtgagaagtgccccaaaatttctctctgactctcgcaatacatgtgagccctacgggcgaatatcggtatgcgtggtcatatttttcataaatgaatgaaaccacatggaaaagattaaacttaggaagaactgaaaa

SEQ ID NO: 608448 - DNA, 368 bp, Homo sapiens
ggggggccccccccttttttttaaaaaaatgggccggcctttaaggttgggccccccccggggatgccctttttttaagggccggggtccggtttttctggttttttcccggtaattgggcccccaaggggttaaaggcccttttgaagggccctaaaattttgccttgtttaaacccagttgggtttgggggccggttttttttggttaaaaattaaaaatttttggggggttttaaatggggtttctgggcccgggggggccctttttcccgtggcccgtgggccccttggattttggggttattggttattatggccccccccccttttttgcccggtttttttttttaggggggggtgttttta

SEQ ID NO: 608449 - DNA, 703 bp, Homo sapiens
agggccttagcaacccatgcccccaccccggaatggcatggtcttgaacgccacttcccaccaaggactggcacggcgcgtggccacgtggttcaacccgccggcccgttagatccccagacgttagccccgcatccaggcgcccgcattgccccgcgccccgctcgggtcccctccggcccctcgtgcgctgccccccggttcggtaccccccgaaggtgcgccccggccccggcttcacgcctggagggaagctcagggtggccggcaatcaccagaaggtggcccggaccatcggcatattctgtggataccgaggaggcgggaccaagtccccggagtccctgccagacccacgtgcagcggctgaaggagtaccgctcccaaacatctatcctcttcccccggaagccctctggccccccagaagggagaccagttcttgctgaagaactgaaactggcccaccccagctgaccggacccggtcatgcccgtccgggacgtcctataagaaggagaaagctcgagtcatcaactgaggaagagaagaatttccaagccttcgctagtctccgtatggcccgtgcccacgcccggcttttcggcatacgggccaaaagagcccaggagagcccccagaccggatgttgaaaagaaaaaataaagccctcctggggacttgggatccgtcggccagtcca

SEQ ID NO: 608450 - DNA, 111 bp, Homo sapiens
  misc_feature (40)..(40): n is a, c, g, or t
  misc_feature (45)..(45): n is a, c, g, or t
gcaggaaatagaaacagtctgaactatccagcccgccatnatccnagtccgaatcgacctccatcctacgatcctttacatacagacgaggtcaacgatccctccttacca

SEQ ID NO: 608451 - DNA, 694 bp, Homo sapiens
atgaaagtctactcctgcatcgtgtttgatctagtatcacagatgggatgctggatcttcgtgaaccatctcctgattgctacgtaacattcgacacgtcagatgtgcttgacacgacctattatcagtcgtgcaatgcacgcggcgaatgatccctggacaatgggaagtgcatccgcatccaatgcgcgagaccatagtgtgtgagtcatttctgcttgtgtgtggcacatctggtatgattgagctgacagccttgtgagatgatttaggtccagaaggaagtccagctaggtgaccttgtctgggcctgcatactagaggcttgtaatgcccccctacatacgtggagggatgccctcacaaggtaaaaactcggtcattgcctccaagtatgtgagtccatcttggcacccattgtcgggcctggtcaaggcgcaagggataccaatcaggcataggatgtgcctctcgtctagagctccgcggactgtaacgacttgctagcgagtcatgagccgtcccgacagtattggcagctcgtgttccctgacgtacggtgtctctagacacagagttgcaacttgatcgcataagcgggcggcgggcataagggttgcgactctagatttgtcagtaaagacccctacatgaagacaaacacctttgtaagtggaccccgcagtatcagaat

SEQ ID NO: 608452 - DNA, 231 bp, Homo sapiens
aacatgtttggaattagctggaacagaagactaaaacatggttataggaaatgaaaactcagtgtactgcctggttctgcaggcctactaccaggcaaaggtcttttatccttaccttggctgccttgccttgaaccattgtcacatcagctacaggtagttggtagaatggccaagcctgtttacaaaaaagcaagactaataggaggaacaacactatgaagtcgacgc

SEQ ID NO: 608453 - DNA, 1302 bp, Homo sapiens
tttgtttgtttgtggttgtgtgtctgctgtttttgttggtgttttggttttttctcttattttctgtgtgcttggcgttgtttttttgtttttcgtttgttgagctcgatgatttgcgtcttcgggttgttttgtttttttttagtgcggcttggctcttcgtgttgtgtggcgttgtttgtgcatcgtcgttttttgtgtgtggtgttggcgctcatgcggttgctgttttctgtcgtttccttattgtcgcgagtgcggtgatgtccgtcgcttttgttctgttgttgttgtctgttgttggtttgtttgcatgttagttgtgtgcctggtggtcgctcttttgtgctgttccgtttgttctgtcttttcccgtccttttgtgtcttcaatgctgtgtgtttctgcctttgttgctcctctgtgcctttggctcctctttggtggttcttctaggcagccactatgggggtcgcttgtgttgcggtgtgttctgcattgtgtggggctaggttttgtatgcctttgccctcctttctgctgtgggtttttccttccttcctctaggtgtttgctgtcttgtttctccatatgaggtcctttgttcgtgtagggtgtctgtatcgtggggtcccgtattgggctgccgcatggggtccgtcccgtgtgtcggtagttggcccgcgcgttgcttgcgtgtgtcgtattgtgcgtggagttaagtttcagggcgctgggctcattggcgctttgttgtggctgttgttggttttgtggagtgcagttgttgcttagctggctgtttgtgcttgtgtcgtgcttgtgcgtatcagcatctgttcgtcgtgctgatggaatatgtagggagtgaagtggaatagagagttaatttgtggtaagggagatagtcgcgaaggctagcccaggtccgctgtgagccctagcacagttggccgacgccgtgtcactgccctggctgtcgcttgcttctcgtgtgctctactgatagggtgtagccatggcctgtgtcttccctcagctccctgggcctggtcactacactagtggaaaacatgactatagcggccccttccccaatatcccaagagtgtcttgctgcttggtgggtgctcatcgcaatgttctgaaggctcctagggccactgttgtttgtaagtatgatctgggcctcataaataccatagtagctgcttgataaaattcgtaaaaatatctggttctctattatgtaaacactattacagtcaccagtgtgtgaagactcataagtctgggtgctag

SEQ ID NO: 608454 - DNA, 182 bp, Homo sapiens
ggtcatatgctactaagataccagctgtctgaagtgtactgggaacaatacacactccatgcgttttgatacatctccggaacgaggtacgagacttgagtccacacatggatgctataccaagtacttgagggccacaggctgtgttgtgtaacatgcacagataaggtcctccctaggtc

SEQ ID NO: 608455 - DNA, 978 bp, Homo sapiens
actgtttgagtttatgtattgctttattttaatcaggatcttctgatagtggaaatttttagtacataatagaacttattgatggagttagaaattgtagtgtctatccaggattgatttccatttgatcacatctcacagtaattaatatttgcaagttttttttttattaccagctctgtgctagtttttatgttgactgtgtaagcctcatcccaaatataaagcttagtgaagtacaattaacttaatgtacttgacctgaatagaacttgctactgtttcattttttctatctatttttggaaacagaatttgggcccttcatggcccagcgcgggagtgcggggggggcaatttcagttcaccaaaacctcgtgcctcgtggggtcaaaggaatctttccggcacttgagctccgcccgttatagtcgtggaataacgggcaccgcaccacaatatgcccggacaaatgtcggattttctcagaagcacatgggggtctccccatgttgggacaggctgggtctcaaatctccccactcttacagtggatcgggcgaacctggggctcctgaggtgcgagatacacggcgcgtgacccatttgtcccaagtttgctaattctcacagaatttggctgggcattttttcactttgtaaaacgggtggcccgcggatagaacccctttaatttttttcggacccccagatctggggctcggctataaacaacgtcgcttaacaagggagaaaacctttcctaacgccgtgtcgtgggaaaagcggaccgccaaaatcgttgcctctctcacgagtaaaaaattggcgcgaccagggtcgcccgaaatctctctgggagcacagaggttttggcccattaagcgttacaaagcagggctccattgaaacaccggggtgattttccccgaatgaaactgtaggaggacttctcgaggcgccaattttacgtgaggg

SEQ ID NO: 608456 - DNA, 725 bp, Homo sapiens
ttccccctccttctcgtatgcggggttcttccctgtgggatggcttagattcctctccgcttatggcgcgtctttgcttgtgtgtgcccctctggtggggcgccccctctatactggggcttttcggccccatcttctgtggcactttgtatcggatccggaacctgtggaccaccgcgtggtcttctggtgaggggtccccttttcttgggccgggtcattccctctttggggtcctcaagggctctttatctggttttccccccccagtctgtgcagacagacattgatacgctgctgggactgaattcgcgatccgaacagcagcgattggccgcggtcacttactcggagtccttggcgcccgcatgtgtaccctttgattgcgctcatgacgagtcctccgagtgacggatgctacctcatgagacgtcgcctcgagctcggtgaccttgctaggcccagcagcccactccaatctcggtagagagggataagccctatattgcctagccacccatgctgtgatcccaaaaccgcctagctgctgcttcttcctcagccagccatcgcccatcccctttgaggtctcagcccctttccctatgtagctcctcccctggagggggaatggcagccaggggttggggaaacagcatctccaagcagcatctagagttggccatatttacctcagcctgggcgctggtcctttcttccggccc

SEQ ID NO: 608457 - DNA, 231 bp, Homo sapiens
agctgggtacccaggtagactaacatatggtaacatatacatcaatatgtgctcccctgcacatctattcacaagtgacgttccaaatgacgacagctgagatatttaggcatgtgctaaaagttatcttagttgagatatgaaaaatgcttcagatggattcagattctcgagtatgttggattagtcatagctgaatcctgttgtgataagatggttaggtctacctgg

SEQ ID NO: 608458 - DNA, 349 bp, Homo sapiens
ccccaaccgctcgctgaccggcacccgcgccaacagttgagcgccgtcagtctcgacttgaggtttaccgagatcggcatccgccagcgtatcgaagaacagcgcgggctgctgccagccggcggcgcgttcggcggcaatctgcaactcgccgttgcggtaaccggccttgacgctctccgccaccccggcggcgatcggcacctgccccatcgcctgcgcgaagtcgtggttaaactgcggatcgttcggcgtcgtcagatccagactgaacgggtagtcggtcagaatgcagacgttgctgcaggtggacagcgtcagggtgcccgccagcgggccggataccggg

SEQ ID NO: 608459 - DNA, 836 bp, Homo sapiens
ggggtggcgcgggtccgggcatgaagctgggccgggccgtgctgtggacctgctaggtgctggtagccgtacctgtggtgcaggcggtggagcccatcatgccttgggacctgtgccctggccggcgtcctcaccggctacagtcttacccgcgtcgtctactgctctcttcgccgagatgctgcgggcagaagcggagccttagccgggaaggctctgcagaaggatctggacgataacctcgtttggacagcatcttgtcaatagtaaacatcattcttaaatgccgtgctttggatttcactaaagcagacccaatgagcccagagaaacctcttcacgactctccctgcaagcgggctggacaggcaccggctaaaatctcgtcagcaatgatcatcgcagagaactatttacggagggtggatctgacacaggtgactatagtccacctgttgagtggccacagttgcacttttccacgatgcttcaaagatcatccttgtacaaggcaaggatggaagtttggaatccctttctggatgtcatcgggattggggtctcttcgtaagtgggatgagatctggagaagttctatgttgaaattgattgaagcgccggtacacacgggatcatgttctcagggttccctctttgggcaaagggtcgtagcaagcttacagaccttttgcacatcgcggttagacgcgaagtttacttacccagtggccaagcatttggtgcgtggggtatactgacgaatcggatccagtagaggtatgtacaggccctggggagccagagaaggtgggacatgctcaatatccatctttaag

SEQ ID NO: 608460 - DNA, 926 bp, Homo sapiens
  misc_feature (324)..(324): n is a, c, g, or t
  misc_feature (332)..(332): n is a, c, g, or t
  misc_feature (339)..(339): n is a, c, g, or t
  misc_feature (342)..(342): n is a, c, g, or t
ccccgctaggggctcctccgccgcgcgcgcacatattggccaaaggaccccccaaggccggatgcccccccgcggaaagccccccgtgtcaagaccccccctggggccgacgcaacccctcggactatgcccccgggcgccggcctaaacgtgccgcggaaatgccattcgcgccggggacgtcccgggaaacgccaaggcgcaagtggcgggtccaacgcccactcccaagtaggccgcctaaggtgaagcgctcctgcccagcaagcaagggccggggtcaaagcgctctggctgtccggcaggcctccgtagggtcccccncgctgcancttcgcngtnttcagacaggatcagctcagggttggcggtgtccgggtccaaggtcacgtcccctcgaaaccttccgcaagtgtctctaccaagtcccgggaccctgcaacacggtcctcagctccataggcaacaacttctgggggctgcagcttcacatcctggaccctgcgcagggcgtccttgatgtcctgcagcagccccagagcaggcagctggcagcggccctcgagctcggcgatgagctcagctaggtgggcgctctgctggccctaaggtgtgcgccctcccgcagccggggcagcacctccagctcctcctcctccagcctcttgagcagctgctgctcctcctctgccagcaaacggcgaagacgctcgaactcacccagcacgttctgcgctggctctccaccatcttctgccacaagacgcaggtctcatccgcctgggcttggaacagcaacgcatcctgcatctgcttccggagatgctccagtgacttctcccagtcgccttgaggtcttcgccgcgtcctgcagcgccgcaccggtgcgcccagtgctccccagagcgctcgcagccgcacacagg

SEQ ID NO: 608461 - DNA, 530 bp, Homo sapiens
cttagcgtgctcacgaattctgttggcagatgctatggttatccgggatgccaccctgacgggtccctagcctcctccatacccaccgtctgcccctggaatccctctctgtgaatcccttggctcctggcatggttggaccagcagtgataataaacaacaagatgcagaaaaaaacgaagaaagcacataaaaagatggacaagcaccaaaagcaccacaagtaccactaagcatggcaagcatacctcctcttcctcctcctcttccagcagagattctgactgaatacaggccctggacccttccctcaagtctacaccagtactgctctcccatcaagcttcagaatgccatgttgtactgggggaatgtagcccttgtgctccccagcccctacctccacctgagcctcaccctgctgttgagccctgagtggctcggggaaatgggaagaggattgccatggcctggccatcttgttgctgcttgggtagatcatatagctactgacttagggcaggggagct

SEQ ID NO: 608462 - DNA, 1965 bp, Homo sapiens
ggggctctccctcttgtttttcgtagtggtgtttgtgttgtttactatccagccgccccgtcgtgtgtttatgtagttctgcgtctgggtcgctccttagtacgctctgctccgtactgttcttttggggggggggccaactactacgcatcagtgtttggatgtgtgttctgcttgctgtcgtttggttttcactaagatgtgggctcgctctagattttgttctttgtcgtcatagtatgttctgtctccatctgggggggtggtgtattagtactccttctcctccctttttgtgtggtggtggcatcgtttggtcgtctgtcgctgccctcccatactttgtgttatgtgggtggttactttattgtgtgcgcttttttactacacgagtggttggtgtgatatctttttgtgtgtaggaatcacacacataggtgctcgttcgctttttgtgttggtgggtgctccgccgctgttgttgtctctctccttttttggtttggctcgagatagttgtgctcctgcttgtcttcgacccacaggcgtgtggtttgtttgttgttagtgacttctcacctcgctcctctctcattcagtctagccgtctcgtcggttgtggttcttcctctcatgtgatgggggtaggggcgtcacccacccttactagtgtgtgtgggagatcattgtctgttcttcttctcgcttgcgtgctgtttgcctgtccatctgtattatgagtaagttggtgttcggtgttctgtcctcctccttcggtgttgagtcattccatcttcgtcctcttctgcggcgggtggatgatatatgatgttggtgtttgttgtcgccctcctcgtcggtctcctcctccttcttggggtgtagaacttccacttaccaccgcgtctctactttagttttgttgtgtcctccatcatgtttgttttcctcccagtggtggtgtttatacacgcttcgtctcttcgtgtcttcttctcttctatgagcggtgtgggggggtgttctctcctcgcgcggtgttttttacaactccgcgcagtttggtagtagtcttttttcacacatctgtgagtagaagacagcatcagagatcctccgcttctggggggagcagcagctattttgtacaacgaattgtcgtccccctcccaccagcacattagtgttgggggtgttctcctcctatcatttattatttcacaaccacaccagcagcagagtacatccttctcgtcttcagtagatggccccccctcgcgcagtagtagtagtggggtatttctctcttctcacgccactctctctctctgtgggtagtgatgagagacctctctatctctctctcactgtgggtgtaataagacacctctctcctcatcacagagtagacagctctctcatagacatcttatgtgctctcagagtgtgtgtgagaggcgtctccccatcacttctgttctgtgtgtgtctctcatcagaggagagagctgctgtgttggagacccgcggggcgcagcatgctctatagtagactacaacacgcgtgagagctctcgtgcccacactctctgtctgcgagtgctcaccgcgagagagatctctctgtatagctcgcggtgacgcctcgttggagagagccacacaagagagagtctctctagagagagagagatctctctcaagaggcccgccacgctctctctgggtgtgtgaaaatacacacaaaacaggtctccagcaggagaacacccccttctctccaagttctcccgcgagagtttcctcccagatgccacccgggcgcctgttgttgtggagagaatcaccttaatatttttgttcttttgaggcccctatgctcattaacacgggggacctgttctccccctattttcactccccacgattttaaaaaactaaaagtggagattttttgggctttta

SEQ ID NO: 608463 - DNA, 501 bp, Homo sapiens
agaaatggactattttgctctcatgtgtaatgttttctatttaaatctttcttaaatataccagctgttctctttccctgaactctcccacaggttctaggacaaatttaataacatgtaattctcctcaaatacttttgtatgtctcagtgttggtgttttcctccctaaaactaacattagggctgtgccacgggcatgactttatttttgttgggcttttttttccctgcttaaggagaggtgtcttttttggatatgagctatttattttgtgaaatgaaaacttgttcacccaaaatgattctctctataaacatattgtgtaacatgtcactatattacattagtcgtttgcacatcaatttgttagaaatattctatttctgaactcaactcccttatcattgacgacaagaccttgcaatgttattgatgtcacatttcttcacaaggccctgcgctcacgtctaagttccccaataaagtggtgcagacaca

SEQ ID NO: 608464 - DNA, 1687 bp, Homo sapiens
  misc_feature (1642)..(1642): n is a, c, g, or t
  misc_feature (1687)..(1687): n is a, c, g, or t
cggcagcggcacagcgaggtcggcatctggcacagcgaggtcggcagcgtgcagcgaggtcggcaggcggcacagcgaggtcggcagctggcagctgaggtctggcagctggcagcgatggtctgtgcagctgtgctgcgctgcttgttgctacttccgctggacttctgaagtacatgtgcgaccactggccaacgattggcagacctctgggcttcggctgcgaaagcgggcttgcttcagaagcagcgcaagcacttagactaaacagtcggccattcggatgcaccgagctgcaggccaggttgccatttgtagaccccgcaactgtttccggagacccaattgtgggcccttagccggggaagggcaccctttgctttgcttgctggggctcatttctttcaccggctttatcacgggggtcttcagcggaaacagagaccctacatttcgcacgcgagattcacagatgccacccctgcaaggcgcacattcccaacatgccgagggcgattccgattccggacgcaggggcggcaacgcgagcatgttgtccgattccgggccgacgcaggatcctgtccgaaggtcccgcggcgccgccagaatgtgcgcaccacacgacgactgaatgcccccacaccgttatttcacatgttacaaataccttcagaaggggtaccctttcacgcgaatgggttcagttcaccccgcgggggaatcaaattatccgcacggcggtgttccccgcgttcgcgaagagacctttacaccaagtgccttcattacggacgcttcctatattggggcgtcgaaccaccccgaacgcacacatggcacaggcacagggttatcgggcgcgttctgttttcgcccacggcaattacccccacgggcaccaggctgcggcgcggcctatcgcctttttatggcgtccccttacgggcgtgttagcaaccctttaacaccactttatggcagcatttcacgttacccgcagaagttttgcccccacaatttagaccgcccttatgtccccacctatatatgtggctgacacggtgctgcgcacacccccgacgaacgtttgggctattgcgtcggccgcgggaaagtggggccaccccctattttacaacgggtcggcaacaacgcgcgcttctgtggtgcacacattattaacgcggagggtgagaccccaacgacgaccacattagcgatatattgggtcttccgcgcgcgcgtgcgtggtggcccacaactactatcccaccgcagcggtggtgcgcgctgtgcataatggatatctcccactacggacccgcctcagcattgcgacaattatcgcggcttaccggcccacagtcacagacagcgccccgcctttaagacgtgagggacaccaccacgtggtatttgccgtttaacatttacgcccggcaaccacttattggttctaggtggcgctacatgctgtgggcgcgaactattagacacagagggcgcctttggcactattgcaacaaccccttgtgtctttcgcacacgcttattaaccacgagcgggcgttcttactccagccacgactgtgcaatgtcccgacaggacaaatacattacacgcgcgccacgccgtgtnattcatcttacagcacggggtgtgctttacgccgccctatgtacn

SEQ ID NO: 608465 - DNA, 183 bp, Homo sapiens
gagctcggtacccttgtgctgggtgaagagggggagtgagagttggaaaaggagagttcagtgacacctgtgtccccagctccccattgcctggttgcagcagccctcaatttctcattcttcttccctttttcccaaccaatgtggattctcttaaatctaacttgatgcattcaagctttg

SEQ ID NO: 608466 - DNA, 822 bp, Homo sapiens
  misc_feature (150)..(150): n is a, c, g, or t
gtaccaagattacgcatatatctccttctaccagcactgctcagtctcccctactatgaacatcccccacttagagtgggtacatgttgtgtacaatcgtatagaacattgtattagagtacatcagttatcgatcgaaaagtccatagnatgatactaggattcactctgggtgttgcacatgattatgggtatggacatagtgttctaatgatcctgtattcaccattatggaatcatagtaggagatattgtcagctgtcctgaaagtctccttgtgtgctataacacaatcgctggtgagcagtggtactcttagtggagtccatagtatcgccttttacccaggataatcacaaggtcggaatcacatagtatgtagctctgtgcagattggttgtgatcacttattaataggtatagtcacgatcgctaagaccgtgctgtccattgcgtcgtccggagcccagtaagaagacagttcttagatatgcaatcctatgtgtcgatactcttcttggttctcataaataataaacatgaaagttaacaatcctatggtttgcaaaccattttaggacctcagagcactgttatcttccgtcctgaaccgtccacatagaacgtgactacgacgtatcacactacattccagcttgacattagcaaacggaatgggaaagactctggcaagctcgggattcgtagatcctcgggaatcggacttccattacctgtctggacaatctcgacatcaataagaggacacacgtctataataccttatcttatgcacttaaggtttacatgggttcttggaaa

SEQ ID NO: 608467 - DNA, 335 bp, Homo sapiens
ccaaaataaatttgttaatgatcccttccaaaaatagattgccaccagcctgattagtataaattttgttggtaattaaccccttccgggcataaaaagtttttttcaaaaaaaattgtagaggctggctttttgttttttccatccaggccaaattattgaaaatcctcccgggatataggccaaggggtaaattttttttttttttttttaaaaatatgttttatcctgagggcggtatttattacttttttcctttggttcctgttgggctcttgtaaaaaaaaaaaatattttcctgaaaaataaaataaatatagggcccttggggggca

SEQ ID NO: 608468 - DNA, 916 bp, Homo sapiens
gccacgcaccacttcaaagccgttcatctcagtcacagtccagagcagtactgagtctgcccaggacacctacctggacagccaggaccacaatgagcgaggtgactatgccagtcgggcctgatgcaactcgatcggacagcctggacagcagtacccgaccgcccagcgtgacacggggtggagtcgccccagcccctgaggccccagagccacccccaaaacatgcaggctctgacaagtgacacaacgggacagctgaccagctctgagtcccactcccgaggtgcggccccaacatatggtaatagctgtcatcgataggaatacaagtggactgctttcagaccagtgccaaaagaggagcccagctccacgttaccagaatttccatgtccagtcggggttcaccgtagaggacgactgtgcgtaaggcagtcgtcctcgctctcacagtatgtcctcccgagcgggacacagactcggatacccaggatgccgatgactcatagctgtgaagtcatctgataggagcctcccggactgtacccctcagcccaactccatcagcatcgatgccggtccccggaaggcccccaagattggccagtatcaagcgcaacgtctgctatggagacaacagcagacctgtccctagaggcgtcctcagctgccccacccgagcccctggctcgagacctcctccagctccccagcagagccggcacagccaggggcctgccgcgagacggctactggttcctaaagctactgcaggcagaaaacagaagcggcttgcaaaggctggtgcctgccagatggacaaggagaccccaagagaacagactctctggaagaagtcttagcgaaaagtcctcagatgctgtgggcaagtgccccagtactgattgtccca

SEQ ID NO: 608469 - DNA, 316 bp, Homo sapiens
  misc_feature (82)..(82): n is a, c, g, or t
atggtatagatatatgggctaggcagagagggcatgacctgtcctgggacagcagccacttaagccttttagtgcagtgctnccttccacagcaccacactggattctggagtctttccagccagggcagaggaagctgcaacagtccacgataagagcttctgggcttctcgtacctaccctctcagactgctggtcctagggtcattaagggctgctgcacgttgactgaagtcatggggttggttgggagcaggttcttttttggaggccatggctggggattggggctgatggctgggaagattccaggcct

SEQ ID NO: 608470 - DNA, 554 bp, Homo sapiens
  misc_feature (18)..(18): n is a, c, g, or t
  misc_feature (30)..(30): n is a, c, g, or t
  misc_feature (32)..(32): n is a, c, g, or t
  misc_feature (38)..(38): n is a, c, g, or t
  misc_feature (41)..(41): n is a, c, g, or t
  misc_feature (43)..(43): n is a, c, g, or t
  misc_feature (56)..(56): n is a, c, g, or t
  misc_feature (62)..(62): n is a, c, g, or t
  misc_feature (69)..(69): n is a, c, g, or t
  misc_feature (73)..(75): n is a, c, g, or t
  misc_feature (77)..(77): n is a, c, g, or t
  misc_feature (87)..(87): n is a, c, g, or t
  misc_feature (91)..(91): n is a, c, g, or t
  misc_feature (96)..(96): n is a, c, g, or t
  misc_feature (104)..(104): n is a, c, g, or t
  misc_feature (112)..(112): n is a, c, g, or t
  misc_feature (114)..(114): n is a, c, g, or t
  misc_feature (118)..(118): n is a, c, g, or t
  misc_feature (122)..(123): n is a, c, g, or t
  misc_feature (132)..(134): n is a, c, g, or t
  misc_feature (136)..(136): n is a, c, g, or t
  misc_feature (143)..(143): n is a, c, g, or t
  misc_feature (164)..(164): n is a, c, g, or t
  misc_feature (218)..(218): n is a, c, g, or t
  misc_feature (283)..(283): n is a, c, g, or t
taaagttataagttattnatttaagccatntnctgccncangnaaagggatggganaccagnataccantcannntnggatacaagnaaanaaggngagcttangggcccananactntttnnggtccatgnnngngagtaanggtccaaaccagtgctgtggnccctggtgcccgggtagtggtccagattctctttattcatcttcgtagccagtnggaagtggattcacatgagggttatggaatagagtatggttaccatctccccagggaaacggctnggtcctgatgcggagatgggggtaggcgatgaactcgggtctctcgtgtgctcctccggtgggtgcgacttcgggtacacatttcagcattgctgactggccaccccggggagcgcgacgaagaagggtgagagttcttccacattgcgagcttgagcccttcttcgccaggggcgccatctcgacttaggccgccccagttgtgtggtgcgggacccgacccagaagccgagaaaaccggggacaccccaattaccgccatttgtgggag

SEQ ID NO: 608471 - DNA, 87 bp, Homo sapiens
gagagagatgaagggtcttactactgtgcctgtgacaccgtagatcctacgggggatctctactcctgggacacccgacagatgttt

SEQ ID NO: 608472 - DNA, 426 bp, Homo sapiens
  misc_feature (17)..(17): n is a, c, g, or t
  misc_feature (23)..(23): n is a, c, g, or t
  misc_feature (25)..(25): n is a, c, g, or t
  misc_feature (33)..(33): n is a, c, g, or t
  misc_feature (50)..(50): n is a, c, g, or t
  misc_feature (57)..(57): n is a, c, g, or t
  misc_feature (91)..(91): n is a, c, g, or t
  misc_feature (164)..(164): n is a, c, g, or t
  misc_feature (323)..(323): n is a, c, g, or t
  misc_feature (415)..(415): n is a, c, g, or t
caaaaacagtttgcagnacctgnancagatttncccccagatgccatatncaaatgntaagcattcaccccaccataaaaactagagaggncaaaagtactgtatcaattcccatttgttccatttgttcccttcaaataaatgagttctaactctgtcccagncccccacgtgtgcaatgatgagtaaaagtatacttctctgccactgggcagagcccaggactgggaggagtctataaaatcaaataatggctaatcttttaaactgaaggctgaggtgctttgaggaggcatatgataggcagggatttgtcctggggnacagaccactgagttgatatttgaagggttggggctaatcctagggaagagagcaaagagtttgttgtgtgcaaggcccaggggtagcaggngaacggcaagt

SEQ ID NO: 608473 - DNA, 213 bp, Homo sapiens
gctttccgttcctgggcctgccttactctgcgggccggcgagcctcgagctgtttagacccaacggcgacaccgccaaggaggcccatcatcggattattaatcgcaaaaatgccggtaataaaggtcaatggaaaactattgggagggtcctattattcctgcgtcctatgtaaagtaccttgggagtctccaaggtccgagaattttacca

SEQ ID NO: 608474 - DNA, 460 bp, Homo sapiens
gatctagcaggatccgtgccgtacggacgccatgacgctctcggtggcaagtaactcactgtggcgagcgagcttgctcgctgctgggcctggtagcggccccatcaagaacactgcgtttattcagtcggaacaccttggcaggtttcagggccgcttcgcagcccagcgggagcaatctctagccacacgatcaggcggcgttttcgaccaaacgatgccacaacgcgtaatacacccgcccggacttctgctcccggtgcaggcgccagccacttggcaggccgagcgtggacggcgcggtctcgctctcagtgtagatccaggcatccggtgccagccactggcgtccttccagcagtgtgcagacggtcggcagcaggttctggttgaacggtgggtcgaggaacactacgtcgtattcagtcgctgcctgcgtccgtagcggccgggtaccgag

SEQ ID NO: 608475 - DNA, 397 bp, Homo sapiens
atgataaagccaagaatattctagtcctgacagtaatgaacgaaattaaatatcagttctgttgactatctctgaggagtgattctagctcctcttgcaaagagctgagttgctccttttctcggtctaccttttgtttgagctcatccagtacagcctgaaatctgttcttgagagccagattttccactttcatgatgagatcctcttgtcgttatgccctgtcctgggtctcttggagcttgcctttcatgtggtcaatctggttctgaattcccataaccagctgattggttccttcattttcctggtgctgtacatctgattcatttagcttgtcctgtagctgtctctccagatcttcctccgtgtcaatgatgtttatatcttcttcatc

SEQ ID NO: 608476 - DNA, 195 bp, Homo sapiens
gctctagaggatctcctgtgctttgggtcggcgcagatgagcatcatgcatccactacccaagtcctactactctggggactttgcaggaggtgagctgcctaacctatacatcagccccagtgcttaagtatactcccccagaggtaagaatgaggaggtcccccaatgaggttccatggtcaaggcagcaagt

SEQ ID NO: 608477 - DNA, 125 bp, Homo sapiens
gaaggatccccgtgtggagacggggttcatcatatggggcaggcgggtctgatactcctgaccttgtgatctggccgtgaccttgtgatctggcccaccttggtctcccaaaggtgctggggatt

SEQ ID NO: 608478 - DNA, 113 bp, Homo sapiens
ggacacaggtgcctactaccacgcccggctcattttagtattttcagtacgagatggggtatcagatgttggccagggtggcctcaaatgcctgagctgacgtgatctgccca

SEQ ID NO: 608479 - DNA, 430 bp, Homo sapiens
aaattcggccttaatggccggccaaaatggtgaagggttttaccatggacctttggttaaggcaattagaataaggtttggcaggattgactaattaaatcctggattattaaaaaaaaaaaaaaaaaaaaaaaaaaaaaaaaaaaaaaaaaaaaaaaaaggaaaaaaaaaaaaaaaaaaaaaaaaaaaaacatgggggcccccttggcccaatcgattttaaaattgggcaagcttatgcatggggcccaaatttgggctaaattggccaatttgccctattgggaggcgtttaaaattaaatggccggcgttttaaaaagttgggattgggaaaacctgggggttcccaaattaaaacgcctttgaaaaaaatccccttttgccaagtgggggaataaccaaaaggcccgaaccgaacggcctttcca

SEQ ID NO: 608480 - DNA, 136 bp, Homo sapiens
ctcgtggtagccaaagtagagcatcaactcctcgctttttctggtatgcctttcattactgtatgacgttcaagatcaacgaacggaggcaccttgaaacccaaatgacagacgcaaacctgagggcacaatttag

SEQ ID NO: 608481 - DNA, 154 bp, Homo sapiens
ttctattagaggatccccccgactagcccgacagcacaccaaggcctcttggatgcagcggggccgccgccttgggggccaagagaccagcccctgagaagtacagagcctcctccagcggtggcagtggtggctggcagtgggggccgcgtgc

SEQ ID NO: 608482 - DNA, 1388 bp, Homo sapiens
cttgttcgttcgtggttgtctttttgttgtttgttttctctcctcggttgtgttttctactcctgtgttggcttcttgtgtggtgtctttccttgttgttagctttcgtgcctggcgctttactctatctcgtttctttactagtgtgtttttgtgtttttgctcttgttcccttgcttttgtgtttctatgtgttctcccttttttatgtgttctgtcgggtgttctgcgggtcgcttttggttttctttcgcttggttttctgttgtcttctctcttttgttctctttttgttttccttttcccttgtgttggcttgctgttttatgtgtattggtcttccgtgtcttgtgtttttgcttttttgtgcttgcttgtgtccccgttgtgctttgtttgttttttgttcttgttcttttgttttcttttttttttgttctgaccagtttggtgttcttgcttgtacttgtcttttttttgtgtttgctccattgcctttggctccttttctgtgttgttcttctctttcccttggatggctgcctttggctatgggtgttctctccttctctttttcctggtttctctgtcgtttctccgctagttttttccattgtagtggttctttttccgttctctggtgtcctcggtgctctcatctgttgttttcttgtgtgtttgtcgagtttctgtgtttttgttttttcgttgttacctttgggcatttgtgttctatttttctatgggttttctatctcgtattgtttctttcttctatttcttgttttctttttgtatttccttctcgttgtgtgcccctttccttgcagccctagtcttctcaggcttcttttgtgttttttgggcatctcttgggtatggtcatctctcgtctctttttcgtatctttctgcttctttgtttctctaatggatttcctggttctcgtggtattttctctttccgtgtttcctgtttttcttcggtgagtttcgtcctgactgctcacttcggtgttcccgtttctcgtcactttgtgttgtagctcgtcaagttgttctttgtgtctttggtgtcattcttttttatgctcctatgtgtattctttttttcgcttcgcctcctcgcactttcattgtaggtacgatgaggcctgtgtgttctcggctccatgtcgcgacacttcctcgtgtgagcatcggtgcaatcttacgattcaagttcctctctggtagcgcctccctgtccgccatcgcggtgcgtgtcgggcggcgctgggggcgctgtgtttcccccccggtttctttttttgtaaattttttataaagtaagggaaggtttaatttttgtattctttaaagagaaaattttattattataaaagaaca

SEQ ID NO: 608483 - DNA, 966 bp, Homo sapiens
atctcacagaataccaactaaaactaagtgcattgagatctgagatgggtaaacccagattcatttaccacagctgtaattaagtttttagaaactattctcttttgggggaaatccatggaagttaatttctgttatcttattagaagaaaatgatgttgatatgtgtttcagattttccatttgaaatcttataattaattggatttatttactggtaagtaggaggtataaatgacactcttaactgggagcgaggggtgtaaagtgtctgtacaggtcaaaattagtgattctattttaatcaaaagtttaatcctgaagtttcaggaccactcttccttaataaacttgttaactgggaaagcgagctttatgaacatttaacaacactgtggctgctgctatgtggcttaccacgaaagtggccaagagagacttctaaggggaaaatataggggttaattttccaaaaatggctgaaatattgttggccatttttaaaaaagtctcaggtattaccatcgtgcattacatatcgtatgcctgcatattaaacaatccggtgcatgtacttatgcgagaacatctaatagggaacagatacgctacaagcaatatacacagtaaccttgagacattgcatttccctcacatgatcgaaatagcctccactaggtaagaaatggcacatggtgcgaaagcgtaacacaacattggcatcttcacggaggaactaaaggccttcagggagcatgagcaagaaaatgtaccgcaaggaaacctgggaccattaatacaaatgggcggagaatagggaccaaacagggtcccaaaaagcgaggacaaacaacaccgcacaaaaggggaaagcccacataccgcagcaaaaccgacagaccggagaacacacaccgccgcgaacaagggacacaaaaaagggaccaccaacagacaagcgcacag

SEQ ID NO: 608484 - DNA, 80 bp, Homo sapiens
  misc_feature (53)..(53): n is a, c, g, or t
acgtttcagaaaaaaacaaaaagttttaaaaaaattgttgagtcaaaaagtcnaacaataaagaaattaagatttcttgg

SEQ ID NO: 608485 - DNA, 944 bp, Homo sapiens
gagaagatgaaaaaggaaacacagagcacggaacattagaaacaaacccactgtaaacttcagccccgagtcagaccgtatagatgaaatggaatttgagattaaattgcttcgagaagcttgcaaagccagcaggctggtgtcagccaaactacccagatcaatcgagaagggagtcctgatacaaataggattcattctcttgaggagcaagtagctcagcttcaaggagaatgtctgggttaccagtgtcgtgtagaacgaagcctttaccttcctggttgacctaaacagatactgtcagactaaacgaaaagcagcaacacaaactgcaggacgtggtttaacatgatccaagaggtcaggaaggctgtcctcacctcatttcgaggaatcggaggcactgcaagtctggaagaaggaccacagcatcttacagttctccagctgaagagagagcttaagaaatgccagtgtgtgcttgctgctgatgaagtactatttaatcagaaggaactggaggtgacgcgaactgacagaactccaagtgccagactgatggcacacggaacccccaacgggcatgccgtatctagacagaacggcgccaacacacgtgacctagaccgcaacatgaccacactcactaaacaaccaacactagcggctcacatgactgaagaactaccacacctaaccgccacggctcccacagcacccaacccgcgccaatggccgatccacagacccgaaagcagaccaacacggacaccgacaccaatggcgcacaaaataacccatgacaccgactcagcacgaccaccaacccgacaacaccacgaacgacaagcccacacaaacaaccaacacaggacacaaagacaaaggacacagcacccacaaccacaacacgcacaccacaatacacaacaacaaacacacac

SEQ ID NO: 608486 - DNA, 210 bp, Homo sapiens
cattttgcccctgaaattttggggtgggtgagttaaacaagccctctccattcagaccaggtgggcaggagtgtttgaccctaaaaaaatttataaggtcggtggagcagtcctgcctttggccccagggaattcatgttcagcccgattttgatggggaccaaaggggcctcctaaaacccaagggggccctggaggcctggggaggag

SEQ ID NO: 608487 - DNA, 714 bp, Homo sapiens
tctggaaagacaggtctggctctgtcacccaggcacagtttacgggagccttgaactccggggatcaatcagtcctccggcctaagcctcccgagtagttaagaattaccaggtttgtcccaccaggcctgggttaatgggtgtaaattttttggggcagagatgggtgtctcactggtggttggcccagggttggatctcaaatctctgtgggcctacaaggcagatctctccaatctcagcctcccaaagtggctggggataacaagacctcgagccaccacactctggggcaacagatgtgaaacctggtccctggtttacctggcgtctatacctctcacctcggaggcctacctctggcctgggaaagagattacaggggaaatcccagggcacgccctggtcaatgtggtgttaatggaattcttaacctggttccctttataaagacaagggaactctggagggcccaaaatgttcctaatgttggttggggcaaagtgggaggtctcctaccctcagtctccggcaaggacctggggggacccccaggtccagaaagccacatgattctggcagcagacggggacctagagcacatcgggatctcagcccaccctgggaaaccggcggctagagaatcccaagatgacagactaagtaggattcggcattagaatactcctggaatcgcgggcgtagcgtaaagtg

SEQ ID NO: 608488 - DNA, 159 bp, Homo sapiens
cggatgtttgcccaacacagtggcaggctgtttcacagtcattttgatatgggttactggttatttcagattgcctgactatccttatcaagaaatctgagtggaatttagacaggaaaagagatttcttaattctggactccagtgttggggataaca

SEQ ID NO: 608489 - DNA, 436 bp, Homo sapiens
  misc_feature (88)..(88): n is a, c, g, or t
aagcctgggcgtgcctcgcaccggctgtgaccaaggacttccgatgtggctgtgattctgaccccataagtccttaactgatgatccntctcagaactgtgggtcacagggaacagaccagatcagaagagaatgggagaatttaaacctacttgctgtgttggatgtggagtttgaacatggttaaataatctgtcataagaaccaaaaattagaaaatggaacacttaaaattatttataattttctttgtacatcgttttgcacttagattttccttgtcttgtaaaaataatgaaattggcttgaaaatatatattactacaaaatgttttaaagtgtgaagtacctatattcatatgtgtaatttagattttatgactcaaacatcaataattttgaaatttaaaataaaattgcagtaatttcaaaaaaa

SEQ ID NO: 608490 - DNA, 169 bp, Homo sapiens
tccccctcttcactgtcgctctgcttctctcgcgccttcctccttctctcggtgctcgctcccgcatcctattcattctcttctgctcttcgcgtctccccccttccccgttctcctaccctctctctccttcgcccggccgtttcccctccctcagccaccccccccc

SEQ ID NO: 608491 - DNA, 477 bp, Homo sapiens
  misc_feature (42)..(42): n is a, c, g, or t
ctgctcagctcaaagcagtccacgggttcaactctcagtgcnccaggaaggggaaacccacttcacttgggtcaagtgttcattttccatcctccctgtctccaccccaatcagcaaaggctagtggctggtggtaaaaggaaggctagtggctgggggtaaaaggccaccagcagagggggctctccagaggcaggcccatccccagctcctcccgagtaagtgccaatcacccagaggtggatcctctttcagggccctgacttgcaaagctgaggaccagcttcctgtcagtggtaaccctcagtgagggccttgtctgagcagccagcagcctctgagacatttccacatgggcactggctaacttaaaaaagataagtattcacccttcccaggaggtactgatgtcaggaatagccaagagtgcagtcttggtctgtaaggaggtggcccttccactccatacggcccttc

SEQ ID NO: 608492 - DNA, 436 bp, Homo sapiens
gaacatttcgttgttagcatatagatcggatgtatgtaagaacttgtaaagtgcctgaggtatcttgaaaaatgatgattctgtgactaaaatgtgctcataagactgaaaataaatgtttaaaacaccatatcttatccacctataaataaagaatttacaaagcaaaagtaaatgtccacccacctcatgaacaaatgatcgaaagatgctaaatctattgaagtcccaaattaatgagatattaccatgtgcgcataaataacttaaagaataaaatatgcgtgatccttctctcatatgggcatttgagctaatgaaccaggatcctatttacactatcagtccccaaagtaattgcttattagaagaagatctgtcttatgaggtttcagatgattaaatctatatgcattgtatgcacacatttgaaatt

SEQ ID NO: 608493 - DNA, 146 bp, Homo sapiens
  misc_feature (44)..(44): n is a, c, g, or t
ggcgcagtgcagctgcatcctgcaggctgacctagagtaccccntgtcatatgcaagtcctaagcaggttgtgtaaggccgcggacatgtgctggaattgatgagacgaggcgaaatagtgccctctgcgccttgcccatatgcgc

SEQ ID NO: 608494 - DNA, 621 bp, Homo sapiens
tcacgatgcctggagctatacagtagcgtgctcttccttcttgtgcttctgagttcacactatgcacaatatcttttggccagacactgcaagcagacttacctggcctcaggtgtacacagggtcttgctagatgtgctggtactacctggacgaaatgctctgagtcgacgcgcggcgcaatgctgttacagcttgcgctccagagtttcgaaccagcgatgcgtagcagacagtgaatagaactcatgactagcacacattactctagggtgaccaagctggaaggtgtaacgcctatgagtgtctcagtacagtccctctctttgacgctctgggctgggttgatacgtgcgaggtcatcttggagactcaatgtgttgagtgcgtgtggttaagcccccagttccttgggctgtgcctgggtccaggtccataagatgtcccgcttggagcacggcgtagcgtgaggtcggaaatctcctttcccccgggcggaaaatcaggaaagcccactgacacgtcacacgcacacagacgaaggtctatctagcttagactttcaccgttttctttctgcggaagacgtgaagttgcccatgcgcagttactgactacgtg

SEQ ID NO: 608495 - DNA, 210 bp, Homo sapiens
cacctctgacgacattccacgagggtttccccaatgttttctagtagtagtttcatagttagaggtctataggtttacgctcttcaatccatttgcattagatatttgtatatgtgagagataggaatctagttttattcttctgcctatggatagccagttttccccaagcacccatttcattgaagcagcatcagtttatctcccaat

SEQ ID NO: 608496 - DNA, 476 bp, Homo sapiens
  misc_feature (174)..(174): n is a, c, g, or t
  misc_feature (250)..(250): n is a, c, g, or t
  misc_feature (282)..(282): n is a, c, g, or t
  misc_feature (356)..(356): n is a, c, g, or t
  misc_feature (376)..(376): n is a, c, g, or t
  misc_feature (419)..(419): n is a, c, g, or t
  misc_feature (455)..(455): n is a, c, g, or t
gagacaggggtagtgcgaggccgggcacagccttcctgtgtggttttaccgcccagagagcgtcatggacctgggtgagtgagcctcttcatgtgagaaggaacagtaccagggtcttggacacccagactgaccctgtggaatgggggtggaggatgcgggtggaacgcatangggtgcttcctggagaaatcagttctgattggtgggcattggagctacttccagagaatgccccctgctgtcccangaagggtgcactgcccttcagacctggagaangggtcagccttttgtgccatggggacaaaggaagggccgagatcatgtctttctaaaacagcaaggacatgaanattgcgggcttgggcttgtngtctggcagaactgttctcatcatgaggtgataggttaagccnctgggactctgggacaggtttcaacagagaattctnccctacctaagactttcctct

SEQ ID NO: 608497 - DNA, 188 bp, Homo sapiens
ctaacagtatgtacctaaggagatgggggaaatccattcagataattaaattctctttcaactcaaaaaggtcacagggataaatacatgaacagaatagctgcaaagataaatgtggagaaagtgctaagcattagttaacacttctcagttttttatttcttctcctcagttgcacatgcggattc

SEQ ID NO: 608498 - DNA, 378 bp, Homo sapiens
gaccgtcgttcacactggacaggtatcctcattaataggccgacgtcggaaattactagtgattgccttctatcgtgggattgctcccactctctgcactgagcatttattgctttctgtttgttttttaatcctcccacctcagcctcccgaatagctgggactgcaggagcgggccaaccatgcccggctaatatggtttacttatatttgtagagatggtgtcttgttatgttgcccatgctggtcttgaactcctgagctcaagcgatctgcccaccttggcctcccaaagtgctgggattccaggcgtgagccaccacactgggccttgctgcagaaaaacaacacaatgcggatgaagtagccgatcctaga

SEQ ID NO: 608499 - DNA, 345 bp, Homo sapiens
gagatggtcacttagagggggtggttcctctggtaaaagtggaggtaagattttaggttcgtacagccatttggggaggtccaccccggatatgtggtagtccacatgatctctgcccattgggaacatatctatcaatttggggtgtaatggtacccatgccatgagcaagatgcagggtcagtggtttttgtagagggccagaggtatttttctaaagtcgagatttgtttttctctctgttcgtcctcagcaaggtgtaacaagacatgaatcaaaggtaatgatctggggtgaatttgacctagttacattgataacaatgtggtcatcatttgactgaga

SEQ ID NO: 608500 - DNA, 607 bp, Homo sapiens
gggtgtctagaggatcccacgtaatatgtaaccatactcttacacacattgttttgtatattggagatctttactagaaaagcagaagttaaaagaagtgtggggcacatgtagccccagctactcgggagacttgagatgggaggatcgttgagccaggagttgaggctgagtgagcatgaccttgctgtgactagcactacactaaggcctggggcgacacgcgaagaaacaccgcttaaaaaacgaaacggaagaaaagaacttgtggaattccagttatctataatgcttccagctcctcagcctcttaactctcgccaaaccctcagcctttgcttttcaaaatactgcatttgctatctactgtctcacagaaatgcagaccttttgcctgaatttcacacttgctgttctctccattacaacttggcagtcatattaggctaatctggattctggcttcattaatacaggccctttcctccctctcctctcctccttgtatctctctaccatgatttgtttcctttggcaacacctttttctctgccacacaaacgtggctgtcacactccgtgtgagctgaggcaatgagaagacactg

SEQ ID NO: 608501 - DNA, 392 bp, Homo sapiens
  misc_feature (257)..(257): n is a, c, g, or t
  misc_feature (313)..(313): n is a, c, g, or t
  misc_feature (350)..(350): n is a, c, g, or t
tctagagtgtatcctaaaccctgggactgctttgattcttggactctgaaggaaaaacaccttataggcctctacacaaaggtttggccaaattatgatttacaagaaggactagcttggcttcagggaggcactgttcattttgataccatccagcagttggaccttttttggaaacgtgaaggcagatggtctgaggccccacctgtgcaggctttctttaccttgccgggcaacccagacctttgctgacagtntaggattgatacagccctcctgtttgccgtctcaggagaggctgcaagaggcaatnccagggaacttaaatcccagaggcatccccagcaganagccagttccttcagcctgttctccagttcacctgactccct

SEQ ID NO: 608502 - DNA, 794 bp, Homo sapiens
tccagtttgcctcctgctatatccattggaagagagaagtttgtgacttgtggcccccaaggttttgagagaactgggctttcggcgcgtgggtgacatgaggatggctcgctgtggtgagctttccccatggagcttaccctagcctgcacgaagatactcagtccagacccagtcgatgacgccctgcctctataggcttggggactccctgtagatgaccgccggagatggacggctagcagaatggtcgtcacgacagctggtgtgctccgtacagtctcgtttccctaggcaaccccttgagtcgctgtgaatcctgaaaccggattgccaagtgttatcctctccacagggcatgagcagctccctgaaagcacttccacacactctcacgcaactcgtgcagcgagggaacgatggttgtctaagctcgtgccggcgcagcctagatgtccctggtccatccacccagctcgcagcaacagggaggagctggagcattctgaaggagcacttttgcggaaaggtgaccaacctcgtcaacaagtctagacgagcgcgggttcaaccaccgtcatctgggcctccggctcttggagacgatcgagactgttcgctgtcttggctggagttggagtgcgaagccccacatactggcaaaagagcgaaagacccccctgtcgttgagcagacaccaggcgggcaccagcacattggtgggggctgcgcctgtaaccgttacttgcaaatacaacactccatgcatcgcacttgcggggacccacatcgta

SEQ ID NO: 608503 - DNA, 943 bp, Homo sapiens
ctacacggggtctgtcaatgtgtgcccccgtttagtggcgccacctctctgggcggcccccctgctgccggcgtggtcccgctgctctcgccctttccccggtatctctctcccggcgcccccctcctcgggcgtcccagagacccctctctgggtccttgcgctgcggggcctctcttcccaaaagcgctcgcttgggcggtgtctatcccctcggggccgcctctgatgtgctcctgtgtcttttctccgcagttatgctcctcgtggccaggtctcacccttggtccaactccatgttggtgcgccacgccgaacgccccgccgatgggttccccgtacgtttccccggtcgcccccaggcaatgcctcttcttcctcgccgttggcggctcccccctccctgccttgcaacccgcgggggtgtgatggtccccttcttttggagtcggaccccttggctgccttacatgggccgccccggcgtggcttataacaccagacgggttggttctttcccccccccccccccctgacccacgcgggggtttgtctccttcacgatcaattttgcgccccaggaccgccccgtcagccttgcccacggggggcagtatccgcaaccccacgggctcccccccccgccataattgcatcccacggcgcgttgctttcatgccctcatggatgtgtgccgcggcgcccccggaggcgccctggcttatgtatggggccgagtgaccccccaccgtctgttaatgtctcccgccactatctcctcccccgcccagtgtttgtgcgggccccctgggctggttcatatgggtgccggggtgcgggcggcgcttaacaaggcttctttggcgtaccaagtccggtttggcccctctccgcgcttcaataagcaaccaatacaaaaagataaaaacaaaaaacataaaca

SEQ ID NO: 608504 - DNA, 359 bp, Homo sapiens
acctctaccccacgatcgaagtcttttgcagatcttaatttaattaagttttccttcgtttttttttttggttggtttggtttccttaaataggatttcctgaattccttggtacctaaaatcgatattggtgtgggaaacaatattaacggatttttccagtatattttctttatttaacttattttttatatgtattggtggtgattttatacctcagtatgtggcctatgttgtaccttgtaactttcatgattattttataattactttttacaagataacttctattcaatttataatgtctgttttataatcttccttcccagattttacctgtttaaaaaaaaaccactttt

SEQ ID NO: 608505 - DNA, 537 bp, Homo sapiens
tagggtgaggatgtttgtggcctagttttgtggaggggaatgaggcagagtggtagaatagaaaggagtgcagttcgggaggtatgaaaagaaatatattgagaaaaatgctaactcttatgtgatatgtatttcctcaaatcactttctaaatgaaatagttgattggaggaagagagcagtaaacatgtccatataccatatgtagtaatctgatataaagagattaaatcttttgcctaattatatctcttccttcagatccctttagaagtacattttcagtcaaaaggatggtttgaattgtttccaagcttaggcttatatttaaaactgtagggttgacttgagaataatctgaacttcatggaaactgaaatttcagaattgcaactaccaattgagaaacaagtgacatgcttatggtgattatcttaattgtaactgctggactaatatataaactaagaatgtaaatcttttagtttgattcttcttatccttgaaggaaaattagcttatggtataacacgtaaa

SEQ ID NO: 608506 - DNA, 628 bp, Homo sapiens
agatgaccgccgtgtggtaacgtgatgaaccccgaccctgtatgaacgtgagatgaccagcgtgtggtaaacctgatgaaccccgagcctcatgaacatgagatgagcgacgtgtggtaaacgtgattgaacccctgagccctgattcaagcattgagtgatgacgcggcctgtgtgtcgtaacactgatgaacctccggagcgctgattgaagcattgacgattgacgcggctccgtggtggtatacagcttgatgaacctccggaggccgtgtatcatacattgagcgatcgaccgcgctctcggtgtcgcgttacacacgttggattgagaccgcactgtaggcccgttgatcctaagcattggagcgattgacgctgctcaggttgttgtgttaagacgttgattgaaaccgcatgtacgccgattttcacgggcgttattggaggcgttatcgagcgactcgttcgctcgcagcaaccgtttaaaggttctccgtcgtttaaccgttaccgcagttgttccgtcgtttaacattccccttacggcgcgggtctgccaagggggaagccaccctggggccccggcgggaccgcggtttcccaagttacggacggttgcacttcg

SEQ ID NO: 608507 - DNA, 568 bp, Homo sapiens
acgagagtaccagggagagcaggatcatatggagggcctattggatatacggggtacaaggacggtgctatctactctatagtatctcccacataccatactaacttgccaaaattatttctatctacctggattagattattatcacattggcaggctttatatgaggatataaatgaggtcatagatatatgtaaaatgtgtgacataaaataggctcgcaaaaagatagctattgttttgaaaaaatagaaatacaagtggcctatgagcccagatgtgatattcctttaaattagatattagacttactcacatttctaaatgtagacattctgagaatccatttgagtacctgacttgagagtactgacagtctaagaatttagaaaatactgatgttcttcaataattaataattgctttagaggcttgataagacattcagatatacctagatacatataggtgttaattaaagtccataaaataaagcttcatggtttgaagtcatacacggaatttgaacaatatgcatacacagtctatgctgcctgtggattagaca

SEQ ID NO: 608508 - DNA, 380 bp, Homo sapiens
  misc_feature (73)..(74): n is a, c, g, or t
ctcacatcatccagaggatgtatggctgcgacctggggccgacgcgcctcctccgcgggcatgaccagtccgnntacgacggcaaggattacatcgccctgaccgaggacctgagctcctggaccgcggcggaaaccgggcttaagataccagcgaagtggaaggcggcccgtgtggcgacagctgagagcctacctggaggcctgtccgtgagtgctcgagatacctgagacgggaggagacgctcagcgcggacccccaagcacacgtaccacacccgtctttacatagcacctagtctggcctgctctacctcgagataaatactgcagcgatgcgagacaactagacatagctgtgagcagcacagagtggactca

SEQ ID NO: 608509 - DNA, 170 bp, Homo sapiens
tctgtttaagagaattaaaatagagtgatgtgatgtagggtagctgggaagtcaggttggattaaatagtcaggcaggcctggttctggaagaaaccagccattcaaaatgatccagagcaggatgggaaaagggcagaagaactaaggcaagactgaggttgacatatt

SEQ ID NO: 608510 - DNA, 266 bp, Homo sapiens
  misc_feature (103)..(103): n is a, c, g, or t
  misc_feature (105)..(105): n is a, c, g, or t
  misc_feature (162)..(162): n is a, c, g, or t
  misc_feature (171)..(171): n is a, c, g, or t
  misc_feature (174)..(174): n is a, c, g, or t
ctatcttctgtcccagggccgccgtcaccatgggccgcgagtttgggaacctggcgcggatacggcacgtgatctcctacagcttgtcgccctttgagcagcngncttcccaagctatttcagcaaaggcatccccaacgtgctgcgccgcactcgcgagcnattcctgcngtnggcgcgccgtttgtagtggtctacctgatctacacatggggcaaccaggagtttgagcaagtcgaaaaggaaagaatccagccatgtatgaa

SEQ ID NO: 608511 - DNA, 730 bp, Homo sapiens
tcctagggtttatcgtgttgagcacaccgatatatttacagtaggaatagacgtagtacacaccgatgcatatttcacctccgcgtaccataatcatcgcgtatccccaccggcgtctaaagtattatagctgactcgccgaacactccacggaagcaatatgaaatgatctgctgcagtgctctgagaccctagagattcatctttcttttcaccgttagtgtggcctgactggcattgtattagcaaactcatcactatatcgatcggtactacagcgacacgtactacggttgtaggccacttccactatgtcctatctaataggagctgtatttgccatcatagtgaggcttcattcactgatttcccctattctcaggcctacaccctagaccaaacctacgccaaaatccatttcactatcatattcatcggcgtaaagtctaactttcttcccagcaacactgtgcctcgaggctatccggagatgccccgacgttactcggactatcccgatggatacaccacatgaaacatcctatcatctgtaggcgtcattcattgctctaagagcagtaatattagtaatattcatgatttgagaagccttcgcttcgaatcgaaaagtctaatagtagaagaacgctccataactcttggagtgactatattttatgccctctagcctagcaagacattgcgaagaagccgtatacataaaatctag

SEQ ID NO: 608512 - DNA, 203 bp, Homo sapiens
gtaaggaccgccacacgcccggctaatttttttgtgtgttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtctta

SEQ ID NO: 608513 - DNA, 134 bp, Homo sapiens
ctcaactccatgagataagacctagaagtgaggagcagaggcctccagccaaaagccatgtgagggagccatcttggaagcaattctccaggcccaaacttcagatgactgtgtgtcccagccaatgcatcagt

SEQ ID NO: 608514 - DNA, 4998 bp, Homo sapiens
caaaagtattttgccatggatatagaagatgaagaaaacatgagttccagcagcactgatgtgaaggaaaaccgcaatctggacaacgtgtcccccaaggatgcgagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctaatgcagctgaatgagatcaagcctggtttgcagtacacactcctgtcccagactgggcccgtgcacgcgcctttgtttgtcatgtctgtggaggtaaatggccaggtttttgagggctccggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggcggacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcacagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaagaatccatctttcagaaatcagagcgaggggggtttaggctgaaggagaatgtccagtttcatctgtacatcagcacctctccctgtggagatgccagaatcttctcaccacatgagccaatcctggaagggtctcgctcttacacccaggctggattgcagtggtgcaatcatggctcactgcagcctcgacctcctgggctcttaagcgatccttccacctcaaccttccaaggagctgggactacagaaccagcagatagacacccaaatcgtaaagcaagaggacagctacggaccaaaatagagtctggtgaggggacaattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacaactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctgacccgggcagacatgatggggggtgcagggggctgtgggcatccagcgtcatcctccagaacctcacatctgaactgggggcaggtgcataccttggggagggagtagggggacacgggggaccaccaggtgtccacggttgtccccagcatctcacatcagacctggggcaggtgcgcagtgtggggaggggatggggtgcgtcagggcccagcatcgccgcctggcatctcctcgccgcagcatttccccttctgaaccgtccagtgactgctttcaatctcggtttacgtttagaaattgagttctactgagtagggcttccttaagtttaggaaaatagaaattactttgtgtgaaattcttgaataaataatttattcagagctaggaatgtggtttataaaataggaagtaattgtgtcaggtcacttttatgccacattattttaattgcaaaaaagcatctatatatggaggagggtgggaaaatagaggtaggaaatagtagcctaaaggaaatcgccacacgtctgtctaaacttaggtctcttttctccgtaggtacctccctgggtagttccacacactaggttgtaacagtctctccctgaggagcagactcccagcatggtgtagcgtggccctgtcatgcacatggggtcccgcagcagtgactgtgtgtcctgcagaggcgtgacccaggcccctgtagccctcagcctcctctagaagcttctgtactccttgtaggatcagatcatggaaaacttttctcagtttacttctaagtaatcacagataatacatggccagtaatcccaggctggccattcattcaggttttttaaaggatatttaacttttatggactagaaggaatcacgagggctactgcacaatacatggcctaagttccctctgttccttcctctgaatcgaatggatgtgggtgaccgcccgaaggccttcacaggatggaagtagaatgatttcagtagatactcattcttggaaaatgccatagttttaaattattgtttccagctttatcaaagacatgtttgaaaaataaaaagcatccaagtgagagctggtgagaccacgtgctgctggcgtagtgtaggccagacattgacagtcctgacgggagctcagggctgcccagcgcccagcgtgcacgggacggccccacgacagagggagtcagcccgggaggtcaggagcgcggcgggcgagggccctgtgtggaccacctccaccaagctcagagatttgcaccaggtgccttgttgcctccgctcaggatgaaagaggagctgagagaagtgctctgcctgccagtgcagtgcccagctccaaggctctagagggtgttcaggtgggtctcctggggccatggggagagattggtgcagaccttaccccacagcatacacctgccacagcgaaatccagggtgttggcacctgtgtgtccgtgatgagcctaggaaaccagagcaggggcagaggggcgtcatcctcccaccggacgctgggagctcagaccccaaaactgaaacaccgtggcttcggcggggggtgtgcctcctgatgtcaggagccccatccacgtgtgtccacacagatctcgtcgcagcacggcaggaaggggtgctgcttagggctcattgttggggacatgaccgggttcagcggctaaaacatctgccccacagcagcctcctcctccaccgaaaagggtagttgtctccctgaagcagtcacagcaggcgtctctgccgctccgtcaccacagtggggttttgttcaggcaaatcgcgctggggttctgcacctgcaaaaggagaggggtctgttgtcgctggctttcccccaagcaggctcttgcacactctagaaaaaacaccttgtaagtctgtgcatttttattgtcttgataaattgtatttttttctaatggggattgggagatggacttcgtttttaaaaatatgtggattttggttaccaagtttagtgttaatatattccatatacatacaaaactacccggtatgtctggcttttcccttctgtcaggtaatagctaaagtcagcatgattgctccctgtaccaccccaaataagtgagtgcctcaccttgtggggcctgagcagctaccttgagaccatgtgaggtggcacctttccggggtggactcgtgcggccttgaggacaggcacagggcaccctatcccaagccgtccaggcaggaggaaggcagccaaggcaactgggttctgggagccctgggtggggcagctgtggggaggaactgggttcggggcagccctgggcagggcggctgtggggcaagaactgggttcggggagccctgtccggcggggggctgtggggcggggagctgggttcggggagccctgggcggggtggctgttggggggaactgggttcggggagccctgggcggggtggcttttggggggaactgggttcggggagccctgtgcggggtggctgttgaggaggacttgggttcagggagccctgggcggggtggctgtcagggggaactggtttccgggagccctgggccggggcagggggcggctgtaggaaggaactggtttcggggagccctgggcggggcggctgtggggaggaaggtgacgtgcaggggaccagaggctctgcactgctcctaggacagctcatctgtaatcagaaaaaaaataaacaaaatacagaacgc

SEQ ID NO: 608515 - DNA, 495 bp, Homo sapiens
cacgaggcgtggaagcgctgcgcagcgcattgatgcggcagccgatcaggtagagctcgccatcacggatcagcacgtagccgtcggtcagctgcacctggccggcgcggatcgccttgatctcccagccggacagcacgacgccggcctcgaactgttcctcgatgtggtagtcgtagcgggcgcggcggttctcggcgatagacatggacggaaatgtgggggctcatgcccttcttacaatcccggcattctatgaagcaggtcaagaagtccgtgctgctctggcacacgccgcacgagatgtatgagttggtgacccaggtggagcgctatccggagttcctgccgtggtgcaacaaggtcgaggtgctggcccgtgaaggcgattcggtcaccgcgcggctgcacctggcctatgccggcgtcaagcacgccttcaccacgcgcaaccgcaacgaggccgatcgcagcgtgcgcatggagctggtcgac

SEQ ID NO: 608516 - DNA, 884 bp, Homo sapiens
tgccactctgtgtcataatgccctggtgggccgctgtgactacctcggggttgcttactattcgcggtcccgtaacaacacccgttccttgtcctccattagtgccttctgcttacgcgggattattactgcatgtccttgttaccgcccgcaagatcggtttgtgttctctcgccaggagttgtttcttgaacccgttgcatacaatgacaggcgatgtgcgcttcctgccccccattatgtggctggtgctcagtgcccccacaaacgtggactaccccccgcgctggacattccccgttcgtgagtgtcccctccgcggattgacaacacttcctctcttttgaatcctccccacaggggttctactatctcccctggcgcctccccccttaatttttaaaatggactcccacccgctcacccctaatatatgtctcaacccgccttcgtttactcaccaacaatgttcagcaaggggcgttatactttttcgcacctcccttcaaattccctcctaagatacattatgagatacgtcccctgtacacccaacatgtccgccggcatattaccggctccacacaacatttgttgtttcagcccatacgtttccccggccttctcgcctactcattgtgttggcgcctacccagttctcacctactgaatcttggtttgatcgccgccgcctattagatagttgtgtcccttgtaactccacccaacatcaccttcctggggggtcaggatacgcgccgcgcccttgtgaagctcgccctgtttattgaaaacaggtgtgtctaggatattttctgaatattggacaccaccaactagtgatagttgggaggggtctattaaacagaacataaccaaaaaca

SEQ ID NO: 608517 - DNA, 417 bp, Homo sapiens
tacagacaggggttggcggtgcccaggcggggtctcgagacacctggggtgcacgccactcacacgcgcacagagctcccaaagagcggggataaccagcatgagccactgcgctcgggcaatgtgcccagagacctgagcacagaaactgtgaaatcataactgtgtgttattctatgccgctcaatagtggatatttattacacactagacagatatcagaaggagaggaggtctgaggtgactcctgttctcacagggggagatatctctgtgagctgaggggggtcccagagacctgtacgcgcacacacttccccgcctgtctgttcagaaccccaccctattccagcttagctctgctcgggtctgggcaaaggtccttgcagagctcgcctgcctgagcgtgcagtattg

SEQ ID NO: 608518 - DNA, 328 bp, Homo sapiens
aaaaagcccccccccccccttgggggcaaagggcccggcccttttttttaatcctggccctttaaaaccacccctttttttccaaaaccccccccagcctttttcggggctttttgaaggaccccctgaaaatttttttttggttggttgttttaaaccaacccgggggggggggaccggaggccccccccccaattgtggggtttgggaaagccagccttttttaatttgggaattgggttttttttttaaggggggaaccccgttttttttttttccatggggcccggggcccttttgttttttaaaaaaaccggtttccttccca

SEQ ID NO: 608519 - DNA, 264 bp, Homo sapiens
gaatagaatcttagttcaactttaaatatgcccacagaaccctctaaatccccttgtaacctttatctgttagtccgaaagagcaacaactcttatgtctattaggaataaaaccttgatctatgagagtaaaataataaatcacccatccattggtctaactagcagccaccaattattgaaagcgttcacgctcaccacccacatatcctaaaaatccccaaaatttttactgaatttcttcaacacaagctgctgaagagg

SEQ ID NO: 608520 - DNA, 135 bp, Homo sapiens
agaggatcccagcgctgagcattatattaattacataaaaatagtttccggagtagcagagtaagcatcatactggtctgttagcagcagcgtggggcacggggcagggcgcgggggtctggggtggatggttaa

SEQ ID NO: 608521 - DNA, 339 bp, Homo sapiens
ggcgctctagacggatccccggtcgggcccctggtggatgctgttgattccttgagtcctcgtatcttccatgagagattgcttccactggactccatgtcgtttgcctcagctcattccaggatgatccctagaaggatagtgggagcaaataagaagctgatgtcttctagctcatgtcctttggctagcatagaagattttttttagatattgtcctagtgcgggctgctattgagacaccagtggctaaaactgggtcacatgtctatttttaatcaactgcttaaaaaggacttagtctccctgattgacttaagtaaataatcatccatttcc

SEQ ID NO: 608522 - DNA, 741 bp, Homo sapiens
  misc_feature (64)..(64): n is a, c, g, or t
  misc_feature (386)..(386): n is a, c, g, or t
  misc_feature (671)..(671): n is a, c, g, or t
  misc_feature (735)..(735): n is a, c, g, or t
ataacgtgctggtctgcgttaatcgcaccagcgcgcagcaaccgttgcaggtatatgatttttngtgcgatgcgggagtcgaattcatccagtttattccggtggtcgagcgcctggctgatgaaacaactgcccgcgatggacttaagttacatgcgcctggtgatattcagggtgagctaacggaatggtcggtgcgccccgaggagttcggtgagtttctggtggcgatattcgaccactggatcaaacgcgacgtcggcaagattttcgtgatgaatatcgaatgggcgtttgccaattttgtcggtgcgccgggtgcggtttgccatcatcagccaacctgtgggcgctcggtgattgttgagcacaacggcgacgtttangcctgtgatcactatgtttatccgcaatatcggctggggaatatgcaccagcaaacaatgtgcagaaatgatcgattccccgcaacagcaggcgtttggtgaagataaatttaagcagttaccggcgcagtgtcgcagttgtaacgtgttaaaagcgtgctggggaggctgccgaaacaccgttcatgctcgatgccagcggcaaaccgggactgaattatttgtgtgccgggtatcagcgttatttccgcatctaccggcatatcttaaagcaatggctgattntgctggcgcacggtcgcccggccagcgacattatgcatgcgcattgtggtggtgagtaagtagnaatcgg

SEQ ID NO: 608523 - DNA, 561 bp, Homo sapiens
gcggccgcctactactactactaaattcgcggccgcgtcgacatcaaatggctggaatccactgcactgaaaactataaaatcaactgctgaaaggaaaggaaaggaaaggaaaggaaaggaaaggaaaggaaaggaaaggaaaggaacggaacggaaaggaaaggaaaggaaaggaaaggaaagaaaaaagatcaattagcggaggtctctaggagatactcgtcactagatgagctcaggaagccagttcttagtagctctgaagcagatgaagaattctcctctgaggaaacagactgggaggaagaagcagctcattaccagacagctaattggtcaagaaaaaagccaaaagcggctggcgaaagccagcatactgttcagcctccgggcagtcggcttcaaggtccgacctatgcggagcccccgccctacgtagtgcatcagccatgcgcagagagacaatgcgcagagaggcaatgcgcagagagacaatgcgcagagaggcaatgcgcagagaggcaatgcgcagagagacaatgcgcagagaggcaatgcg

SEQ ID NO: 608524 - DNA, 434 bp, Homo sapiens
tgtctgttttgacaatcggcgccgcgctgtcgctgacggcgggcgtcgcactggccggcagcgacacccggtccggctgcccagatcctcaatgcgctgaagccgaagtccgccacccgcggcctctcggctggcccccaggtcgacccggccgcctccgccaaggaagcgagcttcctcaacaccgttcgcaaccggcagagccgctcgctatcacttggcgaacgccaggagatcgccgacatcgcggccagcaagccgaagatcgatctggagattcacttcgactacaactcggccgatatcagcaagggctcgacccaggcggtgcaggagctcggcaaggcgctgtccgataccagcatgaagggctcgaccttcgtgctcgccggccacaccgacgcgatcggcggcgaagcctataaccaggccgc

SEQ ID NO: 608525 - DNA, 382 bp, Homo sapiens
  misc_feature (22)..(22): n is a, c, g, or t
  misc_feature (309)..(309): n is a, c, g, or t
  misc_feature (331)..(331): n is a, c, g, or t
  misc_feature (349)..(349): n is a, c, g, or t
gagacggagatttcctcttgtngcccaggctggtggctcccctccattgtgcaatgatgcaatctcggctcactacaaccttcacctctaggcttcaagcaattctcctgcctcagcctcctaagtggctgggattacaggtgtgtgccaccacgtctagctttttgtattttcagtagagatagggtttcaccatgttggccaggctagtcttgaactcctgacttcaggtgatccacccacctcaggctcccaaagtgctgggattataggcatgagccaccgcacccaatcccagctaattttggnattttttgtagagacccggttnttccaagtttgtccaggnttggtctttgaaattcctgggggttgaagcgat

SEQ ID NO: 608526 - DNA, 131 bp, Homo sapiens
catcacacggatcacaaccttcgtacgatgacatcgaccctgacggtcgtgaaaaatcggtttccagctcaatttccgtgtaacgccgaacaaattcctgccaccaccggattcaacaggcctgcccacca

SEQ ID NO: 608527 - DNA, 159 bp, Homo sapiens
tgtggagtctggctctgtcaccaggctggtgtgcatgggctcgtgatctctgcctcacggcaacctccacctgcaggtttcgattcccctttttcagcctccctagtagtctgggactacgggtgtgagccaccacgcccagccggggacggtgcgttg

SEQ ID NO: 608528 - DNA, 330 bp, Homo sapiens
  misc_feature (330)..(330): n is a, c, g, or t
ggcccttctcaagtcactgcttacactgcatacatggccaaagccaatatcctgactacacataaccagtacctttaagggggtgtgacctgaagatcctgatgaacatgcactttgacctgaagctcaccaaatggtgcctatacaggatgcaggccacgagtgccgacgacatgactgcactataccgaggatatcaaggtccttgtatagcccaaggaggttcaatgccatatcccatggtacagcaagtcgaatgctagatcgatttgccgacattggaccccgagcttgtgcgtgctcgagcccgtattgccatggagctcggcn

SEQ ID NO: 608529 - DNA, 162 bp, Homo sapiens
gttttctgggagagcactagagatgagagaaaggagtctgaggagttactcagttaagagagagctccggcggtctgactgggatgtgacaacatagtacatgtacgctgccccagatggacgcggcctctgacggctgtatggcagaggtttcccgcctca

SEQ ID NO: 608530 - DNA, 194 bp, Homo sapiens
agctttggtttaattcagcttcaagactaggcacagtatcttggggaggctgtacacacagtgagaaggtgagagggaagggaaactaggcgaagctgttgcctccctccagaaactatgccccatgttgctcttctgttctattctcagagcatttggcttggttggaagggggtgtcctcattacatgcaat

SEQ ID NO: 608531 - DNA, 912 bp, Homo sapiens
cgtacttcgctttggtatgtagcacaaggcttccatttctggaacggtttcttgtgcttaaacaaggtcagccaggtaccagattctaaaagaacaagattgtcccccacccctcaagtggacttctgatctgcacgagaatgtgctactaccgctctgtagtctcccctaatcacgagaggtctagtgaaattgatggaggaagtgcaaggcttgcttcccctcaggccttaaagcttaaagcagtggtaagattcctcagtccagcacactacagtcccagtgcccagcagcaccggaagttgtatactggcctcttatcttgtcttcaaatgtgcaggaaatttgaaactgtcatctggaactaggttccatctcttatgtgtgttagatcaaaccaagagaatgcccccagctcatgcccaaatgctgcgttcaaaagcctgccttccagtccttacaaaaacttgcaggattccacatgtgttaacttttttattttgtacagtttctaagtgacttttgctagtgatgttaaggatgaacttaagtttatttgaggggtgtgagcacctcctccatttaaataactggtgactttccttttattttttaaaagtggaaacccgttgatgtgccctctcgatttcaagggttgctgatgacatgattcttaagacgcagcatggatcctttatataccgaaatatatgtccctttgtgtgtttatggctatttcagaagaaaatgaaaccttttacttgtgctctacccagtaaactgcgctggtacatagacgcaactgaggcaaaccaactttttgttaacccacctctgactaacctttgtagtatcccagtgacgcacttttggaaatattcggatcctagttgctaaagtattttaagctgc

SEQ ID NO: 608532 - DNA, 209 bp, Homo sapiens
  misc_feature (7)..(7): n is a, c, g, or t
  misc_feature (120)..(120): n is a, c, g, or t
acttctngtctttttatcacaggcatgaggatgtggcctgcatgctgcctgatcttgcctagaaccggctgcacctgctgttctcttgtttatgcaaactggctgcacctgctattcctntgcttatgcccctacccctggctatcctaattccctgttctcctgcctcactattactgtattctctacttctaaataaaaataaaaca

SEQ ID NO: 608533 - DNA, 417 bp, Homo sapiens
gcaccatggacaggatagttgactgaagaggtcattcatattccgtagggatggttgcaagagtatgagaattgaattcccgtgatctctaattgcttttgtcccagttgcactttctactcagggtagtcacttgctgaaggtaactgattggctcctcttggcctcggactttcagtgccgctctcagagcatttaagtcaatcagtttattcagtgtgtatcgtaacagtatcgtctagtatcatcatccattctgactgaaccttcacggacatttgcaacgtatccggatgtgtattccatagtagggaatgtcgtaccttctctcaataacagggcgaccgagtcaataatatccttttcccgctatgtatccgcttccgcataaggctcgagctagtgccgaattcctgc

SEQ ID NO: 608534 - DNA, 92 bp, Homo sapiens
aagcagccccaaaactgtaacctcaaggaaaccataaagcttggagggccttaatttttaaccagtttccaataaaacggttttctacctga

SEQ ID NO: 608535 - DNA, 304 bp, Homo sapiens
atcccccttccttcgctggattgacagatctcattcctttacttgctctttgagcatgtgatcctgccagcatgagtaggttcacgatttgaggtcgtgctgagtgctgtgtcacgcttgtatcccggcattttggtggccgcggtgcgctctgcataccgtcctcaaattcatactctcttcctagctattccagtgctgtatccactaaaaaatacaaaaaaattagccaggcatggtggcggacgcctgtagtcccagctactttggaggctgaggcaggagaatggtgtgaacccaggag

SEQ ID NO: 608536 - DNA, 341 bp, Homo sapiens
tttttgagatggagtcttgctctgtcgcccaggctggagtgcagtggtgcaatctccgctcactgcaagctccgcctcctgggttcacgccattctcctgcctcagcctcccgagtagctgggattacatgcgcgcacgaccaggcctggctaatgttttgtatgtttagtagagacagggtttcaccacgttggccagggtggtctcgaactcctgacctcaggtgatctgcccgccttggccacccaaagtgctgggattacaggcgtgacagccatcactcggccagagaaaaagagttcttaatgtatgttttcagttatttaaaattctaggaaat

SEQ ID NO: 608537 - DNA, 385 bp, Homo sapiens
ggggggaaaaaggggggggaaattttttttttttaaaaaaccccccccaatttttccccgggggggtttttcccttttctttccccccccccaaaaaaaagggggttccccggcttttttgccggggaaaggggggggccccggttttttttttcccggtttcccccaagggggattaaaagggggttttttttgtggggcttccccccagggggaaaaaggtttaaccaggtttttggggggtttttccccccccccagttttttttggggggagggggtggggggccccccgccccctttttaattgggggggtttttcccccggggggtttggggtttttttttttttttttttttagggcccctcccccgggggttgggca

SEQ ID NO: 608538 - DNA, 538 bp, Homo sapiens
ataggggtcctctgagacatatactgctaacaaatctaagtgaggacattaaaagaaagaaatcttagtttcagcatcaaaacacagtcaagaacatagtgaatgcaggctagggcacagtcggctcacggcctgtaagttccagctattctgagacggctgagtgcaggcaaattcacttggagctcagtgagttcagcgaccacgcctgggacaacatggttgaaagtccgtgtctctacaaataaatataacataattagctgaggtgtggcagacatgcaccgtgtagtcccagtctacttggtgagcctgagtgtgggaagactcgcttgacgcccaagaatggggcaggctgcctgcgcgtgagctctgatttgtgccactgcactccaacctgcacgatggagcaagaccctgtctcaaaacaacgaagtaaactatcttaaacctattttttatcaagtggtcaactgttaacaatcaagatttatacacacttggccaggcagagtggaccacacctgtaatcccagta

SEQ ID NO: 608539 - DNA, 189 bp, Homo sapiens
ccgacagctcacggaacgttgaccttcactatattgttcgtaactggcagctcccgtgatctctgtgctagttgcttcccctgtgtgtaccttatgtcatagcttctgggtggtgttcctttactaggctgttactcgcgagaatatgcaataacttaagtccagtcggcgagatttatcgcattttta

SEQ ID NO: 608540 - DNA, 426 bp, Homo sapiens
aggaatttctccaaacatcgtttttacgacgttatggataagcttgtattacagtgggaacatgtctccggaagaagatatttttcaccaaagttcctacatgaacactttgagttcttatcaatcaataggtgatccttgatgatccttctgtggattttatttgattctttagatgagtttaacatgaaaatgatgtaggactttaccacttttctacgaattgtttccaaactggctgatatgaattatgaatatcaacttccattgtcatcaaattcacaggtaaggaatgtgaagactctcaattggtattcaatttgatgagctgctaggctaggaatagtattactcgcaccatatgcttggctgtctgggctttgatgatgatctgcttttactagtatctccccttgttactctgcg

SEQ ID NO: 608541 - DNA, 442 bp, Homo sapiens
  misc_feature (265)..(266): n is a, c, g, or t
  misc_feature (268)..(268): n is a, c, g, or t
  misc_feature (271)..(271): n is a, c, g, or t
  misc_feature (276)..(276): n is a, c, g, or t
acaccctctgcacacagcatagccctctctctctccagggctgttggttctttctcctgactcctgtggttttgctaatggcactttacagactccatggagatgtcaggtggaccatcttctagggcccagcaggagtagggaatgtgccaacagactgcccaggttgccgtggccttccccaccccccagatctcctgagtcatcatgctgtgctaatgaaagggatcatatcatcctctctggggatggtgggtgggggtgnnantangcggnagctcccttaccccaactcaatgactagggcggtaagttctcatccttttgatgcctgcctctaccttcacttatacgggttcagactatgcatactcggaacttaaggattgagggttaacctagttgacgcattggtacccaacctacgtgacctggaactctg

SEQ ID NO: 608542 - DNA, 139 bp, Homo sapiens
aaccacacgaagtgctgggataacaggtggtagagccactgtgcccagcctgagataaatctatagagtttacaactgtgaacaatagaggatgtagtacatatattgtaacaccctgtaccccaccacacagcaacct

SEQ ID NO: 608543 - DNA, 201 bp, Homo sapiens
gtgacatggttttgatttgcttctctctgatgattagtgatgttgaacatctccctcatatccttgttgccacctgtatgtcttctctgaaagtgtctgttcatgtctcttgtctatcgccgctaatgagatgtatttggcttggcctcctgctaatgaataaggtcccaatagatctgatatagaccctgttgatgcaag

SEQ ID NO: 608544 - DNA, 421 bp, Homo sapiens
accccaaatggatctacttcatccatgtgattgagaataatagttttgtttttttttaaggccaggagtggtggctcacgcctgtggtcccagctctgggaggccaaggccagtggattgcttgagcccaggagtttgagaccagcctggacaacgtggaggagccccatctctactaaaaatacaaaaacaacaaaacaaaaacaaaaaacacctcagctgggtgtggtggtgcaggcctgtggtctcggctgctccggaggctgaggcatgagaatcccttgaaccacagatgcagaggttgcagtgaactgagatcgtgccactgcactccatcctgggcaacagagtgagactcggtctcaagagggaaaataaggcatttttctcatttaaataataaataggattccattggggg

SEQ ID NO: 608545 - DNA, 394 bp, Homo sapiens
agttaggaatggcaggcccccctggcatttggggttcaaggtggctcctgtggcaggaacaggtgtccatgaccctaattacctggatttcccaggttttgggaaagcaataagggcctgctgtggctattccaacatttttggtcagggcctggaagtaccttaggacacatggggttggggtcaggactgcattttcagggaccagtggaaagccctggaccaaataaaatggagtttaggcctcttttgtgactgggacttgtgggacgtgggaggcctgttaaatccaggactaaaaattattctgtttcctaatgggcaaatatgtaagtaggtaagtgggatccccaggtaaacgggatccaaaaataaaaactgtgttttttcctta

SEQ ID NO: 608546 - DNA, 418 bp, Homo sapiens
gaattaaaaaacttttatctgaaaaatgcaagtccttttagttatcaaactcagagacgttaaaataaaagtgcaattatgtctttctcctccctttgaattctgtattcatcttttgagactgttcactattgccaacaggaagctataaattgaactaataatgctacattggacactatatcccataccctaaactataatgatatgtatctaatcaataatcaatgttatttttgtaaataaatagaaatttctgacaaacaattttgcccactctgtgtttctcttattgtctttacaaatcttcttgtaaatgctgctactcaaagtgtagattccaggcaactttaatctttgctcgcaggttatatataatctgtaaactttacccaaataaacagtaatacttatattc

SEQ ID NO: 608547 - DNA, 296 bp, Homo sapiens
  misc_feature (152)..(152): n is a, c, g, or t
tgagccgagatcccgccactgccctccagcctgggtgggcgacagagtgagactctgtctcagaaaaacaaacaaacaaacaaaaagaaagatcagactgttactgtgtctatgtagaaaggaaggtaagaaactccattgtgatctgatgntgaccactgttttgccttgagatgctgttaagctgtaactgtagccccaacactgtgctcacagaaacatgtgctgtgtcttgttaacaataggtttgcaggcagcatgcttggtaaaagtcatcgccattctccattctctat

SEQ ID NO: 608548 - DNA, 274 bp, Homo sapiens
tcccagactgtctaccaggtgtcaggttaggagttggaagcgcatatgtgcctcatctgctgttcgttagtctttctctcttatttccatcatctgcctcactgacctttctacatcatctctcgcttccttgtgctccctatgccttttaggtgtggcccatcgacaattagggacaagtcgcctaactcgcccccgcctgatatttcctccaggcttctggccttcaccccctcccaaatagggggattcttcttcattctgcgtggtggcc

SEQ ID NO: 608549 - DNA, 140 bp, Homo sapiens
tgcggtccctctccacatatcacaccttggttcatatcctggtccacacaccatagccctctctactactataaccaggaccaccgccatagttgccaccatcacctccaaatccattatatccaccatcacctcctcca

SEQ ID NO: 608550 - DNA, 388 bp, Homo sapiens
  misc_feature (310)..(310): n is a, c, g, or t
gctctagaggatctttcgggttgtgcatctgagaaggagttgcaggctgaaaggaggcaggtaattctaaacagaggcggcaacaaatataaaagcatggaggtgtgtgaaagagatgatcagggcacagttgagaatgcaaactcaaatgcctacagggaccaagcaggtaacataaatgagtgaaacacatcagttacaagaaaataaatgacaatgactcttgacctcaattacgggaagactggagagagctgagaatagcagcaaataggtgactgcaaggccctcacagcacagaatatagttngtccataccatccgctctcacattctgcctttagtaagaagtgggttttaactattcacatggccacgtagatgagga

SEQ ID NO: 608551 - DNA, 138 bp, Homo sapiens
ttcacaagccagactacaaggtggacaagacatgttgagcgcaaatgttgtgtcgagtgcccacctgtgcccagcaccagctgtgtgcagtgaccgtcagtcttcctcttccccccaaaacccaaggacatcctcagg

SEQ ID NO: 608552 - DNA, 424 bp, Homo sapiens
  misc_feature (3)..(3): n is a, c, g, or t
gcnctagcggatccttaatatgctgtctcaccattctagcatgccagtagaacatacatgattcatgggaggtagaaatattaacattgacaaggtgtatggaagaagtttattccaaccctcatggataactttgaggggtttaagacttcagtggaggaaatcccacagatgtggtgaaaacagaaagagaactagaattggaagtagagcctgaagatgtgactggattgctgtaatctcatgacacaacttgaaaagatgaggagtagcttcttatgggtgagcagagagagtgatttcctgagatccaatttgctcctggcgaagacgctgtgaacactgttgaaatgacaactaaagatctagaatattacatcaacttagctgataaagcagtaacaggatccgagacagcatatca

SEQ ID NO: 608553 - DNA, 153 bp, Homo sapiens
tacatggcatatctgcagcacattcggcttctcgcacattcgacggtttctcccatgttggtccaggctggcctcgcacactctcgcacctctaggtgcatctgccgtgccttgagccttcccaacagtgctgggcatcacaggcgtgcagcc

SEQ ID NO: 608554 - DNA, 248 bp, Homo sapiens
ctgccacgactattgatctctaccagtcgcactgggatgatccgaaacgcgttgagatgttctcggcacctatcaggagcgatcaaggccggtaaagtccgtgcaatcggcgcatccaatctgacaccggaacgtctgacagaatcgcttgatgttgcgaagaagcatggcctgccgcgctatgaaaccttgcagccgctttacaatctctacgacagatcggcttttgaggatggacttgaagcgat

SEQ ID NO: 608555 - DNA, 420 bp, Homo sapiens
gcacgagtctacacaacgttttcaactttctagtggttgattcgcccaaggggagcactgcagagcagtataacgaggcgtgcttattaaagggtgacattggagaccgtgctttaccactacaaagatctttacaagttgtctgctaaggagctgtccaagtgtttggaactatctccggatgaagtagcatgtctgaccaaacgccataaggactacgtagagcatatagctgactctcgtctcgccaaagggtacgtacaaagggtccggtatagccacagtgggtggcgggaagttctcccttatggcatttttgatcattaagactttaaggaatatggggaccacgttacctgtggaagccctgatcccttctggtgatgaaggtgaaactgagttttgtgacaagattctgcc

SEQ ID NO: 608556 - DNA, 399 bp, Homo sapiens
  misc_feature (17)..(17): n is a, c, g, or t
  misc_feature (290)..(290): n is a, c, g, or t
  misc_feature (312)..(312): n is a, c, g, or t
  misc_feature (322)..(322): n is a, c, g, or t
  misc_feature (327)..(327): n is a, c, g, or t
  misc_feature (341)..(341): n is a, c, g, or t
  misc_feature (352)..(352): n is a, c, g, or t
  misc_feature (369)..(369): n is a, c, g, or t
  misc_feature (371)..(371): n is a, c, g, or t
  misc_feature (379)..(380): n is a, c, g, or t
  misc_feature (383)..(383): n is a, c, g, or t
  misc_feature (385)..(385): n is a, c, g, or t
  misc_feature (387)..(389): n is a, c, g, or t
  misc_feature (394)..(394): n is a, c, g, or t
  misc_feature (396)..(396): n is a, c, g, or t
  misc_feature (398)..(399): n is a, c, g, or t
atataactacaatttantttcacgttgacaaaacacagtgaaaagacaactttgtgaagatctaattacaataataaataaaataatttatacaagggtttttttttcttgacttttctataggggtcatattcattaaaaagcccaaaaggctacctttgccttaacccttctgtagtacaggaatgattcttagattttgtttccttttgttatagaagcaaatatttgtttttttaaaatagccttgagatgagaggttatatttggaccccaccagcgaacacacnaaggtggaggacaaacgaggcncgcgggaagntaganggcgaaacatctangaaatgggcangggagcggggggggggngnagtggggnngtncncnnnggggntngnn

SEQ ID NO: 608557 - DNA, 223 bp, Homo sapiens
  misc_feature (116)..(116): n is a, c, g, or t
  misc_feature (118)..(119): n is a, c, g, or t
caggggacccgttcctcttgaaccagtcatccctttggcaaatgtgtgtatgagaatttggggggtgggagcggggccctgatgtggagtagacagtgcgcacctcaggcccacancnnaccccccctggggccttgagcgcaggcctcatctttctgtgcaccgggactccgcacctacctcacagggttgttgtgaggctcaaataaaacatcactcagca

SEQ ID NO: 608558 - DNA, 968 bp, Homo sapiens
tagtggaagccgccgccgcgctcgctacgatcgcaggcgccgcgtagccgtcgccaacgccggcagcccgtgcgccctcggtgtgtacccgccgcgctcccatccccgtcgccggccagggtgcgcgctctggacgcccccgtgacagatgatcccgctgcggctccgcgttggatggccacgcaatgatcgacaaagaggcttgccgggagacgggcgtacaacctggtgcgcgacgacgagcttcggccggtccaatcttggcttgacttttaacatatgaacggctcgcaccatcgtccccccgggcgagcagggtaaccggaggtaccagcacttcaattccaggcagtgccgcattatgactgtcccgcgtttgtgagcccgtttcgtggcgcttcaccagccgtaggtaatgcccatgagcaaggaggtcacagacggcttttgccccttcggtacaacgtgtggctcgggttgagaaacgtccgagcgtggcctgctaagcgagagcccaggaacgcggcgacggggaacaaacgactcctgggtgaaagggagggccgtaccggaacttttcgctaacgaggcgttgggagatccaggtgattcggaacggcttggagggaacgactctcattcaacgagccgagctgaaacaaaggcgggggggcgccacattacgacgcccaaagacgggaaaaagcacagcacccggcaaacaacccctgacagtgtcatctgctgctccccggggaggagggccgcagccaggtatatcccacagcttccaggagaaatgacctggatatccgcgcaccgggttcaatgtcaactttcgtcctaaacgcgggcaataaggcggactattagatctatacagccatcttgtaagaagtatggcggtcgcgcaaacgtctgggcttatattacacggatcaaacgcagtaagggacaagtttacggcc

SEQ ID NO: 608559 - DNA, 124 bp, Homo sapiens
tccccccccccccccccttaaaccgtaggttttgggcccaagggccggggggggggggggctgggaataccccccttggggggtgctttccccccttgtgtttttttttaaaggggccgaggga

SEQ ID NO: 608560 - DNA, 657 bp, Homo sapiens
ggacggagcgccccggtgccgagattcgccagccaggccgcggtagctttaggattgttatagtatacttggacgtcagttgaaacatggcttcccggccgaggacgagttccccgacctgagcgcccacaaaaccacatggccaatggtgctgacccccgagctgtacgcggagctgctgcgccaagagcactgccagagctgtgcttcactgcgtggactgactgtcatccatgacatggctgtggacaaccctggtgccaccctgtacatcatgacctgtggtgctagctgtgtgctgtgtgctgactgatgtgagtcctactgaagttgttcaatggatcgtcttcgaccccaagtcatctgatggaccggtgcactggctggctacaatgcccagctgaatgatgcacaagaccgacctcaaccccgacaacctgcagtggctgtgcgacgacctgtgaccccaactacgtgcttgagctcgcgggtgcgcacgggccgcagcatcctgtggcttctgcctccccccgcactgcgagccgcggggagctgccgagccatcgagaagctctgcggttggaagcccttgtccagcctgtacgtgcgactggcgggccgatactacggcgctcaagaggcatgacgggaggcgga

SEQ ID NO: 608561 - DNA, 2829 bp, Homo sapiens
  misc_feature (370)..(370): n is a, c, g, or t
  misc_feature (409)..(409): n is a, c, g, or t
  misc_feature (413)..(413): n is a, c, g, or t
  misc_feature (438)..(438): n is a, c, g, or t
  misc_feature (579)..(579): n is a, c, g, or t
  misc_feature (587)..(587): n is a, c, g, or t
ttacaaacttaccatctcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaggattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaaganaggtggcccaagtagcagagttgccttccaggaggtgcngggnaggcatggtctacatggctggactngtttttgctgttggtggctttaatggctcattaagagttcgcactgtagattcctacgaccctgtgaaggaccagtggaccagcgttgctaacatgagagaccggagaagcactttgggagctgctgtgttaaatggattnttatacgntgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtgtcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgatcccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtggatgccaaactttctcacacatacaatataaattatgcttatttattatacttcttctagctatcaatcttggtcatgttattcggtgctgtattttccaacttcttcttctcttaccacttaacactttggcatgaacattactgcaggtagcttcgcatgaatataatgcaatgtactggacacttcacattgacatttgcatgggtctatcgcgcaatttttatgccttgttgctgctatcagccactctccagcttgcctaattaaacagaacgacgaggaacttacctggtgagtaagcccatgatgttgttcgactcaagattacaagtatgacactcgacaattccttcacgattaatcctcaccgtttgcaacgcaagtggaaccccaaaaagaagcagtgatgcttatcccgttggcaaagttgtcaaaccttcccggcagagtcaacaggaggcttgccgggtcattagttccaagaaggagcgcgaaggacaaaccgcgacagacgaaccgaccaccgcaaagaagcaggcgagccgcgatcggcgccgcgcacactcagcgaaacaacaccagtcgcacgaggagccgcaggcaggctacggtgagggacaacaggggagtagcccgaaagggagggactacggagagcatagaagcaatgcgcgcaaaaacagcgcgcgggtcaagccagaaagaggaaagaacggagggcccagaagcaacagagggggtggaggaaaactaacacaaacacaacaaaaaaaaaagacaccccgagaggaaaaagaacggaggggaaggagagaagaaacaaaaacgcagaaaaggaacgaaaaactaagagggcacaaacaggagagaaaacaaacaaccgacagaagaagcacaaaacagcagcacgacagagaagaaagccacgagggcgacgaggta

SEQ ID NO: 608562 - DNA, 2173 bp, Homo sapiens
  misc_feature (449)..(449): n is a, c, g, or t
gttaattgactgtatcagtaaggcgtttggtcaactgtaagctattagtaattaaattatgcgggagtaaaaaattatacatgggtttttgactgcgtggagggtcagcacccctgacccccatgtcggttcaagggtcaactgtatatttaaactatataattttattacttttgacagagtatatacccatgaaaccatcaccacaatcaagataatgaacatatccatcatgctcaaaagtttctgtgttcccttttgagtatattttccaaattgtaactacaaagaggagagttttcactgtcatttagattcaaatgataatactactaaagtttaagaaagagattctgaaacatgatttgtacagttcctcctgccttcgtattataatgaagaattgagtgttttctcagagatacagagtgctgcctgtgacttctttnttctctcttcatttctttgctcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtggatgccaaactttctcacacatacaatataaattatgcttatttattatacttcttctagctatcaatcttggtcatgttattcggtgctgtattttccaacttcttcttctcttaccacttaacactttggcatgaacattactgcaggtagcttcgcatgaatataatgcaatgtactggacacttcacattgacatttgcatgggtctatcgcgcaatttttatgccttgttgctgctatcagccactctccagcttgcctaattaaacagaacgacgaggaacttacctggtgagtaagcccatgatgttgttcgactcaagattacaagtatgacactcgacaattccttcacgattaatcctcaccgtttgcaacgcaagtggaaccccaaaaagaagcagtgatgcttatcccgttggcaaagttgtcaaaccttcccggcagagtcaacaggaggcttgccgggtcattagttccaagaaggagcgcgaaggacaaaccgcgacagacgaaccgaccaccgcaaagaagcaggcgagccgcgatcggcgccgcgcacactcagcgaaacaacaccagtcgcacgaggagccgcaggcaggctacggtgagggacaacaggggagtagcccgaaagggagggactacggagagcatagaagcaatgcgcgcaaaaacagcgcgcgggtcaagccagaaagaggaaagaacggagggcccagaagcaacagagggggtggaggaaaactaacacaaacacaacaaaaaaaaaagacaccccgagaggaaaaagaacggaggggaaggagagaagaaacaaaaacgcagaaaaggaacgaaaaactaagagggcacaaacaggagagaaaacaaacaaccgacagaagaagcacaaaacagcagcacgacagagaagaaagccacgagggcgacgaggta

SEQ ID NO: 608563 - DNA, 201 bp, Homo sapiens
catccagcggaagcttctccgtaaccttgtcttttgagcacactacacatgaaaacatatctaagggtcgggcatatcagttctttccgagatatactcccctttcctgttgtctgaccctataaaccacacatctctcgcaacctctcttcactgatggttttcagggtctcaacccaagctgcagaggagtgtcccgaa

SEQ ID NO: 608564 - DNA, 178 bp, Homo sapiens
agtggactccacgacgtactcagtgccagcatcgccccacttgtattttggagggatctcgctcctgtttgatggggatggtattaccattgatgacaagcttcccgttctcagccttgacggtgccatggaatttgccatgggtggaatcatattggaacatgtctaaatgcaatca

SEQ ID NO: 608565 - DNA, 260 bp, Homo sapiens
ggggttttcccttttaaaaaaaaccccggggggggggggggatttttttaaacccaaaaaaagggcattttttttcccccctttggggttaaaaaaatttttttggcccaaatttttaccacccaaaagtggcgggccccgggaggggtttttttccctcaaaaattttttcagggggaatccccgggccccccccctttttttttttggggaaaagattttaaaaaaccttttttttgaaaaaacccttttggggggga

SEQ ID NO: 608566 - DNA, 415 bp, Homo sapiens
  misc_feature (356)..(356): n is a, c, g, or t
gacctagaggacgtcacactgggtcgagtctcggcttcatactgtcaaaaggagtcaagggcaatgagtgccgccacctccacactcatgcactgtgcagaggacttacacagaccatctacaacatagctgaatttcctgacatgttctatactacctctttcttaaagttattttactctaggatagggaatttactatacaggattcctccacatataaaattactctttctttatatccttccttgcaaaacaaacaaaaaatacattttctattcataatattctttacatctctcttttctactcactgggttcactcatgttttgaacctcccatttagtaacttccgngattagacaaaaaattttttctaaataaagaatacatttctttagcacattttatggaa

SEQ ID NO: 608567 - DNA, 690 bp, Homo sapiens
tacagaaccgcggacacagtgagtattggaggcatagctcctggtaggcatgtgtgagaacatgctggagtccatagtcgactaatcagtgccttgtgtggcacaggggtatggagtaacaggtcgacacgcgtcaaagcgaattgagctaggttgcactacgttgagtacatcactaacagacttggcgtttggaggcactccggtggaacatagcaatcccatacgcaaccaaaatctcggatcacaggcatgaccagagtgcactatggcggacacaagcgcgtctcccgagggaattgtctgaacaagaagttcgggggagtaatctgggtgactagtctcgcatgtttgggacctgaaggtgagtagaactaagtgggtttctccaacaattcggggggaattggttgggagcacgcatttagcagccacagatcagaagagtttaatcaaacggggataggtcacaacatgctagttcaggaagatggtcagcctagtgaaaaggactttgggaagtagaaaggggtacttattcctcggggggatggaaatggtggcgtgttccaaggagtcgaaagacaattggtgggtctggtcgagggggaatgtcgagacaggtgggaaacaggtaagctgggtgagaagggaacaagaagaagcaaatgcaatgggaagaggcaggat

SEQ ID NO: 608568 - DNA, 725 bp, Homo sapiens
  misc_feature (137)..(137): n is a, c, g, or t
  misc_feature (346)..(346): n is a, c, g, or t
  misc_feature (481)..(481): n is a, c, g, or t
  misc_feature (606)..(606): n is a, c, g, or t
  misc_feature (618)..(618): n is a, c, g, or t
  misc_feature (641)..(641): n is a, c, g, or t
  misc_feature (657)..(658): n is a, c, g, or t
  misc_feature (667)..(667): n is a, c, g, or t
  misc_feature (670)..(670): n is a, c, g, or t
  misc_feature (673)..(673): n is a, c, g, or t
  misc_feature (676)..(676): n is a, c, g, or t
  misc_feature (678)..(679): n is a, c, g, or t
  misc_feature (696)..(696): n is a, c, g, or t
agcggagtgagctgagatctcgccactgcgctccagcctgggcaacagagtgagatccatctcaaaaataaataaataaataaataaatgaaattcaacgttccttttatgataaaagccctcggcagattgggcantgaaggaacatacctcaaaatagtaaaactatctatgacaaacccacagtcgccatcgaactgaacagcaaaggctggaaccacacccctggagaactgagacacgacacggatgcccacttttaccacttctgttcagcatggcactgaaggtcctagtgagagcagacaggcaggagagggaggcaaaagccatccaaataggacanagaaattaaacaatctctctttgccgatgctgtgattctacacatggaaaaccctaaagtttccatcagaaggctctttgaactgacaagtgaattcagtagagtttcaggaacataaaaacattgtaggacaantaagtagcatttttatgaaccaaaatcattgcagctgataaccgggtcgggaacacaatccagtttacaatggccacaaagaaacgtgaacatacctagcgaattcatccaaccaaggggggtcnaaagaccactanaaggcgcaagtgaggacactgtngagggagatccagagnntgacacatnaantgncanannatccatgctcatggctnggcacaaatcacatgtcggcgtgggctct

SEQ ID NO: 608569 - DNA, 781 bp, Homo sapiens
gtgtggagctgtcgcccagtagaccccgccgcagtaccaggaggtacctctggacgaggctgtgactctgcgggtgcctgatatgccagtgcaggcacctggccagcttcatttagtgctaacccatccatgcattcgggccacaacgttcacgaagccagccatccatgacccgtgcaggatccaaggtgaagacagcgggctgcgatgtgacagcctgtccagtcacagccctagatccacgactcttgtgactagcctaagggctggagccgcattcaacggtgcttccagtgtcacacaccgagcgcgaacctcatcagcctgaccaaccgtgactagtggctcacagaatgcccagactatccgagctagtcaccgcttgaaacgtgtgctgagctttcctattgggttggcacgttaagtgcgttcgggaagaaataaggcacattgcggtgggcggcagataacgcgggtctacttctcaccgcaggcttccgtgttcaagcgttggctcgctcgaacaagagccttcgagccacacgtagtagtgcaacacgaagggcgcgacggaccgcgtccgtgagggaaaactggccatgggatgcttcaggaaggcgggaaaacacttcaagaacggccccatttgatcccccgatgattggaattcagagggccatggcagcgcagcctgcgtaacacagtacaagaggagccacgtgcaagatggcatgtgcgccgccagaggactgcttcacccgttgcgtcatgtgtaaaactg

SEQ ID NO: 608570 - DNA, 786 bp, Homo sapiens
cttgtgccaaatattatattcaaatggtatgccaatagccattgctgccagatgcccttctttcactatggctcatcatgctctctgatccctcaggttctgtcataagcctcatgtttgtatgaccggtgctggttctcagctgaactcaccctgcccctgtgcacgtgtctcaatggttggttcacctgaattccccagatttcaatgccaggatccccatggtgcacttgacctcttggtgtaagcattcagcatctgaatattcattgggattcccgtcaagcatttctaactgtgatggaacaagaattatcgaatgacaaagctcgatagcaaaataggcaccgtgtgtccttccccctccctcttattttatagcataacacagagagtatgggctgagcatggtgggcaatggctgggcatgatggttcatacttgtaatccagcacttcgggagggtgaggcagctggatcacctgaggtgccaggagttcaagaccagccatgtgcaacatggtgaaatcgtcatctctactatagattacgataatacagtgtaccatcatgtctattgacaactacctttttgcggtggctgcgaacgccctaaaaaccattcatttgaacatatgggtggggcggcagatacctttatttgttgttgacgcatgctaaactacttgggatcccgaagaacagccggggtccaagataataggatagatttgttcccgaatgagatccgccgggggtaccacgagggtgtcttgaaattctcac

SEQ ID NO: 608571 - DNA, 535 bp, Homo sapiens
ctccatactgagagcgggtgggagagatctgttcccaaaggaaaagcagggggctgttaccaaagaattggaaacaaacactgagcaggcaaaactgcagcagtcctcaacaccacccttgaaattccctgaagataacaaatctcacttgtgtccttctgtgaaatttaattattatttcttttgacagggagattcacattttaaggaggctagtggcacatccaaattgctattataaccaaatctctttagaaagaagctatggtagtggtgtcaccaaggggtgttctgcaccatagcaattgcccatgtcagcatgctgcggtaggctgagtaacggctcctctagagatgcccaccctctaagcccccagacctgtcaaagtcacctcacacagcaatagggaccttgctaaggtgatcaaaatgagagattttgagatgggagattactctggactatccgggcaggcccagtggaatcacacaggtcattataagagagacagaggaggaggccaggtatggtggg

SEQ ID NO: 608572 - DNA, 254 bp, Homo sapiens
ggcagctggagacagtggcactgatgtcctgtcatctgcttgaacgttccagatcaagcacagcactgataccagtatgagagcacggtgtacacctgaaaatgaagggtgatcactaccgctccttagcagaggtcgcttcaggggagaagaacaacagtgtggtcgaagctcactgaagctgcctacagggaagcctttgaaatcagcaaagagcagatgcaaaccacgcatcccatccggctgccattggg

SEQ ID NO: 608573 - DNA, 199 bp, Homo sapiens
cgcccagacataacaacatttaaaagatacacttaaatttcttgaaggtaggcttattgcttgcaaaattaggttttaaaattaaacaatttgtacaggtattcatttattgcttgacattccacgtcctagaccaaggctttgttggccaccagcattgacgttcttgccatcagaggagcgtacagatacagcttta

SEQ ID NO: 608574 - DNA, 289 bp, Homo sapiens
cggtgactctagcaggatcttagctcatttcagttcggctgatcttgcggtggcaaggccttcgcggctgacttgcaaattgggtgatatgggtggcgtccactgccaattgggtgaggatcaggtcatgcagcatgcgtgggaaatggcggctgccggtgctggcgatgaccttgcctatctgtgggaacaggtgtgagttcatcaattcgtccatgagtttcgtgcaggtattggggccttatagcgacgggggttaagaaggtaactaatgtgaataacctgcagt

SEQ ID NO: 608575 - DNA, 733 bp, Homo sapiens
  misc_feature (546)..(546): n is a, c, g, or t
atgatatcatgtatgagtctgtcttttcctagaggctactgatgccttaaagaggcctgattagtgcattcacacagctggcttacatggctctaacatcctggacaggacgataacctagtacaccgcagtgctgtggcgagataaagagtctaccatagccagactatgacaccagttcgtgtctcttctctctacgtgagaggtgcttgatctggcaaactaagcatcataaagcctcctctaatgagcgcgctatgtaacatctttccatatgtgagatgggaactgagccttcagttgatatattgctgtctacgacgagacggtcatctccacatcctttgagatgttcctctgcattgagactatcagactaacccagactgcttcactactaatggatactactgcattgttacaatcctcatcctatacagaaactgacctatggtcatcaatagatgagcctatatatcatacacagatacgaagcgaagtgacaacacttaactaatgcgatatttttctacaatgggtaaagtncctatttgaatactgctcgtcatgacgagacttacctcgatgcatagtgtggctaccgttgatcagcccattatagacagtagtagaggccctgaggtgtcatatggtatgatcttaagcagacgatcaagtccctctcgaatcttttcatagatcatacactttgctctattgagccaggttactg

SEQ ID NO: 608576 - DNA, 230 bp, Homo sapiens
cccgactagcccgacaggtgctgaggggagtgaggcagtgaggatgcatggggcctgtgtggaaccagagagaagctggggtcagaggtaggagctgacgctgtcgggctagtcggggactgtcgggctagtcggggactgtcgggctagtcggggactgtcgggctagtcggggacttgtcgggctagtcggggactgtcggactagtcgggggggtacctgagctcga

SEQ ID NO: 608577 - DNA, 205 bp, Homo sapiens
atatctcgcgccacccaccccccacattctcacgagaacacgagaagggtgtggagaagaccacgagagccgccctgtccacatgccccaacgccacgtctcccaccacgcatataacacgggtctctcttggcacgctgtaatttctggaggtctggaatgttgctcttctaaagagccctttaaataaaattttgtaccaaga

SEQ ID NO: 608578 - DNA, 693 bp, Homo sapiens
ctatcatatagtaaaacccagcccatgacccctaacaggggccctctcagtcctcctaatgacctccggcctagccatgtgatttcaagcttccactccataacgctcctcatactaggcgtactaaaccaataacactaaccagtataccaatgatggcgcgaatgtaacaatctgagaaagcacattaccaaggtccagcataacaacccatcctgtccaacaaaggccttcgatacgggagtaatccgtatttattacctcaggaagttttctttcttccgcaggatttttctgagtccacttttaaccagctccagtcgctagtcacctctagcctccacaattaagtgaggggacactggctcggcacaaacaggcatacacctcagctataatctccgctagaaggtcctatttcctaatacaatattcgtattgacttcgtactgaggagtatcaatcagactgagactcagcatagtcgtattagaaaaaaatccgaaaccataagtcattcgaaagctacgtggttatttactaaattttaatggggtctgatagttttacccgtgcgtaaagtctctagagtatctgtcgagtgtcctcttcaaccatcatccgaaaggcattgtaaaggtcaatcatatttaggaagggcaaaggtgccagggacttcacgtcattatgggc

SEQ ID NO: 608579 - DNA, 208 bp, Homo sapiens
tcaactgaccaaacaggcatattatcacgtgtctatagcccatggatacggtcaaaaggaaagagtggagcagtagacaccctaggaattattgcttcacaattaggggcatggtgaactgcaggggaaaggaaatgcagctttatttcctttaatctctttatttctgtccctgagtaacccaaatgtcttcagactcaccagtctg

SEQ ID NO: 608580 - DNA, 2946 bp, Homo sapiens
ggcacgaggtactttgggagaccaagcagggaggattacttgagaccaggagtttgagactaccatggacaacatagcaagaccccatctttacaaaaaatttaaaaattagccagacacctatagtaccagctacttaggagtctaaagtgggagaattgcttgagcctgggaggttgaagcagcagtgagctttgatcatgccactgcattccagcctgggtaacaagagtgagactgtctcaaaaaacaaaacaaaacaaaaaaatgggtttttttgttgttgtttttgtcttttacttaggacacctgctctagaggctagataaaaatagattgtaatggccgggtgcagtggctcacacttgtaatcccagcactgtggaggctgaggtgggcggatcacttgaggtcaggagtacgaagaccagtctggccaacatggtgaaaccccatctctactaaaaatcaaaaaattagttgggcgtggtgatgcgcacctgtaattctagctacttgggagcctaaggcaggagaattgcttgaacctgggagatggagattgcagtgagctgagatcgtacccactgcacttgcatctgggtgacaaagcaagactctgtcttcaaaaaccaaccaacaaccaactttttgaaattgaattgcaatatgtctgtctttggcttgggctggacagttatctaataagcaggcagcttcttgtgtgctatggtaataagccttcttaacaggctaagcttccctcataagaactgtggtgtttctctttttttttttttgttttggtttgttttggttttttggttttgttttgttttgttttttaaatcagtatccaatgttttataggggccaaaggttaactttgcactattccctgtcagttaaaggccactgatatttttctaagttagcaaggctcacttgcttgctttcttgcctcccttgcctccatccctctcccttcctaccttctctatttacctatttctctccctccctctcttctcctctctttttttttcccccgcatatgccagctttttcgattggaccttgattttatcgagactgcttagttccagcaagattgggagtcaggcatggagcaggcatctcaggcttccagaaagaattggtcacctagactttcaggcaggcgggctcgtttgcattgtcctgcagtcaattagttgataaatagttcccccttcatcccttaagttttgtttttgtttttgtttttaatataggtaagtgggactctacctaaaattttgcatcatacttatgggtaatatctttttcatatattatttatcaaagtatgaagttgagtattttgcttgtaccatttcaattctgcattatagtagttcattgtataactgaaagaaatgatttcttcataagtgacattaaatatgaacattcatccaattgaatttacaaaatctttccaaaattataagggagaaaaatcgggtttacttcaatctttaaaaatctggcacctcttagtaactttcagtatttctaaattgctctaaaattttataataaatagattagggttttgcaatagtcttaatttttaagccaaaggttttctgagaccttaggttttgtagtctaaccagcttatgtggttatttaaaagaatattctttgtgtttttaaattgctatttttaaaaaagctttttattacccattttataaaatgttatactcatatttgtctgaatttttccagtattcctacatgaaattgtatgtattaaaaactcaatattagtggcaaatattaatactattaaaatggattttggtgctatattcttgtagctaaagcctagtagaattctcaagaataggtgaaatacactttcaaagttgcctgtcatttaaaagaccaaataagcatttggtattaaataaattagcagaagggttagagacttcaaggagagttagcttggtcatttaaatgcgacttcatgttatttgattgaaataacccacatccttgctttgtataagatattcgctctggagaagttacatgtaaatagaattctataaattgttttccagttgaccgagtatctgttgtgtttttgtttaaaaagaggattccatgacataataaaaattattttaaaaaatgttttgagccaccacactcagccttattcttatattttaatttggtcattcttagatctacagattgaacatccctaattgaaaactttttgagtactaacatagtgttcaaaggaaatgcttattggagcatttagaattcagattagggatgctgaactggtgtaatgcccagtattccaaaatccaaaataatttgaaatctgaaacacttaatggtcccagcatgttggataagggatactcaacctgtattgatttttctccactataattcagttctataagttcttccctataaaaaatgaatgaattagaaatttgataataaaacgatattttattaattttaaactctatcttgcagtctgatcattcagaaaggtcaacctagaaaaaagacatggctaagtaaactattttaagccataactaagtatttggaaagccttcattaacacataaagaattttggccaagtactgtggcttatgcctgtaatcctagcactttggaaagccgaggccgacggatcacttgagctcaggagtttgagaccaacctgcgtaacatggtgaaaccccatatctacaaaaagtacaaaaattagctgggtgcggtggcgcatgcctgtagtcccatctactcggaagactgaggcagcagaaccgcttgagcctaggaggtggaggttgcagtaagatgagatcatgctgctgtactctagcctgggcaatgagagtgaaactcttatctc

SEQ ID NO: 608581 - DNA, 641 bp, Homo sapiens
aagatgtgtagttttaggtatattttaatcaaaatagtgtatacggcaaaatgaatgcagaagcattaatggaatccaggctgtcttctattaaactacatattaaagagatttacaaaaaatgtaaaacagggcatgggcatgccagcccctgcttctcagcctgtactcccagcacttagggaggccaaggcagtcggatcacctgaggtcaggagttcaagaccagcctggccaacatggcgaaaccctgtctctactaaaaatacaaaaattatctgggcaatggtggtatgcacctgtagttccagctacttgggaggctgaggcaggagaatcacttgaacccgagaggcagaggttgcagtgagcctagattgtgccactgcactccagcctgggcgacaagagtgagactccatctcaaaaaaaagcaaacaacaaaaaaaatatcaaatagaaggagtatctcaatatgccctagaaatttcactgaggtagaaggccccgtggagtttgtttcggatttattctccactttctgtcatgcaactatcttaccaatgtctacagtaggtactatttctctctcactaaatccaatcaccataatctcattgatgtcatggaccagtgtgata

SEQ ID NO: 608582 - DNA, 760 bp, Homo sapiens
ttcatgatggataaacaagcagggccccctacaggaattgattcttggagaggggatttacctgatggggggagaaaccacaccccctcggattcttggaaaagcagagacttttacccgatgttcctattacaactgctgtgcccctcgcagatggcactggtccttttctgaaacttgcgtatatcatagtgctgccgacgggaaggcgtggaaaagaggaaccaatgccacccccgacatcccagctggtcccatcaccgtgctattccagaaatcttcccaggagcttcgagacatgtcccagatagagagatagcctggcccccgtcaacgcttcctgtgtgtcccccccgtgactgggggaatcatacctcccgttacaccccgaccactatgatagccccacatgcccttgatgccacgcagcaggacttgccacatcagactcagattcccccacagccgactacaggtaaatggtatccctgaagaaaggaaactgactgaagccatggatttataatcagaccatatagccggtacatcacagttcttttctcttcccataatgcatgagcttttctggcatatgttatgcatgttggcagtattaagtgtatacccaataataccacataactttcattttactaaagtatttttttgtacttaaagcctttttgaccatttgtaaaaccttgatgactttatatttgttaccataaaagttgatctttaaatcaatattattaatgga

SEQ ID NO: 608583 - DNA, 287 bp, Homo sapiens
atgacaggcgcccgcacagcccaccaaaggggggccggcctagccatgcgatccactcgccacaccagaacgctcctcagacgaggacgacaaaccaacacacaaaccatataccaatgatggcgcgatgtaacacgagaacgcacataccaaggccaccacacaccacctgtacagagaaggcttcgacacgggataatcatatttataaactcagaagtatataacttcgcaggatatttctgagcctttaaccactccagcctagcccctaccccccaattagg

SEQ ID NO: 608584 - DNA, 168 bp, Homo sapiens
tacaaatgtgaagaatgtggcaaagcttttagccggtcctcaaaccttactaaacataagaaaattcacattgaaaagaaaccctacaaatgtgaagaatgtggcaaagcttttaagtggtcctcaaagcttactgaacataagataactcatactggagagaaaccc

SEQ ID NO: 608585 - DNA, 141 bp, Homo sapiens
  misc_feature (45)..(45): n is a, c, g, or t
  misc_feature (123)..(123): n is a, c, g, or t
ccatttttggcggctgggcctggcaaggcagaacaaaaagcgtgntaaggcggcagacggttcgggagatgaaggtgcgcatcctctccgagcggagaagcctctggacattgactacatggnggaggaacagctccggga

SEQ ID NO: 608586 - DNA, 899 bp, Homo sapiens
ttgggagtgtccattagtttgagtctaccattttgccgaaagtggtacacaagtccagtaggatgtcaaatgtggggaattagcatttgtgggtgagcgagactgggaatgaaaaattcacgtgtatcgctataactttctatgagttattgactagccatgaaacttcaaataagttaagaggagcacctagatcagagttcagcctttcagttcattggatagtctcccaacttggttgtgggactctgataataagtctaccagggtcatggtacgggatggtgaataacttgatgctccttttgtccacttattgaagataatatccctgacctaaaccgtgttttgtagcttgtacattgtaaagattctctatagtgaagacatactttgtcgcctgctcatttgtttgcttctaagtatatgcaactgacacaataacaagtcccttgctgaagactgaactagtagcctggcttcattatcttgatattacaaatagctaaaacaagtaaatatagccacatccttatctgggaatactgtaaagtgatagacagtgtagacaaagtagactgggaaagacagtgtagctctcgacatctagaattaaattgctgtgagtctcagcagtgtttttgggagtcaagtcaaatagttgttattattgttcttttttgcttgaaggcattatgtaaacaaagctctgctctttcaagaagataggagtcctgaatttgagaccttgacagtgattaataacatcattttgagcaaatagttgtcaagaagatcccaaataaagtggcgagatagtctgagagatcacccgcctgatggttaaagtcaagctttgcgacacattggaggaagtcaataaataaatatttgttgca

SEQ ID NO: 608587 - DNA, 382 bp, Homo sapiens
ctgtggcatgaggaagctggggcatcttctccacagggttcgcgctgcagctaggcagcatctccgcaggtccaggtagtgtaagccctcacatgccacgtcccctgggaccatcggcatgcagcgcctttctggccagatccaatcaccctcccgcgaaggtggctttcgcatgcgcttctgctccccagcgatctgaggagtgaacaggaccccacggacgaggtatctgccgggtgtggccctgctctggtcaccatcctggcgctccccaggggccggagccggggacgcccagcactgggggcggggtggttaggggcggccgttgcgatgtatgtggcaaggtgttcagccatacgcagcaactctgctgaggcac

SEQ ID NO: 608588 - DNA, 227 bp, Homo sapiens
  misc_feature (52)..(52): n is a, c, g, or t
tgaaggctactgacaactcatcctggccaggagaagacggatgatctgttanaaacaaggaaaaatatattcacatggtgaaaagacattaatatcttttgcacatgtatggcatattactaccagaagcacctgaaacagacacatcaccttcactttgggatgtgcatttcgctaagcagttagccacagtaaatgaacaaccccttcagaatggatctgaagaa

SEQ ID NO: 608589 - DNA, 98 bp, Homo sapiens
gggctccgtaaccgaaccctgagccgcctgcgcggatcggcgtccgcagcgggcggctgctgagctgccttgaggtgcacgtgttggggatccagagc

SEQ ID NO: 608590 - DNA, 224 bp, Homo sapiens
  misc_feature (115)..(115): n is a, c, g, or t
atcctgttaacgacccaaggagaactggagaaagaaagagacaaactcagttcgtggttgcattgtggatgcaactctgagctgttctcaccttgtgttatatgtaaaaaaaggnagagaatggatataccatggacttgactgcatactacagttgcctcgcctgcctggtgccccaaacagagcagcagtgaggaattcctgcggggtaccgagactcgaac

SEQ ID NO: 608591 - DNA, 260 bp, Homo sapiens
ccaacactagataaaatccattaacactgacatacaattgaccagctagttatagaagccattctttgtatcacctgaaagagctgaaaatgggggaaaaagaaaaaaaacagactggctagaatacacagctcctctagtggcattcctgttaaaacaacctcataggtcagagatgccactgatcactcctagatttcagtaaatatataataacattaatcattaatgtctgaacttgggtgttggggataacatca

SEQ ID NO: 608592 - DNA, 532 bp, Homo sapiens
  misc_feature (265)..(265): n is a, c, g, or t
  misc_feature (324)..(324): n is a, c, g, or t
  misc_feature (379)..(379): n is a, c, g, or t
  misc_feature (525)..(526): n is a, c, g, or t
cccattgagcaatgcctgccttcacttgaaaactccaagtactgccgtttcaaccaggacccagaagcaggtatgtttggagctgagctcagctggaaatcattggctttgtttttatgatccatgtgtgtgtggctgtggctcttaacagggtccaggtagctttgtatattatagagtatgctgtgcatgagtgtgtgtgtgtgtgtgtgtaagatagaggaagactttgcacatgcacacaaactcacacagtttggcacanaattaagaaacctcacgtgcttgtgccacttactgacctagcttctcccatagattagntttatatgccttgaggggcctgaatcaatatccatatttttccaactatcacggngcctaaaattggctgctagatggattattagtcaatggagagaagatgaaatattgaccacttgacccgaataagtggagggatggttcatgaagcaaacaggctggatggattttgggcccaaacttttttacttttaactggannctgggg

SEQ ID NO: 608593 - DNA, 460 bp, Homo sapiens
gggaaactggtgttgacggatctctactaataaatacagaaatctaactgtgatggcagttgtgagcagttgatagtcccagctactcaggagggctgaggatgggaagatcacctgaaccgtgggaaggtttgaggctgcagtgagccatgattgaaccattgcgctgaagcttgggtgacagactgagactctgtatcaaaaagaaaaaaagaaaaaattagccaaatgtggtggtgcgcatctctggccccagatacttgggaggctaaggtaggagggttgcttagagcccaggagctggaagctatagtgagccatgattgtaccactgcattccagtctgggcagcaaagtgagaccctgtctcaaaaatgaataaatacattaaatataatagtcctcaggttgggtcagttgggtgtatcctcatgatttcaggctatgcattctatggttg

SEQ ID NO: 608594 - DNA, 162 bp, Homo sapiens
cggcacgagggtgaccgagaactcgccctccagggtcttgatctgcacctgttctgctcccattcttgtgcccgggtcgggccccgccgcccgccgcgccggccccgccgtgaggtaatcttcttgccgctcttcttgccgccgcccttcttgacgcggccg

SEQ ID NO: 608595 - DNA, 891 bp, Homo sapiens
tccttgttaagtttccttctttgagtacaggaagatttgcacgtaatggttaccactttccttcggcattactgggtaaccatcctctcaatggtgtcactatttgtgcggacagatgagtacagcttgtgtgcaatactggttgatcccgtacaagttcttattttacgtttacgtttatgacgtatacccttaagagaagatggcaagatcgatcctcaaccttcgttcaggactgtgtacaaggctagtgcaataacctttctggtcacgcattcctgactgctgcaatcctggattaggtctatccaatgctgtgctggcaacgagtatagctcaacggcataccaaggatttatgaacgagaagtcttaaagacttaccttgtctagcatcacagtttaccttttgtcaatatgcatttactcccttctcatgctgatggtgtgctgattcgtttgcatgttatagtagcatgcctgtgaacttcgaagaccactagccattctgggaagcgaaccttacacaatggtatagaatcacggctgcatgtaacaagattctttaaattgtgttgctgataccaagttctgtactgttttgtataccgaatacaggaagatatgactatgtggaactatacgcataaattcgtgcacctcgggagggtgtaatactatcacagaagactcaagctaacgcatactttctgggtctacaaaagatactatggaatatagaggtccttgacgtagaacctaaggatcttttgaagggaagggaagtgtaagttatgcattacttatatcatccagattacattatgagaagccaatctagcatgtgaggggactaagtgttctcagagtgatgtttaatccagtccgataa

SEQ ID NO: 608596 - DNA, 456 bp, Homo sapiens
taattcagaaacaggaaagtcaacaatgcaatacaccttcctagagaatgcttagagtcatacgcacgcacgcaaggaaatcttctgattaatactactccaacaaacatcatccaaggaaacttacaccattttatccttaacgggtcaagtcctgtcttatatcataacccgacaactacccccacaacacatctccccattacctaacaaagcattgtatgcacaataagcactcacatatataaatgtgacatatgcacagcaaaccttaaacaaaaagccgaacagagcaagaatcgaaatatacaacagcaaagcaaacaccagcagcaagcaatcgcaatatatggttttctacagtgccagctgtcataaaagaggctcagcaataacaagtaacaaataacatgcacaggaacacacatgatggccaggatgccagcagctctccat

SEQ ID NO: 608597 - DNA, 378 bp, Homo sapiens
actactactaaattcgcgccggtcgacccaggtttgaccatctacatagtcttatttaacagaattactaccaatatgctcagccaaaaaggtgtgttatatggccaagcatctcctttgtatctggacataggtaacacataaagggggactaaaaaattatccttgcctcaaaaagttattttaacaataatcttcaagtggatttaataatgtcacccaatattagccaaacattgtggcacgcacctgtagtcccagcgactcggaaggctgcggcgagagtatcactttaagcccaggagtccaaggttgcagtgagctatgatcctaccactgcactgcagcctgggtgacagagtgagaacgtcgacgcgg

SEQ ID NO: 608598 - DNA, 248 bp, Homo sapiens
  misc_feature (223)..(223): n is a, c, g, or t
catttatctctttgtgatagtttaagcccctgcacctggaactgtgtatttttctgtaactatctctgtaaccattaattttttttaactttttgcgtgttctgcttctgtaaaaattgcttcagctaggctccccctgccctatttagaccacggtataaaaagaaatctatccccttcttcggggctgagagaattttgagctctagccatctctcggtcnctgacaatacaagaactcctgaatt

SEQ ID NO: 608599 - DNA, 119 bp, Homo sapiens
ttttcacagtgtggccctggttgtggtatctggtggactgtactaccatctagtctttggggctgtcctgcatccctacaccttggcctgcctgaccttgtgactgacctcccgtcgct

SEQ ID NO: 608600 - DNA, 327 bp, Homo sapiens
gatgagtcgctcccatcaggcgcacttctggactccagcctgggactagatgacgactctgtctcaaaaaaaaaaaaaacaaaaaaaaaccaaaacacaaaacatacgctccaaacttcgaatacaggaaataatgagcactggcccccccaacactgttttctctaaatatcactgcccactaacttgacaaattagggagaaatggatacacacgtgtcatagagaaagattcatcacattctctcagataactaaattaaattaagcagaataataattccagctaggaataccacacaaaatttgtgaccattcaaaatttaa

SEQ ID NO: 608601 - DNA, 119 bp, Homo sapiens
  misc_feature (65)..(65): n is a, c, g, or t
  misc_feature (76)..(76): n is a, c, g, or t
  misc_feature (94)..(94): n is a, c, g, or t
aaacaccttttctctttctctccctccttctctctctctcaccccaaccaagaagttgtttccangaatttataanagaatacttataattcangtagtaagaaaaccgagtaaaacag

SEQ ID NO: 608602 - DNA, 870 bp, Homo sapiens
  misc_feature (4)..(5): n is a, c, g, or t
tatnngtctcgtctagcagagtaatacacgaacagagacgcaagcagacagtgtcggtatatattacgaacattgggcctccaggtccgtttatccctttacacgctcccaacgcggctttttctgggacccatcgcactccctctctaaacagtgtcgttgtccacaataaatggtttcctgtctccaatgcgcggtctaataccccatgcaaccacgaagtttctcaaccacacagaaaccgtgggtctaccacagccgcccttctgtatcgtgtaatgcgccccccccctgctaagtacaagtctggcaaaagtcctttatggacaatctcatttgcaaggcgtccttacttctcaaacaccatgtgtttcttgatctgcgagaatatgggtcccaactgtttggaccactataattcccctcctgagcggcaaaattgtttccccacgcccacgggcccaagcacatcccaacagtgcgagcggcgtgctagttatgaaatacccacctttttaaaagctcttatgcgttacatgtaatgcatgattttgaaattattcactttgggctttggtggggacaaaaaaactttttccccaccccagttcttgaaagcaaacagtcggtccccccccaccatacaaagtcaagccgaaaataaaagggccgctcgcccccccgtcggcgcacaacaaatacatagtccttgtttcttcaaacacaaacattgaggaaataaagcgtttttcaacgtcgcaaccattttgacccacaacccttgcaccacttctaaccgctaacccccaaaatatatgggcacccctgggccccccgtctgccaaaaaaagccaatttcccaccaaaaca

SEQ ID NO: 608603 - DNA, 255 bp, Homo sapiens
  misc_feature (38)..(38): n is a, c, g, or t
  misc_feature (40)..(40): n is a, c, g, or t
  misc_feature (52)..(52): n is a, c, g, or t
  misc_feature (91)..(92): n is a, c, g, or t
ttcgattggcgggcacttacctacaccacagccacagnantgcaggatccgngctgtgtctgcaaactacaccacagctcatggcaacgcnngatccttaacccactgagcaaggccagggattgaacccgcaacctcatgtttcctagttggattcgttaaccactgagccacgatgggaactccacaggagcatgtgtcttttgagtgaaagttttgtctgggtagatgccaggtgtggatctaagttgcccg

SEQ ID NO: 608604 - DNA, 407 bp, Homo sapiens
gacgagagtgtctgtggatgactccagaacaccacctgtgaagagactcgaagtcgacacatctgtgtataggaagcgcgtgttggattttctcagaagcccttacacagctgttgggactggagggaggccacaccttagaacgagcgcactggatttcttctgtgagagtggagactctttttccaagaggtgtttgtgccctgcgtttcccactgtgggctataccgcgggttttggattgtggttctatggccgaggatctgtgaacccacagaggggccggcccttggaaccctgtttcagaccgaatgaacggatatgtttggcatgtgccttgatgccaccggcccctgtggacggcctttggccattcattcgcttgtgggatgtgaccgcgctgtttc

SEQ ID NO: 608605 - DNA, 118 bp, Homo sapiens
gacccttacccccagagaaacactgaatcaacttttgacagcccttggggtaagtagtagtacatcctttaaatgcactctttcttgaatggcaatagaggggggatatgcacacaca

SEQ ID NO: 608606 - DNA, 279 bp, Homo sapiens
gcacgagaattcaatagtttttgtgtatttacagtgttatgaaacctcattagagtcaatttttagaaccttttcattatcccataaagaaacaccatgccctactaaaaatacaaaaaaattagctgggcgtggtggtggatgcctatagtcccagctactcaggaggctgaggcaggagaatggcatgatcccaggaggcggagcttgcagtgagccgagatggtgccactgcacgccagcctgggcaacacagccagactccatctcaaagaaaaa

SEQ ID NO: 608607 - DNA, 297 bp, Homo sapiens
gtaggtgggattaccggtgcgacaccacgacccagctaactttgtgtatttttaatagagacggggtttcacctatgtggtcagtctggtctcaaacacctgacctcagttgatccacccgactcgtcatcgcaaagtgctgggattataggcgtgagccacggcacctggtgcatagtcagttgcacagtacattaagcatgctggtttgcaactgtccctgaaatagctgtcaccggccacacgcctaaagcctgactgctctgctaacagtcacctgtgcataccaagtttcct

SEQ ID NO: 608608 - DNA, 630 bp, Homo sapiens
agggagtttcactcttgttgcccaggctggagtccaatggctcgatctcggctcaccgcaacctctgcctcccaggttcaagcaattctcctgcctcagcctcccgagtagctgagattacaagcatgcaccactatgcccggctaattttgtatttttagtagagacggggtttccccatgttgaggctggtctcgaactcctgacctcaggtgatccgcccgcctcagcctcccaaagtgctgggattacaggcgtgagccaccgtgcccggcccaagaactcaaattctaaagacacaatctcagaataacaaatctcaaaggttatttgagaaagacaaaaacccactgcttaaaatgttagaaatgcgctccctaaaagtctcagaacaaatttttaagaatgtcatataaacagtttatgtacagaaattatttatttaaacctttgctacacatgcatacaaattcctattaaagcctttgaaacactttaccaaagtgtattactttggaaaaaggaaacctttaaatttttcttttcaaacacttttaaaattcccatttttaaaaggttcctatgttacacaaggttcccttgaaaccctattgggtggtttcattaaat

SEQ ID NO: 608609 - DNA, 701 bp, Homo sapiens
  misc_feature (228)..(228): n is a, c, g, or t
  misc_feature (234)..(235): n is a, c, g, or t
  misc_feature (325)..(325): n is a, c, g, or t
  misc_feature (546)..(546): n is a, c, g, or t
  misc_feature (549)..(549): n is a, c, g, or t
  misc_feature (551)..(552): n is a, c, g, or t
  misc_feature (554)..(555): n is a, c, g, or t
  misc_feature (557)..(557): n is a, c, g, or t
  misc_feature (561)..(561): n is a, c, g, or t
  misc_feature (564)..(564): n is a, c, g, or t
ggtcatgttcgcctggtacaggtgccgctgttcccagcaacgccgggagaagaagttcttcctcctagaaccccagatgaaggtcgcagccctcagagcgggagcccagcagggcctgagcagagcctccgctgaactgtggaccccagactccgagcccaccccaagggccgctggcactggtgttcaaaccctcaccacttggagccctggagctgctgtcccccnaacctnntttccatatgccgcagacccatagccgcctgcaaggcagagaggacacaggagagccagccctgagtgccgaccttgggtggcggggccntgggtctctcgtcccacccggagggcacagacaccggcttgcttggcaggctgggcctctgtgtcacccactcctgggtgcgtgcagacccttcccctccaccccccaggtcttccaagctctgcttcctcagtttccaaaatggaaccacctcacctccgcagcacccgacttaccagacgcatgcccctccctctgcctcatcaaaccacagacccggnctncnntnntnccanccnggctggtccggccccaggtgtggggtccgctctctccactcccagggctccgcgcccaagtgagggggccctgccggagcctcagacacactccagttcagggctgttggggggccttggcacatacctgtcccttg

SEQ ID NO: 608610 - DNA, 804 bp, Homo sapiens
cggggagtgcgcaccttattaggctctgtggacggtagagtaatgaattgctatccccgtactgtatggagttgtactgaaccacgtgctgggcacgcgcaagtgtatctgataggcggccgttcccgacacggtgatggagccggcacttatagcctgcactcagactgtaccatgtgtctgactccgaggggaatactggctggtgaggcgatagtcgccacacggccactgacacaggacctgcctcagtgcacgaggactgttacatcctggaccaggggggcctgaagatcgacgtgtggaaagggaagaaagccaatgagcaggagaagaagggagccatgagccatgcgctgaacttcatcaacagccaacgcagtacccaccaagcacacaggccggagcgtgcagaatgactcggggctgagtcggccgatcgtttacagcagctcttgccagaacgctggacaagcagtccaagcgcggactctcaggccctaggcaaaacccacactgtgggctccgtgggtgagggccaggacgggggcagtagagggagccaggatccaggagctgggcacaggagagcacacttaggtccaccacccaccctccttccctgacgtgcatcttcaagcgaagacttttacgctggctctgggcttgtcaatagcagatggggacgtggacaaactctagttgtcacaaaaagggatgctgagagggcttgggcactggtggcatagtgcctgtaatcccagcactttgggaggctgaggcgggtggatcacctgaggtcag

SEQ ID NO: 608611 - DNA, 358 bp, Homo sapiens
cctgtgattgatcaaagccattagtgacattacacagtggcagtactgtatgactgtgacaaatgtgcaccttccttacaggtaagcaatcctagcaggtgttattggctcacagaaatacctagaaaaagtagaagaattagaaaagttttaaatctatgataggtaaaattaacaagcacatctcaatactcagtgtttcaaaatacagtgagctatgagtttaaaaatgaatttagtgagttttgattacctactttaaaaattgaaataggatgaattagaatggaaaatatcagagttcagtgcactgggtaagataaatattgatgtgtgaaacttttgttttagttatgtg

SEQ ID NO: 608612 - DNA, 255 bp, Homo sapiens
cattttatacccgctctgtcttaggcgttgcaagagaggagtatatacagtagttcccccttatccacaggggtacattctaagacccccggtgggtgactgaaaccacagatagtaccgaatcttatacatactatgttttttttctaaacataaatacctacaataaagtttaatttttaaattaggcaccataattaataataaaacagaacagttataacaatatactataataaaattatgtgtatgtga

SEQ ID NO: 608613 - DNA, 244 bp, Homo sapiens
cgctcgagctgactacgcggctcgatctgactacgcggatcgttatgactacgcggatccatgtgactacgcggttctatctgattacacagagaagcacggcagcatgctccaaattaccgactcgagccgcgtagacagatcgcgaaaaataacagtacggaactgtttggatgccctgttattggtatgagtccactttaaatcctttaacgagtatccattggagggggtttgtgggtga

SEQ ID NO: 608614 - DNA, 452 bp, Homo sapiens
gttgctcagggctaccctctcacgcacaaacgagctcatattcgcatcaacggcggggcggttgaatatcgggtttatgctgaggacccccaccagtcttttggttgaccatctgtcgggagattgtctcagtaccaaggaaccgttacatctacctagtgtccgagtggacagtggcatccgacccggaggtgatattggcacttatgatgatcctgtatttcaaaactgatcacatatggctctgatgggaactgaggcactgaagaaaatggcggatgcactggatactgtgtttttcgaggtgttgcacatgatattgcattacttcgaagaggttgattatccactcacgctttgttgaaaggagaaatcatccctgaatttctctcccaatttgtacctgattgcttccaagacaccatgcctgacccggagtgagaaaaaccatt

SEQ ID NO: 608615 - DNA, 1058 bp, Homo sapiens
  misc_feature (492)..(492): n is a, c, g, or t
  misc_feature (681)..(681): n is a, c, g, or t
agagaggaagaagcgaggggcacggtcgtctgaagacagagctggagcatgagtgccagaccatggacactacagcccagcgaatagagacgggactgcggaggaaggaggaccctaggacaggtatccaggccggctggcctagcgagctcacacccaggcatctagtgactatattcgccagctgactggagtctcatgcagtggtgctacctacggcaaaggactgccgtacccaatcccttcagtcgatagagagatgctagaagactggggatggtagaagacgagcttgagtggagatgtgacgcgggcgaggatggcctacgggacaggatcctccctagcacaacatgaagagctaactaggaaaggaagacttagtggggcctccatcactaggggctaggctaggcacactacatcaagagtatgcactagcgcactggcaagcccacgagcttggtcgttgtgttgttccaatcccgttgnaacacaacacaacagaaaggacagagatatagatggggcacataaccagagggaattgttgccatgacgatgtaggaccatttcatacacagtcgtggagcgaaagcccgggccagaaatataggtccttcctgggaatccggtccggaacggcaattaggaaaaagcgcaatttgcaaaaggaccctnaattgggggagcatttagccacgcattggggagttggtgggtttgcccacaaaatttaagcgaacttgggttcgcccaagggacatttgcaagcaagggccccaagcttccaaggaaagatggggcgattgagtacaatttggagatagttaccacggggcaatattcagatccgggacgcccacagaaaaaccaatgggcgattgggagaaaaaccccaggttaaagtttccaaattccccggggttacttttccagcatatgggattggagcgcatttgggggggaaaacaataaggggccttggaggggttccagaaaaggcggggaaaaatcttggagggagaaaagccgcatatgaggagcttttaaatccg

SEQ ID NO: 608616 - DNA, 296 bp, Homo sapiens
agccaggaacgaaaagcaaagagattgttctgaagaccgcgctctttggcatttgaaagactgccaggtagtgcgagccggagatgtctggaggattctctctagccgcgcaccccgctgctctgaaggtcaactgagaagtcttgtgggacagagacttgagttaggaagccctcagtcgcttgcctttcacggtggcctgccctgctgccatcattggctgaagcaccatctagattcactggtcacccaactgcttcagggtactatgtagactttgcctcactacatgtcta

SEQ ID NO: 608617 - DNA, 293 bp, Homo sapiens
cccacgcgtacgactagttctagatcgcgagcggccgccctatattttattaatctatcgccttaatacttattgttatatttcgtttctagttattgaatagatagagccttcgtgcccccccttccccctttaatatgtacccccaacttgagatagtatagaaggctttcaggtctccctgaggagtggagtggaggcacgtcagggccttacctgctacactgactatgagaccagtacgaactaaaagtgcacacctataagaaactgaaacacacaacaaacaaatg

SEQ ID NO: 608618 - DNA, 195 bp, Homo sapiens
  misc_feature (7)..(7): n is a, c, g, or t
  misc_feature (44)..(44): n is a, c, g, or t
tcacggntcagcgcagggctgtaatcatcaacagctacttacgntgggagagtcagtttgaagtccttgcagagaggattactcatgcgactgctagttgcgttcgtcgttcgagtctgctaggccgacatagtaatgaggatgtcacgctccgtgggctattatcagaatgactgctacggtgcgttggcccaa

SEQ ID NO: 608619 - DNA, 188 bp, Homo sapiens
gtatgaaccctgctcgtgtgtgtacatctgtgctttagttactgcagcacagatgtaccacaggagccttcagaaacaaccagaagctctagacagctcctagagtgagagccctccatactcgttcgtgtgtgtgtgtgtctgtgtgtgtgtgtgtgtgtgagactagagtagatcagagagcgata

SEQ ID NO: 608620 - DNA, 132 bp, Homo sapiens
gactctaacgatcccttatgactggaagcatagtattagaagataatctatttttgtgtaggtgctgggtaggttaaataatttttttgtagctgtttaaccagaaagggtatatgcctctgtgtgtgtgtg

SEQ ID NO: 608621 - DNA, 167 bp, Homo sapiens
agactctcgagaaactgctgcctcatatccgggggaatgaaccatttgtgttcaccaaggaggacctcactgagatcagggacatgttactaggccaataaggtggccacctcctgccctcgctggttgccattgccccatcgttgaagtcactgtgccagcgccag

SEQ ID NO: 608622 - DNA, 277 bp, Homo sapiens
  misc_feature (124)..(125): n is a, c, g, or t
  misc_feature (133)..(133): n is a, c, g, or t
  misc_feature (137)..(137): n is a, c, g, or t
  misc_feature (143)..(143): n is a, c, g, or t
  misc_feature (148)..(148): n is a, c, g, or t
  misc_feature (152)..(152): n is a, c, g, or t
  misc_feature (166)..(166): n is a, c, g, or t
  misc_feature (169)..(169): n is a, c, g, or t
  misc_feature (175)..(175): n is a, c, g, or t
  misc_feature (182)..(182): n is a, c, g, or t
tgtctacgttgcgatgcagcatcgggatggcgaaggcgatgcgttgttggtgagcgcgttgggtcagtgcagtgcgtgtcatgagggtgctggccttgcgttttcttgcgtgttgggagcgtgnntgcttggnaccngggccngattntgcntcactgggaccagnggnttgttnccagatncaaggcggtgtggctcagcgaatccatacacggtgtacttggtcacgcctcattttttagtctacctgtgcgatgcatattgcactgtgttgtgg

SEQ ID NO: 608623 - DNA, 232 bp, Homo sapiens
ggggggttttccccccccccccaacccgggggggaaaaaaagggggtggggattttcccccccgggggggggaaaaaaaccccccgggggtggcctttggggggcccttttttaaggaaaaacccccttttgggggggtgggtcccccccccccccccccccccttttacccctggtctttttggctggggggggttttccccccttttttgcaaccccctttttttgggga

SEQ ID NO: 608624 - DNA, 281 bp, Homo sapiens
  misc_feature (128)..(129): n is a, c, g, or t
  misc_feature (137)..(137): n is a, c, g, or t
  misc_feature (141)..(141): n is a, c, g, or t
  misc_feature (147)..(147): n is a, c, g, or t
  misc_feature (152)..(152): n is a, c, g, or t
  misc_feature (156)..(156): n is a, c, g, or t
  misc_feature (170)..(170): n is a, c, g, or t
  misc_feature (173)..(173): n is a, c, g, or t
  misc_feature (179)..(179): n is a, c, g, or t
  misc_feature (186)..(186): n is a, c, g, or t
tgagatgagtctcaagctgccgcccgtttgggcagaatattcttggtccagtggtgagcgcgttgggtcagtgcagtgcgtgtcatgagggtgctggccttgcgttttcttgcgtgttgggagcgtgnntgcttggnaccngggccngattntgcntcactgggaccagnggnttgttnccagatncaaggcggtgtggctcagcgaatccatacacggtgtacttggtcacgcctcattttttagtctacctgtgcgatgcatattgcactgtgttgtgg

SEQ ID NO: 608625 - DNA, 687 bp, Homo sapiens
gaggacttctcgaatcgacggttctcctttatgatcaggaacaaggcaaacctgactcctttcaccacttgcattcaacatagtactggaaggcctagcaaaggaaattaggcaagaaaaagaaaaggcactcagattggaaaagaagaagtgaaattatctttctttgcagatgatatgctcttacatgtagaaaaccctaaagattccacacaatatactgtaagaaataataaatgaattcagcaaagtaggaggccacaaagtcaacacaaaaaaatcagttacatttccataccctaacaataaatgatatgaaaagcaaattacaaaaacaattccatttaaatagcatcaaaaagaataaaatacctaggcattaaattaaccaaggaggtggagacatttgtataatggatactacaaaacattgctgaaagacattaaaaacatgaagaaatggaaacatatctcatgttaatggattagaagacttaatattcttaagatgtcaataccactcaaggaaatctacagagtcgatgcactccctatcaaaatcccatgaaatctttgcagaaatagcaaaactggcgggcgcgtggtcatgctgtaatccaggactttgagagggcaggcagtgcatcactgagttgaagtcaggccgctgacagaggaaacggggga

SEQ ID NO: 608626 - DNA, 1068 bp, Homo sapiens
  misc_feature (564)..(564): n is a, c, g, or t
  misc_feature (748)..(748): n is a, c, g, or t
  misc_feature (750)..(750): n is a, c, g, or t
cttcctagtttcgtccccgcccgtgggggaaaaaagtttcttccccttagattgtggtttgtagaatgccctttgtgtgtgaattttgttcccggattctcccctgttgggacgcacacttaggagcgtaaccctcgtggttatggaaccccacttataatatggtgggagacacaagggggtctctaagagttttttgcccgcgccgtgagtttcttctatagagacgttgagagggtgggcgttgcccataatatctccccccccttgtgttgtgcgccccacacgacgtttggcgctatacgtctctacggggccctatgagaagccacgctgtaatgtctctttctccaacatacagtggcgctcttgaattttgttggcctcgagggggttcacgctctttgtgggctccgctctgtctgttcgctcgagggaccacgttgggagaaacacacatgggccacggctctctcgatagagctcttctcgggccctcggggggagttgaggcaacgcgggttttggggggagttggggtttggtagaaaggcctctctttgnggtgtgccacactcggcctctgttgggtgttgcttcgggctctataaaggacgcacacttttcttctcttcacatttgggtggagagagagcccaccaggcgcactctatgaacaccgctcacacacacacagtggtgtatatctgagacaagagaagaagagaggttgcggggtgtggagagngnggagaatttatagtttctgtttcccacgcgctatagagagggagagaatataaagagaggggctcatagttatagttttctctggagagcacgcctcgctctttgagaggagagagaaaatatataagctcttggaacaccgagggagagagttctatgagaaattaatcacttgagaacactaattaaatggttattttcttttttcttggagttttccacgagaaaagccttcttaacttttaatgcttttctcactcgcaaagtaaatgtaccccttttttttgaaactgaattaaatactcattttatctttga

SEQ ID NO: 608627 - DNA, 301 bp, Homo sapiens
aggatcctttgtgctttgggacggcggacaatgaaggatgggatgtcaccacctgcttgcggacccttcgtatcagacgccgtggtccttctcatccagcgtgagtggccccgggcggccttgcgtatctagctcaggctgcatttgtccctctagaactcacttttgttccggggcccatattcgctgatcagtttccttgcttggttgcaacgagatttctcgaagggtctccggggggtcacataagttttgcgacaaacccagctcctggcccttgtcatgtggggtccgttccccc

SEQ ID NO: 608628 - DNA, 208 bp, Homo sapiens
tcaagcatcagcccagcactgacgcaagccttcttgaatcatactttgccttaaaggaaaatgtgttatcagcaggcctcactcagtgctgtgattacaggcgtaaacccacgctatctgatgttggcccaagtttcctctgctctaattttccaccgagtatagaactctcttatatcttgatatgcactcgtgacctcctctagag

SEQ ID NO: 608629 - DNA, 147 bp, Homo sapiens
tcgacggaagcaggagtaaggaatgtgtgattgagaaggtgataaaagaaaattaaaaccttcatctgctccttattctgcttacagttggcagttactattgatcccccgcttttctcaccttgtttcctacagcgtatgctctta

SEQ ID NO: 608630 - DNA, 1244 bp, Homo sapiens
  misc_feature (1037)..(1037): n is a, c, g, or t
gtgttaatgtgagttgcactattgatgtgagcgtgtgcatcgtgtgctgggtatactacaacagtggaagaggtcttctcgagggtgttcgctgcttatgtcactgcattagacgcggcgttgtcagatgcagcgctgtggaggtggtaggcgactagtcggatggtgtgtcgtggttctggacgacgatgattgctgttgggcgtggcatgtatcgcatcctggattcgcgcgtcggtggtgagagtgagctattaggtggtcgtgagaggtagatgggatggtgggtgtacagggtgttgttgcatgagacatggacgatgcatgatgtagcacgttagcttaaggtttatgcgagagggagaagtagatttggaggggatgggagagtgtacgtacaaaggtaggtggtttgggagcaatgctgttcgtctgactggaatgaatgcttagtagatgaaagtagcgtagtgagtagttggccatccaataagatccttgtgagacatggggttggtgtgaatcacaaggattgtggggcttggtcttgtggttaccagaagaggagagagggaagagggcgtagaattggaaggaaattagggaagatgaggaggaggactggtgggaagggagggcattgtgatgttcgcgtgtagtgtgggggagtgggtgattgagattggggagggaatccaaggggtagcattggccttggagtgggtggggttgacatctgaagagtgagacctagatattgggcgtgtggagaagtatgggaggagggaaagtagggttgagcgattggtctccgatggcgaatcgttagatagcgaaagtggggttgtgatacaagtcttggtagctgtgggggcaatgttaaggggcaaagattcacgggttgggataaagtgatttgactggggtgggtttggtaaactaagaatctttggtggaatgcaatgtcaaaagtggcaccatgtatgggcgcagcgagagactagtgtggaataggggcgagcggaaatgttgcaacncaaggaggtggttgttggtgagtgaacttgttccccaatgggttgtggtggttggtcatttacaaatatggttttgcaaagccagtggaatgtagcctggaaaataaagtgggagcgcccaattttgggagactatgttggtggaagtgatggttacaacgagaggagaaggaataaataaacatggaaaatcacaaagagaggtgg

SEQ ID NO: 608631 - DNA, 1483 bp, Homo sapiens
  misc_feature (285)..(285): n is a, c, g, or t
  misc_feature (752)..(752): n is a, c, g, or t
gcatgtatactactaacaggaccgtaagctcgaatatccaccattcttcgaccccgcccgtgaggaggagacccctattcgtatagccaagcacctcatgtcgtagacttttgtcggtcagcccgtgacatgttttatcattctgtagtccatagccacggcttcgggcaataagtctgcccgagtattgtcaaacttactagctccggtaacaatcagaactcatttggcatacagtaggttatggtctggagactatgatcatcgaattgcgcattcctcatnggtcttatcggtcgtgtacgcgacgaccgattatgatttacacgctgaaggaatcatgaccgtaggacacgactggagcgatattgtcaccgtccgcataccaccactaaaatctactctggctcattcgcccgatccgcgcccgtcaatacgctacttttcacgtcctgaccttccgtcgcacctccattccgatcgtgaacagggcgaactgatcgcacaaattggaatgcttgggtagcaaaggtagtcgtctttgatgcctcccctaagggaattctacagtgctgtctccgttatctacacctcgctcatgcgatggccactagaattagtgacattggttacttaagcgcaaaagctccatggcacttgagcacgattcgattatcttatcacggagcacgtttactagcggttggtgagcctttcaactttgcccaaactaattgttgccctaagtccanaaatacgtggatgccctcggttaaatctgtcgtcgcagtccaattacgcggacgtgtctctcctaatattcgaactttggagtttgcgcgcgcgtaaatgtcctccatgagtcctaatctagcgcccctaatggaatgcaaggaattccttaacgcggcccagacaaaatccccgattttttccacagtattaccagtatgtccatccgaggcggtcaccaatcctcgagctttttacgtttccccaagcgaaaattacctttttcgttcggtgcccttagttccggggcaaattgtcccccgaaaaggtgacgcttccggaaactaaccccccgcattggctttacgcccaggcttttgataggccaagtcccttattccaatcccgtgggaagaggatccactttgcaattatttctcccttaacccaggccagggcgacatcacttcacttaaacttcctcccctggactgtggaggaaaaagggcctgttggctgtcgaaaagccgaaaaaaggtcctctaattaggttgggaaggaaaaccttcccaatataacctgggggcgtgtcgtcactttttggtgtggccccccccaaccgtatccaccacatttcttaatgaaacacggttgtcttaaatctttgcgcaacagggggggggtctgatcccccccagttggtgtgttggccacccacggtgccctgcgctgttcttagcaacaaaagatg

SEQ ID NO: 608632 - DNA, 457 bp, Homo sapiens
aagctttagagcgacatcttgatgttaaatctcttagtgtggagcaaatctttggtcaagttaaaattgaaactttagatgatcttaataaatatggagttcaacaacttaaatctttattagaaaaagccaaaaataaacaagcaggatttgaaaatgttactcaagaacaaatcgaatctttagaaaaaaatattgaattattatctcaacaatataaaactttaccttctggaacaggtaaaacaaaaattcctgaaggatttttccctcaagattgagtattacttcaattcaaatccattgtagatgttttacttttagcaataaacactgaagtaagtgatttacaagcacaaatagctcaacaaaatgaacaattaaaagcatcaaaagatcaaaatacaaacaaagctgctcaagacaaattagcacagttgaatcaaaaaaaaaaagc

SEQ ID NO: 608633 - DNA, 473 bp, Homo sapiens
catcgatctcggccatgaagcactagccatctcttgctttgcctttgtaacctttgacgaccatgactccgtggataagattgtcattcacagattgcaaactctgaatgacaatcttatccacggagtcatggtcgtcaaaggttacaaaggcaaagccccttttcttgccactgcctcggtcagtcatgatttcaatcacttcaatttttccatactgttcaaaataatctcttaggtgatgttcttcagtgtcttctttaatgccaccaacaaatatctttttcacagttaagtgggcacctggtctttgagaatcttctctggagacagctctctttggttccacaactcttccatccaccttgtgtggccttgcattcatagctgcatccacctcctccacagtggcatatgtgacaaacccaaagcccctggagcgcttggtgtttggatctctcattcccggtggg

SEQ ID NO: 608634 - DNA, 192 bp, Homo sapiens
gcggcgtttctttcttaacctctttcttgagatcttttttctcttctttcttgagctcttttttgacttcttttttcacctctttctttttttggtgtttcctccttcttggtaggtggtttggccttctttttagccacttcttttcttgggcttttctttctcctctttctggtcttcaggctttacctt

SEQ ID NO: 608635 - DNA, 118 bp, Homo sapiens
tccgacggtaccaacagtacggggattttcacaactgcttttccatacagtgtctggaatctatagataacacaatgcagttcagtcatgggttgatttttaactaccagtgccaggg

SEQ ID NO: 608636 - DNA, 254 bp, Homo sapiens
cagagatgatgccactgcactccagcctgggcgacagagcaagactccatctcaaaaaaaaaaaaaaaaaaggctgttgaattcgggcagggcttttaaaattccgggcccgggtgatttcggtaactcgggggcacccggggctagggcccttcctaggcccggcaattaccctcttcctccatttagtattgggcccagtgtctcttacttctctttaccgggttttaacggggccggtgttaagagccttt

SEQ ID NO: 608637 - DNA, 311 bp, Homo sapiens
ttttcttttggtcttggacgggataatttcaaaggttatatcttcaagctcacggatcttttccggtggaactcctctaggtgaattttttcagttcagttatggtattcttcagctccagaattgggaaatggggatacaagaaagttatgcaatatgggtgcggggtgtatgtgtagtaggaagggggtggaggataggctttcaaaagatgagtacctcggaaagattcgggttcacttcatagggaaggacaagtaacagattttatagttcaaatgaagtataaagcgtggaggggtaccgagctc

SEQ ID NO: 608638 - DNA, 792 bp, Homo sapiens
tttgtctacttcctcctgcttccccgccgcgccgccgccatcatgagggaaatcgtgcacttgcagtgccgggcagtgctggcaaccaaatacgtgcgccaagttttgggaggtgatcagcgatagagcacggcatcgaccccacgggcacctaccacgggggacagctgacctgcagctggaactgcatcaactgtgtactacaatgatgtgccacctggcggcaagtacgtgcccctgctgccgtgctcgtggatctggagccctgtgcaccatggactccgtgctgctcggtgggcccttctgggcagatcttccggcctgtgacaacttcgtattgcggtcagagtggtgctgtggaacaactgtgtgccaatggtgtgcactacacagaaggcgcggagctggtggactcttgtgctggatgttagtgagaaagtgaggctgaagctgtgacttgcctgcagggtttccagctgacccatccctgggtggtggggacagggtctgggatgggtaccctcctcatcagcaagatccgggagggagtacccagacaggatcatgagcactgtatagtgtgggtgccttccgcccaaagtgttcagacacagtggtgggagcccatacaaaggcaaccctctcagtcccaccagtcgtagagaacaccgacggagactactggattgatacgaagcgtcctaagcaattgcgtcaaaacctaaagtgacaagccactattgtactgacccctgtgttttgtcatggggtgtcactgtggctcaggcatca

SEQ ID NO: 608639 - DNA, 802 bp, Homo sapiens
gcagaaataaaacttcaaagcgtacatatatcgaaaagggcaatgtaatgtttcgggtgtactttctgttaagggcttgatgattcagactggagatccaacaggtactggtatgggaggagaaagcatatggggaggagaatttgaagatgaatttcattcagcatgacgacatgacaggccgtacacactcagcatggctaacgcgggatcaaatactaatggatcccagtttttcataacggtagtaccaacggtaagtacagtatcattgtttataaagtacagatagataggttatgatgtaagagagtgaactcagtagaagaggtggattattctgtatttgctgcattatgtatatcatctagcagaatacaaagatgaaaatgagcaagaatataaaattatgtgactaatcagtttagaattggtcaatagtgccactgtagtaggaaatacaatggactacgattcaagatacttgaggtttcaatctcaactctgcctctactgatgatgtaagctagaattaattattgcacttctgtgagcctatttccttggctttagaatgcaagattagaggataggattcacagtttgagacgattccccagatttagatcttgaaatcgactccttgaatggatgaatacgataagggacaagccatggtatgcataagaaagtttacatacgaactgggtggataatcccagggtgaagggaatgtacacatggggaaagtaatggtaaagggcaataaccccgcctggaggttactagcgagcgcgtacgc

SEQ ID NO: 608640 - DNA, 884 bp, Homo sapiens
  misc_feature (325)..(325): n is a, c, g, or t
  misc_feature (330)..(330): n is a, c, g, or t
  misc_feature (422)..(422): n is a, c, g, or t
  misc_feature (424)..(424): n is a, c, g, or t
  misc_feature (430)..(430): n is a, c, g, or t
  misc_feature (433)..(433): n is a, c, g, or t
  misc_feature (882)..(882): n is a, c, g, or t
ggggccagtgtgctggaaagacaacatactgtcacgttactatcctggcttctgagggtacacttgcttccaggtttcagcctgtttttccaggctgtttggggctttctctgtccaaagattggctttgagaagaaagggttctgccaactgcagggagatccctggaccaggagatcacacagggacgatttgtttctctatgtatgccaactcctaaaagacatgagacatgggctttccccatctctgtagaaaaaaaaaaaaaaaaaaggataccaagtggttttcccaggcagaccctcaccttgcagtggcacctgcnatganagaagttgaagttaaagacctttattgaagacagactggtcaaaacctaaaggaggcccagatgaccagcctcgggccaaggactgctttcnanagaganaanagtcctggcccttagagtatcagtttacagtcttaggagtgcattgggggctagtttttcaacctctacacataagctccaagagatcccatctccttcacagaaaccctgggaagatgttctttgtgcacatggacttgactactgaatctgtctccgactccttgaagagcctcctcttagattgccctagtagtccgatcatgtgtcctgctttcctgaaagccaggtacccttggtctccatggtcccccgatgcatcttcctataccagagacttcctgttcttattcttggaagacactttggagaacagcagcatcctcaaagacgggaaagacatcctgactcatggctcttttcctacccctcaggtacctcttccaaggctctgcagggatcccagcccataccaacttggtggaaacatacgaacttcaagaagctanta

SEQ ID NO: 608641 - DNA, 856 bp, Homo sapiens
ggcggagggtgcgtgcgggccgctggcagccgaacaaaggagcagggcagccgccgcagggacccgccacccacctcccgggggccgcgcagcggcctctcgtctactgccacacatgaccgccgaacgtgcacagcctgaggctggtgcacgatccagttcggcctcatcaactgcggtcaacaagtacctgacgggcgaggcgttcgggttcaaggtgaagcgcctgtgcgccagcagcctgaagaagaagcagatctggactgctggatgcagccccctgacgaggcgggcagcgcggcgtgtgcctgcgcagccacctgggccgctacctggcggcggacaaggacggaacgtgagctggagcgcgagggtggcccggttcccgattggccgtttcctcatcggggcgcacgaggacggtcgctggtcgctgcagtccgaggcgcaccggcgctacttcggcgggccgaggacctgcctgtcctgcttcgcgcagacggtgtcccccgcgagaagtggagcgtgcacatcgcatgcaccctcaggtcagcgatctacagcgtcacccgtaagcgctactgcgcacctgtagctgcgcggcgtgcgacgagatcgcgtggacctgcgacgtgccctggggggtcgactcgctcatcaccctcgcttccaggatcagcgctacagcgttgcagaacgcgacagcgttccttgcgccaacgagggcgctggtggcgcgcccgagcggcactgggtaaccgctgagtccgtccgggagtggcttcggcgatgggaggcgtactggcgcgccgggcccagggaagctcaagggggaggcccagggggaagggaaccc

SEQ ID NO: 608642 - DNA, 438 bp, Homo sapiens
  misc_feature (394)..(394): n is a, c, g, or t
ttggtgatactgagctaggaggtcgaggatgcagtgagccaggatctgtaccactgcactccaggctgggctacagagcaataccatcaataaaaataaaaaataagatacacataaaagagacacagagagaaaaacagacgaatggaaagatagggacacggggagagactaaagtgtgagattcataaatagagagagctggccagctaagtgagatataagctgagagaggcgaagagagattgacttctgggatgcaagaagagagaggaattgtgtggtgacccgagcaaggccaggttttgtgggatgggccagcagtgaagagggggcgctccgaaccaccagttctgtctcatgtagagggggcgctctcggggcagacccctgncttggggtgtgactgggttcccctggccccaacagagatagcgt

SEQ ID NO: 608643 - DNA, 317 bp, Homo sapiens
gacagtatgttgggtgcatggctcagcctgtaatcccagcacttaggtaggctgaggtgggtggatcacctgaggtcaggagtttgagaccaacctggccaacatggtgaaaccgtatctctactaaaaatacaaaaagttagccaggagtactggcaggcgcctgtaatcccagctactgtggaggctgaggcaggagaattgcttgagcccaggaggtggaggtttcagtgaggagattgtgccactacactccagcctcaatgacaaagtgagactctcaaaaaaaaaaaagagataccgggatccgagaccga

SEQ ID NO: 608644 - DNA, 189 bp, Homo sapiens
cctgatgtgtcggtacccttctcgacgcacaacatcacagccgacagctcattcccacgagcaacaatgcagacatgcctaaccaacacaccagtcgatttacaacaaccggaacgccgagagactttttccgaactcagcaccatgatcacgcctcgtgagcctcatcgtccccgtgatcacaacaat

SEQ ID NO: 608645 - DNA, 349 bp, Homo sapiens
tgagcaagtggagcccgagctctaatcagagatatgaaggatggcattcttcacggaaaatggaaaccagtcatggagatgaaaaaaacagacctggaaatctctggataattaaactcagtaaagaaaactctctcataacacaatttacaagcttggtggcagtagagaaaagggatgagaatgggtcaccttttcctggatataccacaaagtctctggaacgtgtattggccaaaggcaagatggtagactgtcctggcccttacatggagctgggcaggggcggaaccccaagagaagccggtcagggaacctagtcatcttttcagctatcctctggagtggg

SEQ ID NO: 608646 - DNA, 267 bp, Homo sapiens
tgggttgggtttggttttgttttgttttgttttgttttgtttcccaaaaaattaagaattttaatgttgaaaaactgccccaatttttatggggccaagcctaaaaaaaaaaaaagtagtttgaatcataattttaatccttggatgataaaaaagggaaagttttggggccctaatttttcccttccctggggttgggctttaatcagttgaaatggatttttggacccccatttacgcttccataaaagttttattgtttagtga

SEQ ID NO: 608647 - DNA, 319 bp, Homo sapiens
ctccagcttgcccatcattctcggcgcccacacaggtgacagtcccaagtagataacctccatgggacaagttgggtgttgccttacccgcctgcccagcccctcctcccacaggaacacaggtaccacctgcacccacgacagcttcttttctcacacatggggagactggagccgagccccttgtgtcttttgaaataggaagaaaaatgagtgttcaggaacatgactcctggactgggctcttgggcccagttcagtgtctcatcgcaaatctaggcatttttgcttctattttatttaatttttttttttaagg

SEQ ID NO: 608648 - DNA, 618 bp, Homo sapiens
  misc_feature (93)..(93): n is a, c, g, or t
  misc_feature (106)..(106): n is a, c, g, or t
  misc_feature (152)..(152): n is a, c, g, or t
  misc_feature (170)..(171): n is a, c, g, or t
  misc_feature (190)..(190): n is a, c, g, or t
gcaagggaatccagcagcagcacagcagtgtcagccgcgggtgcccagcagggcggctacgagatccccgcgcggctgcggacgctccacaancctggtgatccangtacgcctcgcaggggcgctacgaggtagctgtgcccctctgcaangcaggccctggaggaccnnggagaagacttcaggacgncgaccacccggacgtggccaccatgctcaacatcctggtccttggtgtacagcggatcagaaatacgatacaaggagatgcaggttatacctactgaagtgatgccttgcgctattcggtgagaaaactttcgggcgacagatcatccttgcggtggccggctgactttgaataaccattgcagtcctttatggtaaaagacgggaagtacgatcgaagctagagcacgttggttgtatacacatgagcttcttggaatactcctgatgacaagggtttgagcggcgaaatggatcacgcgccggatgtaacgcccaccttaggccatagattggacttagtcccttgtgagctcgtggcccagaacgcctggacgagctagtttaccggaacgttggtacactagtcattctatcaatagtagtccg

SEQ ID NO: 608649 - DNA, 132 bp, Homo sapiens
catttggcgaggcagtctcgaactgacctcgtgatccacctgcctcagcctcccaaaatgctgggattacaggcttgagccactgctcccggctgatttttgtattagtggagactgcctcgccaaacgatg

SEQ ID NO: 608650 - DNA, 119 bp, Homo sapiens
  misc_feature (65)..(65): n is a, c, g, or t
caccagcagcctcagttaggagacttaagctcatgaaatgcgcgctcggaagtacgcccgcattncgttcttctgttgctggcgaatttgctttgtcgagcccgccttccctgagtgca

SEQ ID NO: 608651 - DNA, 167 bp, Homo sapiens
catcttagaggatccccttaaatggccagaatagttactttgggctatgtggcgcacgctgtcttgcttataagctatattgggctctatgcagaaagtgagaatggaaagaatttgagagatacgtgagacctctaaaaaaatcggacccacttagaaactgtgaa

SEQ ID NO: 608652 - DNA, 626 bp, Homo sapiens
atgagctacctggctatccccgcccaggtggctaccaccagctgcaccaggtggtggtcctggggaggtgctgctaccctcctccgccagcatgcccccatcgggctgataacgtggccacctatgcggggcagttcaaccaggactatctctcgggaatggcggcaacatgtctgggacatttggaggagccaacatgcccaacctgtacccctggggcccctggggctggctacccaccagtgccccctggcggctttgggcagccccccatctgcccagcagcctgttcctccctatgggatgtatccacccccaggaggaaaaccacctccaggatgccctcatatcgacatacccaggagccctgtgccgggccagccatgccacaccccacggacagcagccccagggcctacctgggcagcaacagtgagctacccatggtcagcctcaagtgacactccctgggcagcagcaggcagtgcgaactacccaggatacccggggtctgggactgtcaaccccgaagtgaccccaaccaagatttggaaagcgaggaacatcactgatgctcacggattgacccacggcgaaatgccgaggactgggaagggcaaagaaag

SEQ ID NO: 608653 - DNA, 320 bp, Homo sapiens
cgaggaggcggtgctgtgtgtcaagtgatcacgatcgacgcaggacaggtatctcttcgttatcagaagagttgcttcatcacatctgggatcagaaaacagcaggtggctgttaacagataagtataactagcatctgcagtatcgcatgttagggataagtgcttattctgaagagctgtggagtccttgaaatatcaaccatggcacttgctcctgacccctatccctaggggatatcaggattgatgaaatatggcatcgagccttttataaattgtaggacttgtacctgtgggcttcagcgatgggatagtaga

SEQ ID NO: 608654 - DNA, 92 bp, Homo sapiens
cccctggggtgacatcggctcacaccttcccctgctgcatgtgggggccgagtgggcagtggacctcggtggaaataaaaggtatctatcac

SEQ ID NO: 608655 - DNA, 120 bp, Homo sapiens
acggaccaggattgacagatggatagctctttctcaagaaaatgggggcgtcacaggtacctcaccacactgcaaaattcccctgaagggtgacattcacatgaacgtgagcacacgcga

SEQ ID NO: 608656 - DNA, 676 bp, Homo sapiens
ggaccggggctcttgggatgtccagtggtctgcaaagaggcatcccggaatcgtgatgccgctggagcgcgcggacagcctcccacatgcaccaaggacatgttcccgtgggtccctactcctagagaccccagaatgaacgggccgccgtcgacaagaagtataatatgctgtgtggaatgactacgaaccttacccggatgcatggcatggggtatgtgcgactacccgaagctccctgacctgctcacacgcatgatgagacgatccatggtatatgctgggaccatgcctgtggcctgatggttgaactgggcgttgaaccgactgtcactggcacctagacatgtacaacaggaaccgtgtggatacatccccacacacctggtatcttgcgacatgtcatgtgtagtgcagactcttcgagtttccatggctttcatgatattcatgtgctgggtggggtgacgtgtacctctgtctaccaggcctgtgggaccaaagcagtatccttacaataatactgaacctggaacgacggcgttgatccctccaaagaatccaggagcgggtggttcactagtgagatctgaggaggcttcgtggggctaagggtcctctatccaggactccctcaattcctagaacattaacctttttgaaatcctattaaagc

SEQ ID NO: 608657 - DNA, 752 bp, Homo sapiens
aggggagagaaaggggggccatgggatagggcctggcccaagtgggattcgactcgtggccggaaaccatggcgtctggacggagtgtacgccgaggctttgctgcacggaggagagtcccgcctggaggaaagttacaaacaaaggggggagacccacacaaaagcgagctcaccacagttcggataggccacgcgtccaaagatgcttcacgtataagagatgtatcgcccgggcgggtgctaatttgcacatgtctatgaacggcggctgtaagcgcactctgtttggttgaaacgccccataaactctcgcgagcgcgtatttagaccacgggtttcaaaccccttcggaataaggcgaaattttctggagtgacacctgagggagcagatgaataacgccgacttaattagctcttgcgccccgggggtcggacaccgatcacacctctctttgtagaactattcccgctcttcggcagagatttgatcgtcacgccgtccactaatacggctggagggtatctcgaccgatggaatcaccgaggtctaaactcttcgtataccccgcgccgtactttcggaaccggacgatacagtctccgcccccctctacataagatggggctacctccgggtcattcttcttatcagaaacgtcccgtagcttcatgggagaacagagaatcgtaggggccgaacacgcatggccctcaatgttgggcagacaacagatcacgaccccactaa

SEQ ID NO: 608658 - DNA, 592 bp, Homo sapiens
gcacgaggttttttctttttttaggccttgtcttcatatggatgctgatctttggggttctatgcctggatttcttactcaatctgtatcctaaattcggggttattgtatcgactattcacttttcgtgagtttatagaggatgacatctctcttgggttatctaaggtcctgatgaccttctgattacagcggttttccgttagtgtgactatgctgaacatttggcactagctgtgagtccgactctagctttgttaactgatggtactgtgacctgttggggctgacttcacctatggttgtttcatatttctaatttgtaaattgggtctaatataggatgagcctcctgctgatcatgctgtgatcatgatcgcgtaacgatgggttagcggactgtcacatgttgccttggacaggaattgcgcgatggtgttacacttgtttgtcctatgactttactgatgctgctgccggaagatcatttgagtttatgattttgggaaccttatggccaccttaggaaaacccttttgttccaatagttgatgattaagttgtttaagtggccctatgctttaattcccca

SEQ ID NO: 608659 - DNA, 254 bp, Homo sapiens
gcgtcgacagcgtcgaatacaaatcttgtgtacgacaagaaactgtaggagcagggcttgccgcgacagaggccctgaagccaggcgctatgctccgggcttggcgctgatctgctcctgcaggttctggatctggttctgcagggtggtgatattgcgcgtgacctgcccacggaaagcatcgaactccgccgtgttgccagccgcctgtccacccgcggcctgacggttgtcctgctcgctcttggtcgacg

SEQ ID NO: 608660 - DNA, 665 bp, Homo sapiens
cagcaagctaacactgggacagaaaaccaaacactgcatgttctcactcataagggagagttgaacaatgaggacacatggacacagggagggaaacaacacacaccagggcctgttgggaggtgaggtgtgaggggaggaaacttagaggatgggtcaacagatgcagcaaaccaccatggcatacgtatacctatgtaacaaaccttcacattctgcacatgtatcccagaacttgtgcagtaaaaataaagaaaaagaaagaagaaagaaagaaagaaagaaagaaagaaagaaagaaaagacctagctctatattctcaagtgaacaaaaaatctttttatattattgagcaagctaatgtattaataaatttaaagtcaatggttattgctagtcctaatttatgaaaaataaaagagaatctggatacagctattcaatgtgcaaaggaataatcagaaaataaacagtatgttccaggaaacatataaggtttttttctcaaatggaccaaattgataagaatatctaaataataaagtatgtatcatcttccaaatagtgcataatccttctttcatattttaatacatacctgatactctcatcatttcatatattacattcacattccttcgtgtatttctatataccctctggt

SEQ ID NO: 608661 - DNA, 764 bp, Homo sapiens
  misc_feature (395)..(395): n is a, c, g, or t
gatgtcactcagttgctctatgagtgtcctctttctgttccaggatccagtctaaggtgccacatggcaggaggtggtcacatctccttgagtcgtattccggtcatgtgacagtttgcagtcttacctttgcgtttgcatcacttgtggcagttattgagacatgctcgcgtcagcgctgtcttccgtagaacggtccctcgactttttgtgatgtttgaacaatgtggtcagactgggagatacgtggactgttatgggaacgatcaccacagacgggacgcgagccttcttatcatcatcccatctcgtagggtgccccgatgcccacagttggcatcacggcatgtgagtcgctgccgtaaaggtggtgcctgcgggatttctgccagtgncatatttgccatttgccccctttccagtgcgccagtctcaggtcctctgcacatattacggtccgtgcacatttagtttgtgcttggagctgtgtctaatactatgtccagatctttgttgctcagcctgtcccaagcttgtgggccatgttcactgctttgcccggtgggggttctgtgtcccctgtggggttaatgcccccatctcatcctttattgtggtggacaccctttctttgcttgcttggtgctacaagagtgctctgaggacctcaagtcagtccctagaaccaagccatttctcatgggaggcccccttgaattttatttgttagagaacagggcttggactgtcgccggctggtgcag

SEQ ID NO: 608662 - DNA, 910 bp, Homo sapiens
  misc_feature (37)..(37): n is a, c, g, or t
  misc_feature (44)..(44): n is a, c, g, or t
  misc_feature (91)..(91): n is a, c, g, or t
  misc_feature (97)..(97): n is a, c, g, or t
  misc_feature (103)..(103): n is a, c, g, or t
  misc_feature (180)..(180): n is a, c, g, or t
  misc_feature (191)..(191): n is a, c, g, or t
  misc_feature (261)..(261): n is a, c, g, or t
  misc_feature (269)..(269): n is a, c, g, or t
  misc_feature (283)..(283): n is a, c, g, or t
  misc_feature (299)..(299): n is a, c, g, or t
  misc_feature (313)..(313): n is a, c, g, or t
  misc_feature (318)..(320): n is a, c, g, or t
  misc_feature (336)..(336): n is a, c, g, or t
  misc_feature (350)..(350): n is a, c, g, or t
  misc_feature (441)..(441): n is a, c, g, or t
  misc_feature (462)..(462): n is a, c, g, or t
  misc_feature (503)..(503): n is a, c, g, or t
  misc_feature (513)..(513): n is a, c, g, or t
  misc_feature (537)..(537): n is a, c, g, or t
  misc_feature (550)..(550): n is a, c, g, or t
  misc_feature (809)..(809): n is a, c, g, or t
  misc_feature (832)..(832): n is a, c, g, or t
  misc_feature (839)..(839): n is a, c, g, or t
  misc_feature (898)..(898): n is a, c, g, or t
gggccgtacggaggtggcagctgtgggaggaggcggngtggaangccgaggagctcaagcccggaccaatcgccacgttccgggccgcgancctgancctgcngcgtaccgggaagcgaaaccggccggatgggccgctgagcccgaattgggcactgtgtggagccccctggagctganatcaggatgtnccgcttcatgagggacgtggagcctgaggatcccatgttcctgatggatccctttgctattcaccgtcancatatganccgtatgttgtcangtggctttggatatanccctttcttcagcntcagnnntggcaacatgccaggnaccaggcctgcaanccgccggatgcagcagggtggagctgtctccccctttgggatgctgggaatgtcgggtggtttcatggacatgtttgggatgatgaatganatgattggaaacatggaacanataacaactggaggcaattgccagaacttctcatcttccantgtcatctcntactccaatacgggtgatggtgcncccaaagtctacnaaaaaacatcagagatgcgctcggcaccaggcgggatccgggagacacggaggactgttcgggattcagacagtggactggagcagatgtccattgggcatcacatccgggacagggctcacatcctccagcgctcccgaaaccatcgcacggggggaccaggaggagcggcaggactatatcaacctggatgagagtgaggccgcagcgtttgatgacgagtggcggcgggagacctcccgattccggcagcagcgtnccctggagtttcggcggcttganttctcangggctgggggacgaagggcggaggggcctccccgcctggccatccaaggaactgaagantccccttcccga

SEQ ID NO: 608663 - DNA, 1058 bp, Homo sapiens
aagagctgcaacaacagccagcaagaaaacagacctcatggcccggcgcagtggctcatgcctgtaatcccagcactttgggaggccaaggcgggtggatcacgtcaggagatcgagaccatcctgactaacacagtgaaaccccatctctactaaaaatacagaaaattagctgggcgtggtggcaggcgcctgtagtcccagctactcgggagactgaggcaggagactggcatgaacccgggaggcggagcttgaagtgagctgagatcgcgccactgcactccagcctgggcgacagaacgagactccgtctcaaaaaaaaaaaaaaaaaaaaaaaaaaaagggccggggggggggggtccacccggtgttttccccagatggggggaggccagagggggggggaaccaaggggcctcagggacttctcggagacactctctgggggattaaaagggggtgaaccccccggtttttttttattcaaacttcacacaaaaaaatttacgccgagagccgcggtagaaggcgcgccttgtatctcaccacctatattcaagaggagcctagacgcacgaggacactggggttttacccccggggagggcgacacttggcagtagggcccagaataagcagccacttggtaagttgggtgctcgccagcgaaaaaggacggcacacctcactcgtcttccacaaagaaagcacagcaccacatcgcgatgcggacaggaagaaaacctcttaccacaagaggaggtgggtgaggaaatttctcgccaaaccgtagttgtggtggggagatttttccccagaagccagtaagtaggtgtagtcacaccacctgttgtgcgtttttgcacccaggagacatctgcgctgcctagtcaaggaccaatacggaggtgtagccaacaaaagggggcaaactcggcagaggcgcacacactagagctcgtgaatatgctatcgctgtattcttttctcttttttttttctgatttctcgtgcgttgacactcacgtataggatacgcaaaagtaaaaagagga

SEQ ID NO: 608664 - DNA, 320 bp, Homo sapiens
atgtagtgggcctccaccgacccacatacatgtaggactgcgattacctgctggggctaccctacattgatgagtctcactgtcagctctatgagccacagtgcgtaagccacgactggagctcgatgtaaagactgtacgataccatatatcagaacaggctgataagagaactgcgtgcagagcactcatgttgaggctacagacctagtggtacctaattgtacgatgcctgactaagtattattcgtcttgaatgactcattgtggtggataatgcatactgattatctgcatgagatatgctactgcgtatgagc

SEQ ID NO: 608665 - DNA, 87 bp, Homo sapiens
gtaccattctggtatctgatagtgaccttccaaatccttagtggcactaagcgccacaggctctccaactaaaaaccctttacacac

SEQ ID NO: 608666 - DNA, 589 bp, Homo sapiens
  misc_feature (123)..(123): n is a, c, g, or t
  misc_feature (125)..(125): n is a, c, g, or t
  misc_feature (137)..(137): n is a, c, g, or t
  misc_feature (142)..(142): n is a, c, g, or t
  misc_feature (144)..(144): n is a, c, g, or t
  misc_feature (148)..(148): n is a, c, g, or t
  misc_feature (156)..(156): n is a, c, g, or t
  misc_feature (162)..(162): n is a, c, g, or t
  misc_feature (166)..(166): n is a, c, g, or t
  misc_feature (183)..(183): n is a, c, g, or t
  misc_feature (220)..(220): n is a, c, g, or t
  misc_feature (431)..(431): n is a, c, g, or t
  misc_feature (454)..(454): n is a, c, g, or t
  misc_feature (529)..(530): n is a, c, g, or t
  misc_feature (549)..(549): n is a, c, g, or t
accatgcccacctaattattttttgaatttttgtagcgaggggttcttgctgtgttgcgcaggctggtcttgaacttctggacttgagtagccctcctacctctggcctcccaaagtgctggnantacaggcatganccacngngccnagcctgtntttgantttnaagagtcctttcacatngcctttgatttcctgtggcagcttaagcaggaggtanagaccacctgttgcaagatgtgcagtctccacagtagctgggggagcagctgagggaaagggaatttaatttccaagttacaaaatcattatcatttagagaggatcggtcttattcaatctaggcataggtgcagggttagattaaggtatggctggaagagttaccaattagtgacagagggttctttaaatgagttgttgttgttgtngttgtttttgagatggagtttcnctcttgtctcccagactggagtgcaatggcatgatctcaccgatggctcactgtgacctccgcctctcgggttcnngtgactcttctgcctcagnctcctgagtagctaggactataggtgtgcaacacgaataa

SEQ ID NO: 608667 - DNA, 953 bp, Homo sapiens
acgctcctcatactaggcctactaaccaacacactaaccatataccaaaagaaaaaaaaaaaaaaaaaaaaaaaaattggggggggcgggcccaaaaaaattaaaacctgtggggcgcggggcccagcagagaggtatacggtggacagtgtgcgccatacggatgctccccataaaaaaaaccgtgggcaccagcaacaaaggtgctgtgggtctctacccccaagtgtaaaacaacgccgggcggaaaccggacgggtttgtgaaaaaaactccagaggcaagtcacggaagcgatcaaacgcggggcatgtcaacaacaggggacgtccaaagcaagccagcaataatcacaaataaccgcccccgccgagggaaggacggtagcagaaaaagggcagaactaacggagagaaggaggaagcacgaaagagagggagagaagaaagggaggacgagccgaggaggaggcaagacacgagaagacaaggaaaagggaagaaagggccggcggcaggacggagaagacagagaacgagggaggcaggaggagagggagggccggaggaacctagatcgggaaagagccgacaacgtgcgacatacgagaccgagggagacaagtggagacggcaacagaagagagagaagagacgcagaggagaggacacggaagcaggggaacagacataacacgaagaggaaacagacaagagcaagaggagaaagagagcacgagacacaaggcacgagacgaggcgagcgaagagagagtgaggagggaaaggacgagaagtgagacggaagaggaggagggagaggacaaggaagagaaaaagaaagaagaatggacacagacacagagaagaacagcagagaaaatagaaggaagacagaaagaaaaaggaggagaaggagagcaagagaggagggcaagggcggacggaagaagc

SEQ ID NO: 608668 - DNA, 525 bp, Homo sapiens
gcatcaaaggggggaaactgaggcagaaatttaaaaataaatatgcattcattcactccaagaaaagttaacaggcaaggcaagggttaaaaagaaaagaacaagttttcctcggcctagcaagctcacttcaaggacagttataagataatgttgtttgagaagccaagtccaaaggaatgggttccagacatccctcccctctagaacaaggttgaaggaaaaaaaaaaaaaaaggaggaagacaaattcctttactgttactcctttccctggcttcttaagcatgattatgttttacaaatgtctgtatttagccagttcttgattttcttttgacacagctccaaggccaccagctatgcaaggccacaagttatgcactatatgattaactgcttttgttttacttttgtaagtccacttataaaaaccctgctctgtctttgtttaatgctcagctttttggatttgaatccactcagccggtgcacaccttaaaataaacatcctcctgtactctca

SEQ ID NO: 608669 - DNA, 327 bp, Homo sapiens
  misc_feature (12)..(12): n is a, c, g, or t
  misc_feature (24)..(24): n is a, c, g, or t
  misc_feature (41)..(41): n is a, c, g, or t
  misc_feature (63)..(63): n is a, c, g, or t
gtatttttgtgnccttaggaaatngggatgccccaaggagngggagagagacaggagaacagnctggttgttggagccagtgagaacacccacaacatttattgattaagtttgttgtccttaagtgggcatggttccgtggctccccaaaataatttcaatagtaacaacaaagatcacttatcacagatctccataacagatataataatgaaaaagtttggtgtattatgagaattaccaaaatgtgacacagaaacataaagtgaacacatgctgttgggaaaacagtcactgatagacttaacaccagcgttgcaaaaaaaa

SEQ ID NO: 608670 - DNA, 447 bp, Homo sapiens
gcacgaaaaaaaactgagtttttaatttaaatttgaatccctgtatgtggctattgattaacccattggacggcccaaccctaaaatattgtatgactgggtttgaaatagcaagaatgatgtgaggccccaaaggtggagtgagaatatttaagaaaaaatagctgggtgcggtggctcacgtttgtaatcctagccctttgggaggttgaggcaggcggatcccctgagatcaggagttcaagaacagcttggccaacatggtgaaaccctgtttttattaaaaatacaaaaaattagttgggggtggtggtaggcacatgtaatttcccctacttgggaggttgaggcaggaaaattgtttgaaccccccaggcggaggttccagtgagttgagatcgtgccattgcactccagcgtgggcaacaaaagcaaaactttttttca

SEQ ID NO: 608671 - DNA, 313 bp, Homo sapiens
caaaaatcggccccctttttccagggccggagctaccaggggagccccggagccctgctttgtttgggaacccccaaaaagggattgtgatgggtttcccctccagtatgagtattagcccccccgcccgtccctttggggttggggccaaactgccaggcttcccccccaggtcatgggctgggccctgcccttttttatggaggcccaaccaggggttgagcccactcctatttgaaacgtcccgcagggcaaaaaccccccccccctttgcttcctttgggttttttaataaaaaaatttcctggggcca

SEQ ID NO: 608672 - DNA, 106 bp, Homo sapiens
cggcggcgtggtatcattctattaccccctctattgatccccagctccaaatatctcatcaactaccgagtactcgccacccaacgatgacgaactcaactaacct

SEQ ID NO: 608673 - DNA, 285 bp, Homo sapiens
  misc_feature (19)..(19): n is a, c, g, or t
accagctagccaacatggncaaaaccccatctctaccaaaaatacaaaagttagccgagtgtggtggtacaaccctgtaatcccagccactcaggaggctaaggcaggagaatcacttgaacccgggaggcggaggctgcagtgggccgagattgtgccactgcacaccagcctgggaaacaaagtgagactctgtctcaaaaaaataaaaaaggaaactactccatttttagtcatctccttacttagttctttacttacacaggttagctccaactcatatca

SEQ ID NO: 608674 - DNA, 832 bp, Homo sapiens
ggtcccctccggcttgcggtcctcgcagcaatgggggcgccggctcccagcatggctgtctctgcagatctagggcaaggatctgcgtgcacttctccatgtgcacgtctatctggcatatccgtgattccgacgatcatagcgcgtgcgcggaaatggaaccaccctgggggaatatgaagaggccagcaagaacgaaaggcactacctcctaggacagaatgaatagatgtgcgtgttgaccaagtgcatctgtggctcagtggtttaccaccaggttgcagcaccatttaaacttctgcatgtacgctcttcctgtgcgacttgggttcttccattgtagcaccatgggctgtgcccagtggcaacaggagggaagatctagaactttaaaggattccccaacttgtctggctatttgagctcctgtagcacacttaagaaagcactgtgaaacgcccttaagagattttcgcactgagtggccagccgctactggacagtcgaccgagaacctgtgacgaacgcatttttccaatctgaacacttgaccagggcccttgaatatacttgtttcatcaagcgaaccattctggttcgagaagccccccagaggcacgagttaggtaagtgcttaagacgttaaacgcttttcccagctcttgaatttgggatgaatcacggcaaagaacggaccctttagttaacacttgtatggaagaacgcgataactggccaagacccaccgattgttggctttccattccaaaaaccgaaagggggcccctatcagggcaggcgcgcaatacaacgaatgcaggggttccctcac

SEQ ID NO: 608675 - DNA, 187 bp, Homo sapiens
ttacaaccgagctcgtacccctaattggttcttcgatgacgcagcctctagagtagctgggaccacaggcgcatgccaccacaccctctaatttttgcctttttatttttattttttttggcagagacagggtttcgtcatgtttgccaggctggtcttgaactcctgagctcaagcagtcctcacg

SEQ ID NO: 608676 - DNA, 155 bp, Homo sapiens
aggtggcagcatctccttctgggcatcatgcccgccctcagacccctttgtgaagcccaagattcgtcaaaaagagaaccaaagaagttcatccggcaccagtcagacccgaaattgtcaaaattaaagcgtaactggcggaacccagaggcatt

SEQ ID NO: 608677 - DNA, 121 bp, Homo sapiens
ccgagcaccaccaatacaccgagcaccaccaatacagagagcgccaccaatacaccgagcgccaccaatacaacgagcaccaccaatacagagagcaccaccaatgcaccgtgcacgatta

SEQ ID NO: 608678 - DNA, 140 bp, Homo sapiens
ggggggaaaaaaaaaattgggggccaagggaaattgaggccccatttagggattaaacatttttaaccaatgggggggggggggttattaaaggttgccttcccgggaaaaaacggcaagaaaaaaaggaacttccccca

SEQ ID NO: 608679 - DNA, 116 bp, Homo sapiens
cccccccggggggccccccccccgggggttttttttttgggttccccccccccccgggccccccctttttgtttgggggggttttttttttttccaaaattaaaatggggccccca

SEQ ID NO: 608680 - DNA, 863 bp, Homo sapiens
  misc_feature (782)..(782): n is a, c, g, or t
cacaccacacccggctaattttgtgtatttttagtagagacgggattcatcatgtggctaggctggtctcaaacatccatgacctcaggtggtccgcccacctcagcctcccaaagtgctgggattacaggcgtgagccaacacacccggccactcatgttcatatgcaacgcgagattgtggttgtaaatagaaatcccatcttcccgatgtaatatatacatgtgtgttatataaagtgagttcacactataggttactatactacacgaacagcactacattatactgtagtactgctgtactgtactaatgacaatttttccaataagctgggaatatggtcatagactagttattatactcactttacttttctgcttgcataagtatagcacattctagtgttctgttactggagaaaggcaagagatgtctatgcccattgttctcctaagaggctacatagttagtccttcctttgatggattataaccctaatttatatatacctaaatgcctataaagtgaagagtgataactttagaatttggggctgttgttgaaactaattcttcaggtttatacttgtgtcttttcttactggtaggaatttatcatacagatacacaaatgcaattcccaggtccaaagcgaacacatttttatgatactgccaaattgccattccaaaagattgtactactttatgttcatacaagaaatcattttcagagtcatctcatagatgtcacctcaggtagagcaggatgactcccatnttagggggaacataaattgtttccggaaatagctttcttccccttctcccaggttcggtgtatttcttagtcacctaaaat

SEQ ID NO: 608681 - DNA, 177 bp, Homo sapiens
tagatccgaagaacagaggatagaacttgtatattacatcttgcccaggcagaaggggcgatcgtgattgttgagggttggagcaggcccttgtactgcatgccacatcacctaacatagggtggggtagatctctggaggggctagggagccctgtgtagggcaagatggcagcga

SEQ ID NO: 608682 - DNA, 126 bp, Homo sapiens
ggacactctgtcgtggttgggcactgtgcggcaacttgaggatgaaattagtgagctgtgtgcgttgaaaggcatggcctgtctcctcacttgagtggccggtccatcgagcaaagccctgttctg

SEQ ID NO: 608683 - DNA, 123 bp, Homo sapiens
ttatgtgcgtggttacatgatcggcgagcacggcccgtccggattcccgatgttcactggagtcaatgtcggcggcgtcggcttcgacggcctggccgagctcttcgatacggacccgatgga

SEQ ID NO: 608684 - DNA, 127 bp, Homo sapiens
attattatagcaagctccagtctgcgcgtacgacaaacagaacttaataatcgtgcattgtcagtatctcttcatgtcagccacatggccctcgtagtaacagccattctcatccaaaccccctgaa

SEQ ID NO: 608685 - DNA, 680 bp, Homo sapiens
ataattgcgttggtgggagaacccatacatattaggtagtgaggatggggggccgtctcttgtggcctatgtgaacatcgtaaggtcacactggtccagagtgcaaatgtctggtgccagaggccctgaaggaggttgcagggggcagcagagcagtgacccccaagagcctcaatcttttccatgacgtagaggagcagaacacacatctcctccactcctaaggagaaggagggcaggggagcctccacaatccccaggcacatgcaccagatatggcttgcgaagagatccaccaaatgtcagaagcaaaagcaggtggtctgggagccagaaatccaaggcccttgctttgtgggtgtacgttcgtgcttgggacccattggctgtggcatggattacggttgaaaaggaagccatgggccattttggagcagcatatcccacgatgttaacaggagaccccgatcaagaacggtgcaacgaccacaccgagaaacaacagcgccagaaagggaagaacatccctatggagccagcgagagggtgcacacatcaagagcgtccatgagccaccaagagaacagcgcaagcaacaccaaagcggggcataggacaacagaagcatctagacaagagaaagggagcccgaacaccgaatggcttaaaggagcataata

SEQ ID NO: 608686 - DNA, 1266 bp, Homo sapiens
  misc_feature (87)..(87): n is a, c, g, or t
  misc_feature (721)..(721): n is a, c, g, or t
ggttggtggtggtgaatggtaggagaagaagctggtggagtcccgcagaagagatatccggtgaggccacccagccaccgtcagagntccactatccctgggagacccgcagagtgaaccatgaggtcgggcggcggggggaccgggccgtcgtcgctcggactatggtggaagcgttgtcagccgagagcagagctactcccgcccagagtcatccatcagatgagagatacctcgtagcgttctggcgcatgaggtgatcgctagagacgtctgatgatttaacacatctaatagcgaggagcgaacgtctcgcgcattcagtatgcgacgtgccgaggcctgcatgggtgtaggcagactgtggcaggttgtgcgtgaggtccatgtgggaaatccatcatgaggtcgggtctatgtgccttcttgatgatgggttaggatgttcgtcgcccgcatcgtatgacacataaataatctcgaccttttttacacgcgattctctaagattaaaggtacagaagccattatttatctcatgcgttcggagtgcctctaaatttgggacaggcggcgatatcgcccatttaacggtctgtgcatctttgatcatttctcattgaacgaaattagggatatatacagcgaattgtgcttatccctttacagcgagactatcggtgagtgatggtaagtaacaatggtaaattggcccttcgcnatggataggggcatccatggtaccacttgtcgaagtgcgtaacatatttaagtaaaggtgggaggggctttttgcacattaaaaaagctttaacccggggggaaaagcctcttgtgtaatttatcaactgacacgaacggagtggggagagacaaaggtatggagaacgaggggggacggccgaaatagggggcaatttatatgctatggagcaaaaggagatctcctcgggggaaagagcaatctaacacacgacgtcgagacgaagaccatcgcggaacgcggaaagcgacgccttagacacaggacccgcaaaacgtgcagctgactcgcctcggcaacatggaaggtccccgggcacgagcggacacacacgggcacaccacaaggggggcacacacaccacgagcggcaccgacggcagtccgcacgacacacaccgtgtggggccaccccacacgcgcagcaacagcccgccgccaccgcggcccaggcgggcataacgacgccgcccagcacaccacacaatgctgttcacgacacac

SEQ ID NO: 608687 - DNA, 219 bp, Homo sapiens
ggccaagagaggactatcagatcaccagaaggtcacatgatacgtgttgcttgaggcgagaagtcaggatactatttttcctatgtctctgttctgctgcacaggcctatgaccaaacaagtggcaatgaattatgcttattagtcccagactaggttgctcaaatatccactttccaagcaaagaccaggggctccttgtgtagaaatgactagattt

SEQ ID NO: 608688 - DNA, 1338 bp, Homo sapiens
  misc_feature (307)..(307): n is a, c, g, or t
  misc_feature (1338)..(1338): n is a, c, g, or t
gggggggggggggggggaaagggcccttctttcaaaataaaccaaattaaaaaatttttagagggcaaaatattaaaaaaatatttgggctttacctttattttcccgcgaaaagccaaggtgcttatccctctccctcgtgtgtgtgtggcatctgtgggaagagaggaatcggggccctatttccctcttgaaagagaaaagggggggggctttaagagatagtggcaagagggacaatctcctgtgttcacacaagagtcgcttctctctctcatatattgggaagtagtgacacttatttacnaaacaaaacacaacacaagtagtgtgtgccatctcacaagagtctcctctgcgcgcccacacatgtgtgtgtgacacactttgtgggggggggagcgcgccgcgcctccacaacgcggacggtggtgtgtgtgcacacctctctcacccggcgtcccagagttgttatacaacactccgtgtgagagtgcccagaccgcacagaaaaaaacacaacaacaaaaacaaaaaaaaaacaaaagagaaagagagggcgcgcgcgccgcgctcactaacagaaatatctctctctctcgcgagagaggctcgcgcccccagagctagttcctcgcgcgcgtctctcacacccgcgtcgttcttctgtgtgtgtcccacaagagagaggcgcgcccccctataagagagagagagagcccggtatatatatatatacgacacgcgagagagcgcacgagagagagacgcgcgcgacgcgtgtctacaacacacaacagcgcgtgcgacgagcgagtggcgcgggacacacacgcgcgtgccaccccccgggtgggaacaccacacctgtggtgagaaaagagagacgcacccccctaatatcacacgcgcgcggggggggggggggagcccacacaccatagtggtgggggcacacaccactacaccactctcccccacaaagaacggaagagcatagattaatactaacagcgcctccctacaagacggcggcaggcgcatccatatatttagacaccaccatcactttcgtcaacagaagggggtggatataaaactaagtctgcgtggtgtgtggcggatacaaccaaacaaagacgcagggcggacagacaaatgatttaatgtacctcaaccggctgtgcgcttgattaacacagacaaaaacttttagcgcgagccgcccaacacccggagagcgcgaatcagttacttatcttatgcgcgagcaaaccaacattattttttttcaccaccgagggagctgaggatgtaatatatacataatctaatgan

SEQ ID NO: 608689 - DNA, 206 bp, Homo sapiens
  misc_feature (66)..(66): n is a, c, g, or t
  misc_feature (86)..(86): n is a, c, g, or t
  misc_feature (95)..(95): n is a, c, g, or t
  misc_feature (102)..(102): n is a, c, g, or t
  misc_feature (113)..(113): n is a, c, g, or t
  misc_feature (142)..(142): n is a, c, g, or t
  misc_feature (165)..(165): n is a, c, g, or t
  misc_feature (174)..(174): n is a, c, g, or t
ccaggccctcagtaggttttaaggagtccccagccctcctcccttttggggccgaccagcttatantggtccattttccccggccncatgccccnccaagtnttgcacagggnccccccccccaggggccctgctccgttanataattttaaatacgactgtggncccaacccnataaaacctctgtttgttcgaaaagaaggtga

SEQ ID NO: 608690 - DNA, 1586 bp, Homo sapiens
aggtcctgattggtctttattgtttttctttttggaaacagagatcatgctctggcccgtgtctgggtccaggcgggagggtagtgggggcaatttcggtctcatctggcaggcctcggcgctcctaaggttcaagacgatgcttcgttgattcgtcgaggcttcccaagtaagctggggatctaccaggagggtgccactacacccatctaaatgttaggttattttcaaggtgagaaaagcggggtgttcagacagagggtcgttatggatgggttgaccatggtgatgactaagatgtggtagcgattgaaaaggaatcaagggatgactttccttaatgcggaggggaggccatggacaaagtccgctcggtcggccacacacgtggtccggaaagggccaccaaagaccagcgagaaggtccaggacagcggccgacacactcaacacagtcaatcgcaacagctctaccgagacaaccaaagaagacaaagaggcaaccaacgcgagagcccactacctacaagagatcccacgagagagccgaggcaaaaaaaaacggacaagcccacaggaaacacgagcgccccaatcgcgcacaccaaaaaaacaaagaacaaaccagcgcgcaaccccgcaccccaacacgcgcggacaccacacagacaggagcaccggcaatccgtggccagagacaaacaacgccaacaaatagaccaacagactcccacaaaataacaactacagcgccaacccaaacccaccggaggaaacaaacaacagagcgacgacacaacagcaacacagcagcggcaccaccaaagcaaaaaagagaacacaacaacaagagaacacccaaaacaaacaacagaagcagaggagaagaggaaagaaaaagacaacagcaagagcaacgggaaacaacacacaaaaacaaaacagaacaacaaacgaaaaacaacacacacacgagaccgacaaaacaaagaacgacaaaaacaaaaaaaaacaaaacaaaaccacaacaacaacagaagaaaacaaaaaagaacagagacaaagaaacacaacaacaacaacaaccaaaaacaaaagacaaaaaaaaaaacagaaaacaaggaagtagttggggattgaagcagagagtagagggtagtgagagtgggagaggagagataggagaggagcgagaggaagagaataaagaagagaaggagatgaagagagtgctaagctagtacagtagagaaaggatgagtagatggaaggaaggaagcagaagaaggagagagagcacggagacggagcaggaagaagacggcgagaagacagaaggaagacagccaggcggcagagagaagcgaggaaagagacacaaagaagcagtacgaagaggggaccgagagacaggcgtacgacggagccaacacagcgcggtagaagataacagtcagaaggggaactgcccagggtcatcatgagcgtctagaaggcggggcacgcatgagaagaataaacgccaaagcggagcacgataccagcaccggaggcacacgcacgcagcaagcgaggaagcgagtaaa

SEQ ID NO: 608691 - DNA, 122 bp, Homo sapiens
aagaagatcccaactatagaaaaaatcaccaagaagaaacacatggacacatgaacatcactaaacagctcaagcaccaggtaagaccagagcaatctgtggaaaaaacccgtatgtccgac

SEQ ID NO: 608692 - DNA, 393 bp, Homo sapiens
  misc_feature (34)..(34): n is a, c, g, or t
  misc_feature (163)..(163): n is a, c, g, or t
  misc_feature (369)..(369): n is a, c, g, or t
gtgaagtaacaggtgcccatgtctttccctacgntgaagtcccagaggcctaagctggggcctcagaaaacatgttgaatgaacacatgaatatatcccatactaaaattgcactaggcccaggcacagtggctcacacctgtaatcctagcactttgggagncccagggcggatggattgcctgagctcaggagttcaaggtcagccctgggaaacacagtgaaactctgtctctactaaaatgcaaaaacttggctgggcatggtggcatgcacctgtagtcccagctactcgggaggctgagtcaggagaatcacctgaacctgggaggcggaggttgtagtgagccaagatggtgccattgcgcnccagcaattttttctaaaaaaaaa

SEQ ID NO: 608693 - DNA, 903 bp, Homo sapiens
gggataggagagagatgaattgccaaagtagcagcataaatatctcttacttagctttgtttataaataaattagtatgattggaaaaactagtgtatagggaaatgaaatcacatgttcagagcctaataacaggtagggaagggcttttctactaccctgaagaatgcaagggtaatccaaaggcatccattttctaggcttaaaagatatgatcttagatatatttaattatattctctacactccagcattgaatatgtgctgtttaagaaatgcactaatagctcatatgggctcatagaaacattagaatttgaagtaccttttaaagtaattattttaagacaaatagcctggaacgtaatgagattctcatgccatgcacgctttcatttgtcagttgtacgtgactgacgatcatattgaaatgactacctgaaatgcatatggtatcatgggagagttcaaggtatagattatgcgatggttggccacgaccagtttgcgctgattactcttagagacagaagaaatggacaaggtgacagaaggccaggagcggacactgacaggctatcggatacgaagagggaatgccaaaaggcaggccatacttcctatttttcccccacaggattcatttccgcacacaaaatcctgttgtttcctgggatatcgtcatgcgcatcgaaggaagcactggtgtttggagagccgtatgggttcctaaatgcccctaactctacaagaaaggttggctgcagaataaattaccctgtcactaactgcaatggcttttaacacggggattgtgctgcgaaacacccggtaatgtagacagagttgaatcgacaagagagtctgaaaaacaatggtggcatcacaaagaaggaacatgta

SEQ ID NO: 608694 - DNA, 150 bp, Homo sapiens
cttcggactgtcatcgaaaccctattaacgcggttatttatgggggggctgtagtgtctacttgtatacgggtttaggagctttacccgaatcccgcatcgggccgttaaaacgcaaatgaggaggatccccgcatcggcgtaattagta

SEQ ID NO: 608695 - DNA, 442 bp, Homo sapiens
ggacaagccatctttgaatggttcctcgatccgcctccttgcccgccgcagtcgcctccgaccgcgcgcctcctccgacgccgcggactccggcagttttatcgccagagtccctgaactctcgcttgctttttaatcccctgcatcggatcaccggcgtgccccaccatgtcatgactgcagtccgtagactaccagctccgaaatctaccatcctagggactatgagagggagaagcaaggactggtgtgtaggaaagaggccgaaactggaagcagacgcctcctgctgagaccggcgaatgctagatcgaggacaagatgttggggagcacgcgaggctgacaatgaggtagacgacagagagacgaacagggcggggaggacgacgaggcggaagaaggagggtgatggtcgacggaacgacgatcgagcgtattgg

SEQ ID NO: 608696 - DNA, 476 bp, Homo sapiens
ggaatgcttcatattgcttcatgtataagcacctacacatggccccccccaaccatgaacaagcattcgtatgacatgcttactcagcactgagatctaagatgtgcatgcatagactgaggcccgagagagagaataggagtcagctgagtcgtcccccagattagacaatcgccaaatattctgggaccttgctgggggtcgtacagccctccctgctcatcattgggcctttgcgatttggtacaagctcctcgggaaaccaggagtgacaagggcgcttgtccctgaggagtgcagagcgcggtagttcgtgtgcttgagtctgccctgatgtggcagaggaggagcgggcccccgcagagccagggctcttcaagtgtctcctggtccttggtgaagtggaactggaccaggcgcgagttccggaacagcggcactagggtggtctgcggggaagcgaggggacccccagc

SEQ ID NO: 608697 - DNA, 201 bp, Homo sapiens
cgggaggcctgacaatgaaaaaaatcatactcatcacacagattgttgtttggttgctggtagtgccagcctagttcaaaaaacgcaacaatatcatgacgtagtatggctgttttataataagctctttgtgatgtatacgtcctattatactgcggagttggggtaggggtcttgatcgaacccagagattcccacaat

SEQ ID NO: 608698 - DNA, 413 bp, Homo sapiens
  misc_feature (203)..(203): n is a, c, g, or t
gctctgtcttaaaatacacagagtctatgattgatcgagacaagtcttttatacttgaggaagacataggacaaataaacagttgtttatcagccaatactgtggaagaaattattgaaaaacttacatgcaagatggttcatctatttgccctaagagcaataagaaggtaaaaaaataaacatgtctccaagcatctctanaagatcacactaaaggcaactcatagaaggggtcttcaaaagaccttgcaaagaagtactaacatctggagtatcggctaagtcaagcttgtatgagaggtcatgactttcatgaaggcgttagagctgttttaattgataaagaccagagtcccaaatggaaaccagctgatctaaaagaagttactgaggaagatttgaataatcact

SEQ ID NO: 608699 - DNA, 143 bp, Homo sapiens
ggtttttccccccccccccccgtttttcggggggtaagccccaggaccccctcggggtttttttgggtccccccccccccccctggtcatttcccccctttccctggtttggggtctttaaaaataccttggggttcccccca

SEQ ID NO: 608700 - DNA, 326 bp, Homo sapiens
gaccccatcctttcctctatcacgaattctgagttgctcattttaagatcaacgaggcatttttagggcatgtatgcctgagagaggaaatcaatgtgaacggcaaacttccctctaaaacagcctaatacaatactggtccaggaggaacaaggcacggaaaccccctggtgaatgactcatctcatgaataggcatggcatggtcaggagagtctatggaggataagacctggaacaatacctctctctcttgcttttttacacacacacacacacacacacacacactctcacacccctatgagcccaaatctattgaattga

SEQ ID NO: 608701 - DNA, 238 bp, Homo sapiens
cctctctgctcaccgaacattatggccaagcatggcggctgtatcctagcactttgggaggccaagggggatgaatcgcttgaggtcaggagttgaagaccagcctgggcaacaagacaagaccttgtctctacaaaaatacaaaaactagccaggcatgatggtgtgcacctgtagtcccaggtacgcgaaaggctgagatgggaggatcgcttgagcctgttcggttgagcggaga

SEQ ID NO: 608702 - DNA, 845 bp, Homo sapiens
  misc_feature (452)..(452): n is a, c, g, or t
  misc_feature (459)..(459): n is a, c, g, or t
gtactaaataactgatgacctctgctggatttctgtttacatccagaaaacaatgttaaggatgtatttattcccctaccctgacatgaaacgtgtagcgagtagaatccgtgtttctagcagttctagaacttctacgatgcttaacacgtcaatcaacaaagacttgtgtttttgacgattattcgtaacttgtggcgaacaagtaagacttataacgcagaacttttagccaatttttttcatctaaaagtattttaagatatttttaaaatccaagagcttctctatacttttcagaaatatccagatgcagtgaactgccagaaggtaaccagtctcaaacatgcttatcccattatcaacctgaaagttgcttgtctttaagataaaaatgtaatgttgtgatatccttccagtaatgccactgtattttgtctccaaataaagangcttatngtagtatgtttgcagaaaaattctaaacaaaaattatacagcttattcagcagtgtgggaatagggatctaaattttcaaatcacacattcatatcatatatataacatggtgctagattttataattgcgcagttgagtatcagtttaatctatacttcttaaattccaacttaaaaattatgcaggtttcagcacaatatatgggaacagtttaaccaatgtttaaaaatcagaaacagcatgcagtgttccatgctttaaaaatgatttttaaatgtggtaatatagcatatacgtttcatcttcatctgtcatttgcgagcagtcttccaggttaaaagatacttctcaacaggttcacagtaattttactctgtatgtaag

SEQ ID NO: 608703 - DNA, 111 bp, Homo sapiens
tctcagtctcctcatgctggcacaccacactgacctccagataccctgctccaggaagccatccatgatttcctgccatcatttttgctagttggtcactcccaggtctat

SEQ ID NO: 608704 - DNA, 154 bp, Homo sapiens
ctcctatagatttaaggaatagttggaaaatgggagctacacagtagactatgaaggaccaaccaaaaagaacaagaactgggtggtatcatggaaacccaggtaagagagggcttcaaaaaggagaggtgatcttctggcgggtacctgagct

SEQ ID NO: 608705 - DNA, 382 bp, Homo sapiens
  misc_feature (43)..(43): n is a, c, g, or t
agagatgtggctgtgcttttcccttaggcaaagtggaaaaganttagcccttaccaaagggccccttcccaaaaagtgatgctggaaaatctccggaatttggtttccttggcaaaatcaaaacccaaaggcccaacccgccctttttgccctttggcctttggcaggcagcagttcccccacccaaatgaggtcccccatctcccttttcccggtttccctgcaggaaatcaacccccccccggaaatccccgccccaagggtcaccccccctccccccccccctttttttaaaatccccgggggggttaaaccaaaaatcccccagtggaagggggggccccccccctttttttggggaccaattaaaagggggctttta

SEQ ID NO: 608706 - DNA, 195 bp, Homo sapiens
aacctgaagggaaagcccacggacgatggagccatagagttcaccttcgacctggagaaggagacgcctggatgaggtggccaagagatgattgagtctggattcttccacgagagtcaccgtccagatcgtggcccagtccatccgtgaccgcgtgggccataattcatgttgcggcgggcgaggatctaggcc

SEQ ID NO: 608707 - DNA, 94 bp, Homo sapiens
ctttaaaagaataaaagataatgattaataattatcttttattcttttaaagaaatatggaggtacaaagaataaaagataattattaatcatt

SEQ ID NO: 608708 - DNA, 270 bp, Homo sapiens
  misc_feature (53)..(53): n is a, c, g, or t
  misc_feature (63)..(63): n is a, c, g, or t
cccccccccccaccctttgagatggctgacaagcggaacccccccaaaggggncctctgtggnttggaagctaatgtgctcgcttgtcccgtatgatgtgttactcgtgggcatttcattgagagtgatatagcaatagggtaacctgtagtcacacatgcctgtctggatgttcagtatttgtaaacccatatggtggcttcttttttttcctttcaagtcaatttctagctccatctagagtaagcaataattcatagtattaggcca

SEQ ID NO: 608709 - DNA, 130 bp, Homo sapiens
catgactgccagcctcagtgaccttcaagcctaatgaccttgctccaggaactgggacccttgacccagcttgacccagtcatctaggaatctggatgttatcaccttgaccccacgagcgactgacagg

SEQ ID NO: 608710 - DNA, 119 bp, Homo sapiens
aatagaatggatggaatggaacggaatgtatggaatggatttaatggaatcaaccgagtgcaggagaatggaatggaatggaatgcaatggaatggagtcatccggaatggaatggaat

SEQ ID NO: 608711 - DNA, 415 bp, Homo sapiens
cgggctgcaggaattctgcacgagaaggagtctgagaagatagcgctgtcagagaagatgatgggtacacagcacagactgtgcaccatatccctgtgagatggagcggcagaaaccagatgcccagagccggcaggagcacgaccgggtaggcctgccgtcgtaaggaggcttgcggagcaagagcgccctctcttcaccgagctattccgcggttttcagcataccatctggcggactcctcttcctctctcttctcctactctggggcttctatcctgggggtccttgagatgcctatcttccttttgtggctcggaacctctcacgcctgccacaaggtactcttttccttggtaggtctgaactttaaataagggaatgcctgtgagaatgccattgctcaatttgtgtc

SEQ ID NO: 608712 - DNA, 216 bp, Homo sapiens
cggatcctgtacacctctaggggctcagtaaattagtactttccataagataagatgaacccagagtagctaccagtggagatatttaaccttttatctgcagctatttgcttaggaacaaaaggaaaggcagtttcttgcatgactcaactttcagcttttttttttttcccttttggccttattaattggggccccctaaagttgtcgggtccc

SEQ ID NO: 608713 - DNA, 110 bp, Homo sapiens
tgagaacagtagtgaactagcctaacgataattttcgctccgggcaaggctaaaggaaaaatggcacgggggctctgtgaaacgctgtaaagtgaaaaggagagtgtagg

SEQ ID NO: 608714 - DNA, 199 bp, Homo sapiens
cgtaacatagcagacgcatgtgcgtagcggaaacgaatccaactaggaactatgaggttgcaggttcgatcccaggccttgctcagcgggttaaggatccagcattgctgtgagctgtagtgtaggctgcagatacggctcggatctggtgttgctgtggctgtggtgtaggccggtggctacagctccgatagcaccc

SEQ ID NO: 608715 - DNA, 185 bp, Homo sapiens
ttggtggggctttgggctgggaggggaaggcggataagagatgggggaactgtggatgccaataaggagaccatgcgtcatctcgttggaatcaaaaagggaataaggaatagatgtatgaaaagtcgtgtcactggatgcataattagaaataaagtgtatgctgctgaattggaaaaaaaaaa

SEQ ID NO: 608716 - DNA, 407 bp, Homo sapiens
  misc_feature (163)..(163): n is a, c, g, or t
  misc_feature (317)..(317): n is a, c, g, or t
  misc_feature (322)..(322): n is a, c, g, or t
  misc_feature (392)..(392): n is a, c, g, or t
ggcacgagtgtagatgtggaagaacaggccacttcaagagaggatgtcctgaactaagaaaggagaaagaagcccttccacccataactttcgaggaagaataggggggtcaggggctctgtctcttgagtcccaccaggagcccttgataaatttggaggtnggacctaaacatgagcttatcacctttttagtcgattcagaggctgctcgctcctctgtttgtttccccccgtctaatgttgtctcctcctcagaggaacttttattctccggggtaaaaggggaaggagaggggagaacagcaggcataagtnggctnggcagaggcaggggaaagaccagcagaggagggagagagacagagggaggggaaagaaagagagaggganaaagagagagagaga

SEQ ID NO: 608717 - DNA, 500 bp, Homo sapiens
  misc_feature (135)..(135): n is a, c, g, or t
tttaatggtgtttccggttggcaaacctcacgcaagaggaaaaacagtattatatgtggggtcacccggggggtttccacacttttaaatcggaagttccttccggggtcactaagggggttgtgaaactctttnactctgatcccatcactgtgacggtccctgtaaaagtttccaggaaaaaccctaaatttatggaggccgtggcggaaaaaacgctgcaggaataccccaaaaaaccccgggaggaattaaatttggatgttgcttttgcacccaccgggggaattaagtccagctccccccaaaatgaagtgcagccccccaaaaaaagctttgcccgttcccaagtaaacagggcccagccttcagggccccaaatccggccaaccttttcccgctttggattctgcactttaacactcgactttgctggtcatgggaaaaaaaaaattggtcctgcatgcaactaattcaataaaactgttttgtgagctgga

SEQ ID NO: 608718 - DNA, 354 bp, Homo sapiens
  misc_feature (3)..(3): n is a, c, g, or t
  misc_feature (206)..(206): n is a, c, g, or t
  misc_feature (292)..(293): n is a, c, g, or t
ggnccataaaatcaattgagccaggttaggatccagcatttttccttgatgaaataaaatgtctaatagaagtggtcactgtgcatcctttttattgacggttactagtgtttgatgaaactttggctcctccatgtataacaagtacccaggccacaaggcagtggagagtagtggttcagagcactggagagtctgggcaacgnttgtcacgcctgtgatcccaacactctgggaggccaaggcgggtggatcactcggggtcgggagttcaggaaccggcctggccagnntgcggagccccgtctctactaaaaatacaaaattggccgggtgtggtgatgtgtgcctgta

SEQ ID NO: 608719 - DNA, 276 bp, Homo sapiens
  misc_feature (205)..(205): n is a, c, g, or t
gccgtaggcaaagggaggtggggaggcggtggccggcgactccccgcgccccgctcgccccccggcccttcccgcggtgctcggcctcgttcctttcctcctccgctccctccgtcttccatacccgccccgcgcggctttcggccggcgtgcctcgcgccctaacgggcggctggaggcgccaatcagcgggcgggccaggggnttgccagccccggggctgcgccggcgaatcggcggggcccgcggcccagggtggcaggcgggtctacccgc

SEQ ID NO: 608720 - DNA, 371 bp, Homo sapiens
  misc_feature (72)..(73): n is a, c, g, or t
  misc_feature (93)..(93): n is a, c, g, or t
  misc_feature (97)..(97): n is a, c, g, or t
  misc_feature (101)..(101): n is a, c, g, or t
  misc_feature (140)..(140): n is a, c, g, or t
  misc_feature (151)..(151): n is a, c, g, or t
  misc_feature (168)..(168): n is a, c, g, or t
  misc_feature (205)..(205): n is a, c, g, or t
  misc_feature (226)..(226): n is a, c, g, or t
  misc_feature (234)..(234): n is a, c, g, or t
  misc_feature (246)..(246): n is a, c, g, or t
  misc_feature (255)..(255): n is a, c, g, or t
  misc_feature (268)..(268): n is a, c, g, or t
  misc_feature (274)..(274): n is a, c, g, or t
  misc_feature (310)..(310): n is a, c, g, or t
  misc_feature (313)..(313): n is a, c, g, or t
  misc_feature (322)..(322): n is a, c, g, or t
acacaagccggccctgggcgctcctgcctcctctctcagacagggaagcgggaaccagacttactgatccannccccacctgcctcccatgcnaagnccanccccaagatcccaggcagcgacacagcatcccctctggncccctcctggngctgctcctcagcaggnggcgcaccaaaacttgccccctacaatgttgaatganaaacgtttcccctcccctggnagcaaggnggttcccaaganctgagaatnccccctggaaganacactnccccctagacatacctcccacccttccatgccctangtnactcaaagnggggaaactgaggcacagagaggtggagttacctagcccaggccactct

SEQ ID NO: 608721 - DNA, 456 bp, Homo sapiens
  misc_feature (86)..(86): n is a, c, g, or t
attctgtactccgtgccatcatgtccgtcctgacgccgctgctgctgcggggcttgacaggctcggcccggcggctcccagtgccngcgccaagatccattcgttgccgccggaggggaagcttgggatcatggaattggccgttgggcttacctcctgcttcgtgaccttcctcctgccagcgggctggatcctgtcacacctggagacctacaggaggccagagtgaaggggtccgttctgtccctcacactgtgaccttgaccagccccaccggcccattcctggtcatgttacttgcatttgttggccggcctcccctggatcatgtcattcaattccagtccccttttttgcaatcatgacctttttatgtttccatggtgacccccttgggggtccctgaccctgcttggtggggtcccccttgtaacaataaaattttttttaacttta

SEQ ID NO: 608722 - DNA, 318 bp, Homo sapiens
tcagagacaggctcccctggagcttggccagctgactcacagaggtccctgagtctgggccacagctcaggctccgggtccagctatgccctccaagagtgagtggcctcctggtgcctctaaggggggacatgggggaagctatgacgggcaaagggcgtagtgtgaccttaccatgcaccaatggctcgttccgtgtttaaacgagcaatttggggttccaggctcagacaagtttagcaacccgtgacaggattaaaataagttctggacagcagggtaatcataacagtttatcttatgttcacatagcagggt

SEQ ID NO: 608723 - DNA, 317 bp, Homo sapiens
tgcttgtaggctgcatgaagcctcgcaagttcctcgatcattatggagttgtactccggatctgtgaagaagcttggaccaacgtgctggagacatgtgctggaagctgttttcgccctcccaagagcggataaacggttaggtgacccaaccagcatagagtgaccccagccaagcccaacgtaaattgctgacccccggcatcctgatcaaataatgtagtccctgtcttacccccctaaaatttgggagtggataagtaaagtcagataaaatcccaccctttctcttttgtgcttgtaagttacactgactga

SEQ ID NO: 608724 - DNA, 1146 bp, Homo sapiens
ggccctgctgacaatatgcggaccccgtgagcgcccagcacgccaagctgtcgcttggacgagtgcaaaccacatctacaaacgcctgctgcacgctgcgcatcagacttttcctaaggctcacgctaggtcctcaacgtcatagtacaacaagtgacaaagagacctgtgattatcacactgcccaggaccattggccttccgcggagcacatgccgagctcgctcgcgtggtagcctatggaccattggaccgcgaggcgttcaggtgcagcactgtgtactaatctcaagccgtcattcccgattagttgacaggtgaacgtctggatattccgactccgcaacgcgttattgacccaaatttccattcgaagtcgtagacatgagacgcattatcccctgttgtgcctgcaaacctgtttcgcatcgatgactggctcctcgtggtccacccacactttgggaacaattagcccatcggtgacgaggcagtgatcgtggcaggaattgatggaggcaagagaagaggagtactagagattccgagccgatcacccccttgggggcctttagcgcctcgagatggatgcacaggttgaaccatctatcttgcgtcagtttcgcgtatggctccatcgcaagaatcatcaaaacgccctaagaaggatcgaatgtcacacagccccactaatgatgtccccttctttttaattccttatggtcttgagcgagtcctatccggggtagaccccgtagcataggccgccgtgctgacaggaatctcctgattcccataacgaaaccggaggacaccgtgcgcttgaagttgccaaagattggctggaacctgtggaaccaaaggcccgcgagcttgatgcccaagtgaagccaaccacattgaaactggggcaacagagtcttggccacggagggaacaggccccattcgctgcaaatccaacgcgattctccgagaggccacccgagacacagtggcatgcgttggccccgacgcaaggggccaagggacagagacccgagggcgccttgacacgaaggaacctaacgaggcaacttcatccgccttggcacacggtgtcaaaagaagagccggggcttccaagaacctttcccagaacccgttc

SEQ ID NO: 608725 - DNA, 208 bp, Homo sapiens
  misc_feature (6)..(6): n is a, c, g, or t
agtagnttagagctctgtacatgtcgggtcggacgtagcgtatcgatggcgcagtggagggggcgcaatatgcatcctaggcctataaatattcggagtatactgtacgcgggtaggttaacaaccggtacctctagaactatagctagcatgcgcaaattttaaaggcgctgaatatcgatctgcgcgcagcatctgtcagtgcatg

SEQ ID NO: 608726 - DNA, 213 bp, Homo sapiens
aggaaaggatagaaatgttcaggacatcatcatacaggctcctcatctacaaagttccagtagcagtgacgcctacacggaagacttggaactgcaaacaggctggggtcccctcagtgacatctgacgctgtccaaccaaaagttcgatttttgttttgggggtgaaggaggaaacagcctgtactaaagccctaaaataatttcttgttta

SEQ ID NO: 608727 - DNA, 109 bp, Homo sapiens
ccgactttggttttcggcgtgtgacgtgaagatcggcgacattgggcttgctcagtatggtctctcggcgtgtgcaatcttcacgagcccataatcgccgatcttcacg

SEQ ID NO: 608728 - DNA, 247 bp, Homo sapiens
atgtaaaggaacatccttctccattgaaagagaaatttgatttctctgggagaaaaaattacaacgtgtagtcactaggatgcattatgaacctgtgattgcgatgtgggattttatgatcaaggtctcttctcttccgcaagatgtcttcagctaagggcggaattacagatttcagcgcccacaaaaatgtttcacagacctttagccccatctagtggccatatcctgtcaggacacccaagcc

SEQ ID NO: 608729 - DNA, 166 bp, Homo sapiens
  misc_feature (3)..(3): n is a, c, g, or t
  misc_feature (141)..(141): n is a, c, g, or t
  misc_feature (151)..(151): n is a, c, g, or t
tanacagagaagagcccagagtatagagcggaagcaagagagtgagccacgtattgttagtagagttgtccagtgttgtgcttggaatggtggagtgttctggttcagtctcctcattgttttatcagagtatttattccntgtgcttcangtcggtaacagcccg

SEQ ID NO: 608730 - DNA, 1218 bp, Homo sapiens
  misc_feature (1218)..(1218): n is a, c, g, or t
tctggtacgccccggggtaatgggatatgtcgaccagcgctgtctggggagtgcctgggtggccctgggatggggaacctgcggtggcttcctgctggagtgtttctgtgcagtggcattcgtggtgccggggtctgcgtgcctgtgtgacgggggccgtggtgcctgatgtgcctggcgtgagtctccgcgtgatggcaatggcctgacggataatgtgatgtggatgcccgtcaccagagttgggcctgcttgtgtcaatgtgacatgacatgatcaatgtccctggacgcgcagactctatctcttctccctgcccattaatgtgaatcagagatcattgatttcttcctggcggtgctctcttctccaagtgcattgagtgtttcttgaactgattagtagcccaggttgccaggaagtgcatgaacccggtgcctggcacatgctgcagccaggggtttcaagggcacttttgttgctattcgtggtgactactaagctggccaccggtccgggacctggtgctgtttaaggttgctccaaaggcactgctggttctatccggtcgcaatacccgtggcgtgccaattccactccctttggctcagatgctcctaccaatcgttcccaccgtatgccgcacgaagggcttaccttgtgtggggcacacacatgactctgtgctaaagccctcaccactaactatggtacccccaattagccaaaggtggttgagcaagggccctggctagtacgtgtgctactatgagtgacatggagtaagcggctcttacaaattcctcgtaggcaagccgcacaggggggccatctttgtgccagatttctgtactttccgttcaaagcccttggatgcctataaaatgaaaatgctatggcgtccaacttgaactagcgctatggtgatacattcagagacttaggaagctatggtctacacgaatcatctttacaatggccccagggagaggagcctttagccacacattttgagtcacagacgcccctgttggagggccaagagcatattacgggcagccaaaagtggtccctaagctctttttttgagacgttagccacacagtcctttcagtaaacagtgaacctcttacgcaagcgcgtaactcatttaggagacccaccctcaggacaacccttcatatgttgcgacaggaggagtgaacatttggctatctn

SEQ ID NO: 608731 - DNA, 1006 bp, Homo sapiens
ccgatgcttcgttgtgtgcctcattgcgtcccgtccggtcgctggcgttcgcagggcatccacgctccgactgggtgcctcctgtctggggagccttcccttcctgaggtcggcgtgctgccggatttgcgtgaccaggcggttgaggcccacacggagccgctggttagcgggaccggggctgcagctggcgtcggtgaggaattgcggaccttcgtgctaggtcctcttggggctgtatccgctcagggggtgatctcgccagatcgcagatttatggtcagtggacggcttcatcgctgactggtagcacatgccggcaggccggggatgcccagttgtgcgagatacgttgcgcaggagcagcgcgagcccactcccagccagcgtcgtcgaggagccccagggggaggacagggaagcagaaagagcttcccgggggcctcagacgggagaatgcatgcgcgacagcccctgggagcgacagcagaagaggccatgtcctgaggtccacctcctgcggccgaggagggggacgtcccgggatgaacaggatggagactgtcagctgagacagaaccctgggcagcggcagtcccccccagaatgggtcccctatatagtgccagcaggacatgtacagagccagcggaaggtgtaaccgcagccccctctgagtgatgcctacctcagtggtatgcctgccaagagacgcaagacgatgcagggtgagggcccccagctgcttctctcagaggctgtgagccgggcagttaaggcagctcggagctcggcccctgacgagcccgcgagagctctgagccgggacctggagggcaccagaggttcaggagagctacaggcagcagctccggtctgatatacaaaaacgactgcagtaagacctccgaaatacagtcctcagcgcttccaccaatgcccagcgggcctttcgctgatgatccttagctctttgctctatggcctattcctcatcagggggact

SEQ ID NO: 608732 - DNA, 267 bp, Homo sapiens
ggtatttgggtccagccgtgctcgcctgtgtttgatgtgtccgtttcaaatttcacactgcctttgccatggggcagcggacaagcacagtgccctggcacaaggctggcctctgcgtctcttagctggacccagagtccctgtataagagtgggggactgtgggtggcactcagtaggtgtccctgtacaagagtggaggggctgtgggtggcactcagtggtggtccctgctgaccacagccagtctactcctagaataggaatc

SEQ ID NO: 608733 - DNA, 262 bp, Homo sapiens
taacaaaaatgggaacagggctttcgggatacaaggtctccttacaatttttctatcaaaaaaaatggaacctctgaagcttttaattaagataacccggtacctgatattaccagcgggaaattcttttaagggggcccggggatctggcccttacatattttaggggggggcaaaaggccaagggataatgggcctcaatgacactgcccggcaagggacatgggccccttgggggacagtggctttttgaaggaagtgg

SEQ ID NO: 608734 - DNA, 238 bp, Homo sapiens
agcatagggtgggtacctgtagtcccagctactcggaggctgaggcaggagaatggcgtgaacccgggaggcggatcttgcagtgagcggagatgcaccactgcactccagcctgggtgacagagcaagactccctctcaaaagaaaaagaaaaaagatgtaaaaaccattcttagtttgtgggccttacaaatcaggccactggcccatggcttgtagttagttgatccatgtcatg

SEQ ID NO: 608735 - DNA, 572 bp, Homo sapiens
  misc_feature (6)..(6): n is a, c, g, or t
aaatangccaaaaaccgtaagtaaaaagaacaaagctggaagcatcacactacctgatttcaaactatattacaaggctacagtaaccaaaacagcatggtactggtacaaaaatagacacatagaccaatggaagaggttagaaaacccagatataaagccacacccctacaaccatctgatcttcaatgaagtcgacaataacaagcaatggggaatggattctctattcaataaatgctataactggctagccatatgcagaagattgaaaatggacccctacctttcaccatatacaaaaatcaactcaatatggattaaagaattaaacttaaaacctaaaagtataaaaactctagaagaaaacctaggaaataccattctgacataggtgttggtaaatatttcatgatgaggtctccaaaagcaattgcaacaaaaacaaaaattgacaagtgggacataattttgcttgtaaatacttcaggaccgttctctttttattatttttattttttttctttagacttctcaagtgtggatatttggcacaatttgtgtgtatttta

SEQ ID NO: 608736 - DNA, 377 bp, Homo sapiens
  misc_feature (5)..(5): n is a, c, g, or t
  misc_feature (38)..(38): n is a, c, g, or t
taccntttttctccttcctttccttcttctttactacncttacttgcgttttttagattaatttcccccctctgcaccgcctttctctcagtagggcctttttctcaccttccccgcgcttctgcctcttgctatcgtgaatttaccccagccgccgcgtgtttgtattcctttactcctcgtcgcgtagcactccggcggggccgtcctcgttacttgggtatgggtagcccctcggcgggcgtgttcttgtcgtgctgttgcgttccgcgcgcgtcgcgcgtgtagttgttttttcaccggacgaggtgcgccacgttgtcccgttctagttgtttgcgaatgttagggagtgtgtgtggtgacgcggcgtgtgg

SEQ ID NO: 608737 - DNA, 658 bp, Homo sapiens
  misc_feature (447)..(447): n is a, c, g, or t
cacctgaggtcgggagttcgagaccagcctgaccagcgtggagaaaccccgtctctactaaaagtgggaagctagctgggcgtggtggtgcatacctgtgagcccagctgctcacgaggctgaggcaggagaatcactagaacctgggaggcacaggttgcagtgagctgagatcgcaccactgcactccagcctaggcgacagagctagactcagtctcaaataaatagtaaatatattcttaatctttatggggataaagaaattaggacttgtgagacattttaaagggaatatcctgctttttaaggaatgctagcattttgtaagagcttcataatcatttaagagatcagctacttaccctattccagaggggttaatacagaaaaggctctcatttcttagctcttctaagcagctagctgtcctttctctcatttgagntggagactctggctgttttggtcattctcaccatgctttgctctatctttttcccccattgaccctatacactcttgtgcactcagctgtgagtcgatccagagcagcacctggtggaggtgaggccatgggcaaaccttctgcttgtgtgagactgcgctcgagtccatctgctgctgctgggggcccacctgtaagagtccgctcattt

SEQ ID NO: 608738 - DNA, 579 bp, Homo sapiens
cagaaggttgttgtcgtccgttgtgaggcactcaacgttgtctggtgaattcttcagaaccaagttgaaataccatgactacttgagaaagggtactcgtttcaacaagaccagaggtccattccacttcagagccccatcccgtatcttctacaaggctatcagaggtatggtttcccacaagactgctcgtggtaaggctgctttggagagactcaaagtcttcgagggtgttccaccaccatatgacaagaagaagagagttgtcgttccacaagctttgagagtcttgagattgaagcaaggtagaaagtacaccactctcggtgacttgtccgcctctgttggttggaagtacagcgatgttgtttccaagttggaggacaagagaagagtcagagctgctgagtactatgctaagaagaaagctgctaccaagaaggttgaggctgctaaggcttcccaagctgattctaaggtcaccaaggaattggctgcccttggttactaagcggttttgatgatgaaagaggaaaaacgagtataggtttagtctaaatgtttatctgtaattgtacc

SEQ ID NO: 608739 - DNA, 319 bp, Homo sapiens
catacgctctgggaaaaaaaaatcttcaactgtcactgattacccttgtccaaacccaggacatatcctaagacctggccgtgatcattttcctgaactatctgggtgaatggattacaagaaacggagaaagtagagccagtggtgtggggagtggtgtgcatgcccactgaaatctgcagtagggtgccgatttgtacgtccgttgaaagttcctcgggtcacatctgaaggcggttctaggtcaccctagaggcctaggctggctgtctacacgtcagggggctgagttgccatacaaagactcaaaggagtgaat

SEQ ID NO: 608740 - DNA, 292 bp, Homo sapiens
  misc_feature (190)..(190): n is a, c, g, or t
  misc_feature (253)..(253): n is a, c, g, or t
  misc_feature (255)..(255): n is a, c, g, or t
  misc_feature (279)..(279): n is a, c, g, or t
tcgatgaggccctgcataaagagccgcgccgatcttcaatgcttgtgcgttgagagatcggcacagaaactgggcgaagaacacgccgagattttcgatgcgcacctcttgatgctggacgaccccgaactgctggatcaggtcgcggctgggctgcagtggtggccagagcgccgaaacggccctgggntgccgtatccgacacctttattgctgtctttgagacgatggaagatgagtacatgcgcgaggngnccgccgacttgcgcgatgtgcgantccggggtcgacg

SEQ ID NO: 608741 - DNA, 368 bp, Homo sapiens
gtgtcagacaatacattcagagtacctaaggcaaaacaaaacaaaacaaaacaaaacaaaacctgccaatcaaaaatactgcatccagtattagaaatgctatcctttagaaatgaagtagagataaagactttccagacagactgagtaaatctagcatcaccagacatgtccgtacaagaaatacaaaaatgagttattcaaactgaaggaaaaagatgtttttgcataacaagaaatcatctgaagacagaaacttcactggaaaatgtaagtaggaaggcaaattcagaatactctaatactgtaattgtagtgtgtaaaccacttacatcttcagtataaatactaaaagacaaaacaataaa

SEQ ID NO: 608742 - DNA, 131 bp, Homo sapiens
aaacgcaatggaaacagaggttctataacataaagaatgaaacaaataggctgggcgcggtggctcacgcctgtaatcccgagcactttggtgaggctcgaggaggacgaagcagcatggtaccgacgctc

SEQ ID NO: 608743 - DNA, 474 bp, Homo sapiens
  misc_feature (126)..(126): n is a, c, g, or t
  misc_feature (177)..(177): n is a, c, g, or t
ctttctgtcccagaactccaggaaacaatggagaaactgacttggctggcatctgaaaggcgcatgagtcaggagggtgagtctgaagaagagaattctcaggaggagaactctgagccagaagangaggaggaagaagaagcagaaggaatggaaagcctgcagaaagaggatganatgacggatgaagcagttggagactctgctgagaagcctcctacttttgcttcacctgagactgctccagaagtggagaccagcagaactccaccaggagagagcatcaaagctgctggaaaaggccggaacaatcatcgagctcgcaacaagcgggggaagtcgggctcgggccagcaaggacacctcccaagctgctgtttgcttgttattgattgaaggacattcttcgagcgagattccactcagggaagcaggaaggactttggccttttgccccagcttatcttgaccaaa

SEQ ID NO: 608744 - DNA, 1433 bp, Homo sapiens
tgcactggatgaagctcgaaaagcacgtgcaggcagagagtgggaccgtctttattgctcaaattaggagactactatccgtccagtagatcacaagttctcacgagacttggaagttacatgtgatccattgtgctacgtaggtgaagcgctatctttgcttgaagctagagggaggcaactatactcgactgtggtacaatgaattgtggccctctatggtacgatgtcctagaacaggtcgtggcagtgagaagtcccgaagagcacctgtctatccagtagtggtacctaggacaattgtttacttatgtgaagtatgacctttagcaagagccatcatatcgtataatctctactatatctcaagatgtcctcgtcgcttcttgcggcaggtagggctgccaagattgggaacggtgacgcacagttctatgagctcctacggatcttcttgggccccctctactgaagttgaagttcgcagatcgagcctaggggcgcttgatgcccacagtcaagataggtaccaagcgagttctataccacataccgttgttgtggaagaagccatttcaaccaccataccttggagccttgggatgctgacagctaacgttacggtgaccggcacacggttcaaatcgaattttgatctggaatcgcggaaacggttctgaaacaccattccggagtcagctactcatgttcccttgtggagcaaggagaggggccatgacaatggttgacaacattccacgataggttgacgaaaccgccaccattcctcagaaatgccgaggagttgggaacgatagtacaacacaacagagttcaagaagccaacaaggaggaaaaggacgggtgaccatttatatgaccctctaggcgagcagcaggggccaattgagaaccgccaagctttaaagccaatgtgtatgcgaattgagcgccaatagcctctaatcggagcaagtagttaacaagcacttaagcgccagtagggaaggatactatacctccgatggcacagctctgcccgacacaagggcaccaatgcgtgtggagtttacgcgacctgtgtggggtaaggagaattctcgcggagatccaaaccgggttgggtatcgggttaaacagccacaaacgggtcccatcgcgagatagaaagagaaaagaaggcatccatctaagaagcgcctgcgcgcccaaggtgcttgccaaggacaaccaagttctacataaactatcggacggcggtggcggccaacgcacatcaagcagacggcgacgggcgacaaacaccgaagaggcaaagaatgagcaagcgagaacacaagggcgcaagaccaacaagagggaggacaaaaacagagttggtccactcaatcagacacgtggcaaacgcgaagcatgcgagagcgaacccaaga

SEQ ID NO: 608745 - DNA, 885 bp, Homo sapiens
tctaatccaacagttttttaattaggatgtcagcccgtgggtccaaaggtcaaaaaatagggacaggggacagcccaggcgaggcggggccgggggttcaccccaggagtgtcccaaccacgaggggcagaatctccctccacctccacagtgcgtggccaagggcacaaacgcttgccgatattcgcctgtgccaagtgggggtggctcacaatgtgcgtgctgtgccgcgtggctccgtgttatgtggcgcccggggtgtcgccagaaacacaaaacaggaaagcctctacagggcccggtcctttggagagcttccttgtgaaatttccctacagaagaagagcgccctccttaacagattctgtggcataagagccgtggtctcacagggcgtgttcgttaaatgtgattgaccaccattcaaaaacaggcgcgggactctcctgtgtgagcagtgctcctctctcccaagtgtcgtcgggccctatggaggacaacgaacaacggcccaacgcccgagtatttccacacaaggggatctcactcacactcaggatttaaacaggtgtgcttgacgccgactgtagccggaaagcccagacagttgcactcccaaagacacacgtgtgcacagtgagaaaaaaggggaggtgttgtggcgcacaacggaaagtatgtggcttacaccatgtgctgctgccccccgcaaaaaaatattcagagggaggcggccctctgttgacatgaatgctctccccgggaaaaaaacccccccgttggtcaaggggtctcccccacgcgtcttccccgaggaacaacccccaaagatttgggggggtctctaaagtagggaccctatagaaacgtggcactttgtaacag

SEQ ID NO: 608746 - DNA, 330 bp, Homo sapiens
gcctgtgttggcttggtgtggatgcaggttgctctcaaggaggatctggatgccctcaaggaaaaatttcgaacaatggaatctaatcagaaaagctcattccaagaaatccccaaacttaatgaagaactactcagcaagacacaaaaaaaaaaaaaaaaaaaaaaaaaaaaaatacaaaaagtagccaggtgtggtggcaggcacctgtaatcctgggttctcgagaccgaggcatgagaattgcctgaccccaggaggtggaggctgcagtgagccaagatcatgccactgcactccagcctgggcgacagagtgggactctgtctc

SEQ ID NO: 608747 - DNA, 1015 bp, Homo sapiens
ccatttacccaaataaagtataggcgatagaacattgcaaaccgtggcagcacatagcatcatcagtcacccgcgaagggcacacagcatgcaacacacattcatcagccacagccataatatcagccaaggcactaacccctataccttctgcatcacatgacattcaactagcaaataactttgcaaggagagccaaagctaagacccccgaaaccagacgagctacctaaagaacagctcaaacagagcacgaccacgtctatgatagcaaaatcagtcgggacagatttataggtagaggcgacaaacctaccgagcctggtgatagctggttgtccaagatagaatcttagttcaactttcaatttgcccacagaaccctctaaatccccttgtaaatttaactgttagtccaaagaggaacagctctttggacactaggacaaaacttgtagagagagtaaaaaatataacacccatagtaggcctaaaagcagcaccaattaagaaagcgttcaagctcaaacccactacctaaaaaatcccaaacatataactgaactcctcacacccaatgggaccaatctatcagcctatagaagaataatgtagtataagtaacatgaaaacattctcctccgcataagcctgcagtcagatcacaacactggactggacaatctaagagcacaatatctacaatcaaacaccaagtcataattaccatcactgtcaccccaccacagcgcatgctcataagcaaacggttacaaacacgtaaaacgacccgcgaaacataggccgccaggaaccacacacacaacactaagatacgccgaataaacggaccggaagcacgagaacactgcttacaggcgcggaaccaaagcggaaggaaaaaacaaggaaccaaacagaccgtatgaatcccacgaagcaagagacgcaaaaaaccagaacgacacactcaaacgcagaaccaccacaacaccggacaaaaaaacaaaacacg

SEQ ID NO: 608748 - DNA, 327 bp, Homo sapiens
gcaattctccccttccatcaccccaccctaccctggttcatttgcccccctagtaatgatcaaaaaaagaaagaataaaatgttcccccaatctgtgacttagaaaaacatgtggagggttttgccattttttgaattttgatcccccctgagtcctcattgaaatgttatttggggaaaaaagtttacctggggcctccttcccaaaaactttttttcaaatgaatttttagtcaaagactaaaacttgcctttggaaaagcctggataaatttggatggtaaaagacttgaggacccctaataaaagaatgggggactattggga

SEQ ID NO: 608749 - DNA, 1031 bp, Homo sapiens
  misc_feature (138)..(138): n is a, c, g, or t
  misc_feature (769)..(769): n is a, c, g, or t
tgagaaagtgttttttcttcgccctttgggttaaaaaagtttcacgtctggggtcgcctttgtgtgtgtgtgtagatgtgcgcgccttggcgtgatgtgcgcttgtgacatgtgtgtcgcacgtgtggtagaggggancatgtgcctcacccttctatacccttataaggggggcggcagggagtgtgagtgactgtgtggggagaggctttgggagagcaaaatatagcggaaagagagggctgtgacctgtgactcttctgcggtttctctcacagaagtgtgtgtaacaaaaacacaaaaatctctttaaacacaaattctcttgaacactctctctcacagagagtctctatattttttttacacacgtgaaaagtgtgtgtacaattctttatataagatatatttttttcacgagagagagtctgcggacaatgtgggtgtgtataagttctcacccatagcgtgagagatatgaggggcgggcgcgacattttttctgtggcatcatgtgttttaatgctgaccacacccatttgcgcacggttccccatataacagtgtgcgggggggggtctacatatcttataacaccgtgtgtggaccccgtgtgtgtgtctgtgcgcgcttataaacacccacagcgtcgtagagcgtggtgcgggggctctttatataaaaccacccttttgtgcaaatgtgcgcgctcttataaagtgtgccccccatgtgggggaaaaatacgtgcgcgcgggggataaatatnctcacctttccaccaaaaaaaaaacaatactttcaaacaagacgggagaaaacaacattatacgacgggcgctcaacacaccccgcacaaaaagacaacacaacaaccaaagaaaacacaacacaacgacaaaacaaacacaacgcggaacactcgacacaaccgcgagcaacaacgaccaccaaagcagaccgaagcgggggcggcgcgggccgactaacaagaaataaccacaccagagggcggggtgccggcccaatca

SEQ ID NO: 608750 - DNA, 114 bp, Homo sapiens
agcgcgggtcggcatccctacttcctgcattctcaagggccaccagcagacagaagatgcaaaggaatccaataccgacaaaggttctcactaagttcaatctacaaaactggc

SEQ ID NO: 608751 - DNA, 112 bp, Homo sapiens
atggtcatgtagtgaggacagaaagtgtctttgacaccatgtgctacttgtcccttcgtaattggcttctaacagaattcaaccagtatataattgataatgtgaatttttg

SEQ ID NO: 608752 - DNA, 730 bp, Homo sapiens
agatcctagctactcgggaagctgaagtgcgagaatcccttgaagctgagaggcggaggttgcagtgaggctggaacataccactctacgtccaacctgggtgaaggagcgatactccatcccatctgagaatagtatgaccatgaactttacatatgtaacgtcataaatgcataggtgaaattaaaagggatctagtgtaggacactggaggtgggctgtaaggctaacgctatcatcccgtacttttggaggggcagacagaagaacaccttgggccgggcagacggaaccaaactggtgagcaaatgagagttccagtcttacccgggaactggcgacataccccggaaaacattgtcgccggattgccccaagcggcttaaaacttgccaggttattggttgcggccgaaattggctttattgccaaattgcccttaagggaggcggttacaattaacgggccgggggttaacacgtctgactggaaaaaccctggggtacccacctaaatgcctttggaaaatccccttttgcaactgggggaaaaccaaagagccgaccgaaagcttttcaaaagttcgccccccaagtggaagggaatggaaggtaaaatttggtaaaatcccgtaaattttgggaaacacaccatttttaccaaaaggcgcatcgggcaaatacctttaaactaccgcgaagggtggttgtccacctggacaggccccctt

SEQ ID NO: 608753 - DNA, 120 bp, Homo sapiens
  misc_feature (37)..(37): n is a, c, g, or t
  misc_feature (39)..(39): n is a, c, g, or t
  misc_feature (109)..(109): n is a, c, g, or t
tggaagaattcgcggccgaggctggggaagcgtggtncncccatggacgacgggtttgtgagcctggactcgccctcctatgtcctgtacagggacagagcagaatggnctaatatagat

SEQ ID NO: 608754 - DNA, 107 bp, Homo sapiens
  misc_feature (5)..(5): n is a, c, g, or t
gtggntgtgggtaggcatctgtgtcaggctcaactcttcagagccgactcagacattttctacatcaaaagttccttcctggttatctccatagtgtcaatggccaa

SEQ ID NO: 608755 - DNA, 226 bp, Homo sapiens
  misc_feature (138)..(138): n is a, c, g, or t
ccagattacacaagcttttaattcccatgggtctcgtatagtatcctcaaatctgtataggacctttgactttaaacccttggggccttttaaactgctgtcacttttcactgaacctcttcttccgggagtcttacncttatttcctcatatatccccattcaaaaaaagtcatcattcatgtatgtacttcttaacctgtgacatgctgcaccccggggggacc

SEQ ID NO: 608756 - DNA, 866 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagctacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 608757 - DNA, 1835 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagagctgtggcttaccagctttccaggcccatccttgagtccggactccctccccaaccctgacggggcggctttggctatgtgtacatggtgcaagtgcacacgtgtgagcgcctgcacgtgagtatgcgtgtgtctggcttcacacacacacctgctgagcatgcctgcgtgccagtgtctctgtgaggtgggggcctgggagtacttgtgtgattgaatattgggctccagtttttcttaccttgctcttgtggtttaaaatggcacgtgccggccgggcgcggtggctcacgcctgtaatcccagcactttgggaggctgagcggggccgatcgcctgaactcaggagttcgagaccagcctggccaacatggtgaaaccccgtcactactgaaaatacaaaattttagccgggtgtggtggcacatacctgtagtcccagctacctgggaggctgagggagaagaatcacttgaacctgggaggtggaggctgcagtgagctgagatcgtaccactgcactccagcctgggcgacgaacggcgtgagactctctctaaataaataaataaataaaaatagaatgacacttgccactgggcaggtgtgccctggacgagggaccccagtgcccaggcctcacctaccacttcagcatttctttcccatcccccacccccatcccagagagctttgggggctgggggaggggccatgcaacagcctcacaggtgcttcctgctcaaacggctctcttgccactttattttccccagagactctgctcctatcctccccacctccccctaactgagcagcagtcctgagggccctgcctcccagtccctccttgttccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 608758 - DNA, 290 bp, Homo sapiens
  misc_feature (145)..(145): n is a, c, g, or t
  misc_feature (148)..(148): n is a, c, g, or t
  misc_feature (213)..(213): n is a, c, g, or t
acgctcagcggcgggagcggtgtcgccccaagacgatgcttgagaagaaccccgagttctacgccgcctgttccgctgccatcaagcaacgtccacgcgtacacagtgtggacagcttcgtgcacaccttcaaacgggtacacgnagncgaggtttttccttcaacaccaacggtttaccgggatattgaggccggtagattcgaactacggncccacgacttaccgcgtaaacccagcttgcgaattaaacgagccattcccatacccgcaccaataagacggggttgg

SEQ ID NO: 608759 - DNA, 399 bp, Homo sapiens
acgaccccccccttagggggccgaaagcccttaaacaatttagcctggcctgcctggtgacacggtgaccccccaaccttactgtgggttcagggcaggcggggacccccccctggtcaagtttacaaccccggcggtggaggctcccgtggaaaggaggccgttctgcctgctcatgttaggctgttgctcagcatgcaggggccctgttgcgggcacagcccaaggttgcctccccccggtgggtgccctggttctgcgggtgcagcacggaaaccccggctttttctgtacaggaccctggcccctttcaggtcaaaaaacaagcctggagggatgtctggctgcaaaaactatttttatcctgccactttttataaagggctgttttgccatgga

SEQ ID NO: 608760 - DNA, 721 bp, Homo sapiens
aggtgagcgggcatgtgggctgagtacatctcctcatcatccagttgtggggctgtggctgtgagtggcgcctgtccccgaggcccctgggatggcccaggctcccagcagcagcagctgtggcttaccagatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 608761 - DNA, 211 bp, Homo sapiens
ctcttttaatggggggaaggttttgtttagggggggggctcttttttgggggtaatttgggggtttctcctcctttgggggtaaaattggggtttccggttttcccttgttttttggttttgggtgggtttttgaaaaaaaaggaaaaaagggaaaggaaccttttttttttttggggggggtttttttgttttttgggggggttccccca

SEQ ID NO: 608762 - DNA, 1077 bp, Homo sapiens
tgaaatggagctgagatggctggagccagggtccagctagaggacaatgcccacgtggcatcttcggggccctggaggagggagtgggaggaggatgggaggggtgaggtgtcagttccccattggtctaggccaggtgttctgtggcggtccccacaccacacaacacacacacatctgcacctcaaccacagactacacttgctgaactggctcctggggccatgaggctgtcactgccactgctgctgctgctgctgggagcctgggccatcccagggggcctcggggacagggcgccactcacagccacagccccacaactggatgatgaggagatgtactcagcccacatgcccgctcacctgcgctgtgatgcctgcagctttccaggcccatccttgagtccggactccctccccaaccctgacggggcggctttggctatgtgtacatggtgcaagtgcacacgtgtgagcgcctgcacatgtggcaaaatctggcaaaggcagagaccaaacttcatacctcaaactctggggggcggcgggagctgagcgagttggtctacacggatgtcctggaccggagctgctcccggaactggcaggactacggagttcgagaagtggaccaagtgaaacgtctcacaggcccaggacttagcgaggggccagagccaagcatcagcgtgatggtcacagggggcccctggcctaccaggctctccaggacatgtttgcactacttgggggagtttggagaagaccagatctatgaagcccaccaacaaggccgaggggctctggaggcattgctatgtgggggaccccagggggcctgctcagagaaggtgtcagccacaagagaagagctctagtcctggactctaccctcctctgaaagaagctggggcttgctctgacggtctccactcccgtctgcaggcagccaggagggcaggaagcccttgctctgtgctgccatcctgcctccctcctccagcctcagggcactcgggcctgggtgggagtcaacgccttcccctctggactcaaataaaacccagtgacctca

SEQ ID NO: 608763 - DNA, 408 bp, Homo sapiens
ttaacccctaactgtctgcataatgaattatctggaaatactttgcaagcagagccacagctaaggacccgcgataatcagatccagctacctaagaacagctaatagagcacacccgtctatgtaacataatagtgggaagatttataggttcaggctactaatctaccgagcctgctgagagctgttttcccccaatagaatcttagttcaacttcacatttgcccacagaaccctctaaatccccttgttaatttaatctgtctctacatagaggaacagctctttggacactaggaaaaaaccttgtagagagagtaaaaaatttaacacccatagtaggcctaaaagcagccaccaattaagaaagcgttcaagctcaacacccactacctaaaaaatcccaa

SEQ ID NO: 608764 - DNA, 183 bp, Homo sapiens
ccttcagttttggggggcagcttggggaccccccccttcccccgtcagcctttccccttgcaggatcaggatcctcctcccaggcaatttaaaacctgaggacttcccaaagcaggaaatttgtttttaagcagaaacccccctcccctgcccttttcctgaaataaagaacagctttgcaga

SEQ ID NO: 608765 - DNA, 442 bp, Homo sapiens
cacagagaagcaagacttccgcatcgggggaggatagggcttgagggccgccagcccagactcgcttcacaaatgtgagaactatgacagtccagcgagtaaaggccaagagtaaactccaggtttccccagagtaacgctctcacattttaaaagttcctcacgttcccaccgctcttgtccctctttctgagagatacaggccaaaaggtgggctctccctgtttttttccttttaagcattttttttcaacttgaagtcactgttaggtttcgttgaggaccctaccaacttttaatatttgaaaatggggttggaatatatttgtgtctcatcaaatcagcaacagtactgtgtgtggaaatgccaccattacgggatccgcaacctgtgatttaatttttaaagtaaatcaatggattttggcaatacaaaaaaaaa

SEQ ID NO: 608766 - DNA, 971 bp, Homo sapiens
  misc_feature (329)..(329): n is a, c, g, or t
  misc_feature (656)..(656): n is a, c, g, or t
aatgagtgactaatgcctgtttactctcatctctcttgggcacgcgacgcaaatgacgcggtttcacagaggctcctcgaacgatccgcataccattgtgcgtctagagactgagtgcaatagctccagtctctattcaaaatgcatacacgcgtactcaatttagagtggcgtcagtggtggacaggacaactcatgtaattctccagacttagatcgggggaggaactgaaggctccggagacaatgcgacgtgacaccccgggggcaggcaagagacaggctaggcatggttgacgtcccacagtagtccatttggcacatcatgngaggatcacaatgcctctatgtttgttttaaccgcattgccaagaaggaatctcccggctcttctcatcgagcaagaggaattattcacattcgaagacctttttatcaccaatgttccttatgcacattttggttacacacttaggccatccggccaaatttttacgctacgagggccgaaccgtgagttacatcaacgatacaaagggggggcatttaaactttggaatatgaagatttacccttcactatgaaaaagtttcccgatgttgcaccggtgaattacggggttctttcaccgggctaagttcatcaacaggaaattntccgtcgcagctcattcaagggagaacaaggggctgaaatgtattttaaccaaccaactgatgggttttaaagtgaaaggaataaacgccgaagattgagaattatttaattagccagttttattggaaaggccccaacgtgatttttttactgcggaataactcttttaaacacacatgtgtctgttattctctccaaaagtgtggaatatactcttatttgtccatgcgaaagagagaacttattccaaaaaagaatggaatttaattgattagacgtagcttcaagggttgtgtgtaaccaactatgtaccg

SEQ ID NO: 608767 - DNA, 266 bp, Homo sapiens
tgagcggtaccggcatctagtcatctcaaaataaaaataaggcggtcgcggtccactctagtcactatcttccaacttaagttgactgaatattcttcatagcagtttcacaaagactgggattattcctcagtttccacctgtaagacaagaagggggcaggaggggccaagatagccgattagaaacaagatggctctcatagagaagaatgacaacagcaagcgaattcagcaccttcaactgaaatgtccaggttctcacac

SEQ ID NO: 608768 - DNA, 335 bp, Homo sapiens
tgctttccctttagagtcaggacagcttcctctatgtgtcagccgtgtgtgcaagatctcaggagtacagcccttcctgttctgatgggaccggtgttactgcacatcaggatttggggtaggggaaacgtattcatcccgtgtgagcatgttctgtaggatatctgaccgtgacacgtacggactccttgtgttcgttctggctttggcttgtatgtgctgcagcatggcatctaggcccctaacatgcatgtcgagtttcagcaagcctcatcagacattagaatttcttaggagttaccaccaaaaacataataaacattcatttttttgca

SEQ ID NO: 608769 - DNA, 912 bp, Homo sapiens
tccaaacaataccttttatttaatacttctctatacttggtaccaaatctttttgggcggaattaattttataataaacttttaaaatttacattcttcctctctcttttttttaaaaacctcaagggcctctttaattgctcaaaacttcttttttaaggctatattttaagagattataatcattttaacatctcccccccttgttgtagactcatatcaccggtgggattatccagggatatacacggtgtcgtgtacacacgctaaaaaccacagagacgggaggagagcgggacaatattacacagggcagttgagacatcttggggaccggagatgcgtttaccaaccaacacgcgcaggtaataaaagctctgaaaccctctcccgtgtggcccctataaggccaagacatggtcctttctggggaaagccctctttaactctcttacacccaagagtattcctccacaagccctcttacccttcttctcccctcctcttatacctccaccaaacaacaaacgccaaccagggctctggcctctatacggcttttactctatgagaggaacaatttgtgtgcgccgggggcaaatggatccaaaaccaaagatccctgtggggaacagaaccgagccgtgtgaacgcggttgacatttcattttcacccggatattggttcccgccccggggagccattctctcctcgttgaaaatttacattcccccctgtggccctttcctcctatcttcacttcgaccttcccacatataaagaagagagacgccccaatcaaattttttcaccagtggttaacatagacagtgatttaataatacgatgagggggtggccccgaggggcccggtcccgtaaaaaatcttttgcgcccaacaaaacaacaat

SEQ ID NO: 608770 - DNA, 440 bp, Homo sapiens
ggataacttgaggtcaggagttccagaccagcctgtccaatgtggtgaaaccccgtctctactaaaaatacaacaatcagccgggtgtggcagcacgcgcctgtagtcctggctactcgggaggctgaggcagaattgcttgaacccgggaggtggaggtcgcagtgagccgagatcgcaccactgcactccaacctgggtgacagagcaagactcggtctaaaaaaaaaaaaggctgggaaatttcagaaatataaagagggaaaatttgtgattcactaccccgaggaagaccaaagtgttaactggttattttcttccttggaaggaatactttcataccttcctttaatgagattgaactctgggccaggcatgggggtcagtactttgggaggagtaatcccagcactttgggagggtaaggcaggaggattgct

SEQ ID NO: 608771 - DNA, 488 bp, Homo sapiens
caaaaaattgggaaaagaaaattttttttttggtgaaggctttggtccccaaggggccccctaaattaaagtttggagggggtggcctttttttcaggcccctcccctttacccaggcgaaaattatcaagggggccatttggggctttgggttaaaaagtaaattaatataacccttgggttttattaaaaaagaaaaggttttcccctttgccaaaagattgccccaaaaccaaaaaactttaaaaacggggggtaagggccttcccccctttttggggcatattacccaaaagggttggtaaaaaaaaaataaaaataacccggttaaagaaacccttgttaacccattgccagggcccccggtaaaaaaccctttttttggttttttgggaaaaaagccaaaggggtttaaaccaaatcccctggaaaaggtgggatgggggattttggggaaaattttcccaaaaaagggcaaccaaaaccca

SEQ ID NO: 608772 - DNA, 283 bp, Homo sapiens
cgcatgtggcaccagggatattcaaagcctatccctcttctgatgtcgaagaaaggcagacagcatcttgggcagctcccagcagatcaggggcatctgcgtactatgcagcacagttacccagcctttgatgggtcttccatcgtttgtgctagctcttagcgtggacgcaccttgccttagctgctaacagtggttagacatcttgaaaagcttatgtaatcctagagacatatttttggctattgggatagccacacaagatgtacatatgtcaacacct

SEQ ID NO: 608773 - DNA, 106 bp, Homo sapiens
aactcccagttcacatatggagaatcagctcactgctctctagacacgtggcgttggtgaacggaccatgcttccgtagctctgacctgagcagcaggtaaagaca

SEQ ID NO: 608774 - DNA, 758 bp, Homo sapiens
  misc_feature (67)..(67): n is a, c, g, or t
caagcagtgagagatttatttcctataaagggtggtagcctgcagggttgtccttctgacaggctgngaagcatagcctccagccagaagccagaaacagactcttcaaggaggaggtaaagaaaatagcaatttatgctgactggaatggccaaatacatttatttaataagctccaggaggagtcatgaatatttatggaaggagaaatgcatgcatgcacaattgagtttctggcttcttcatgggtcccatgtacaaaaaatggcagtgttagcatgatcccaggtgcagttttcagccctctgacattaaaaggtgaaacagaggacatgaaaactcgctctgtgcatcctctgtacgctggccagaacctctctgttgtgggtggtctcttatcaggcaagaaaggagaggttgatatcggtagtggaggctttgaaagggctggtttctgttaaatccttagggaagaaagcctcatcatggttagcaaaggagtgggtttaacgatgtgtatgttaacccgatcatccatctagcaaagtgagaactcagtttgtgaaagttactctgtggtcccctcagcaaagagtggttctgtgcagtcagtgggagcttataatttaaatttggtatcaatggtatgggaaagaagtagtgtgttcatgggagtgatttggagaaacctgggtggggtaagggggggttttgggggtgtgttttgggcaagacgtgggaaaggtctttttcgaagg

SEQ ID NO: 608775 - DNA, 382 bp, Homo sapiens
tgtcctgggcgtactgtaggaatgaggaacctgactttactatataaatgaagctgcagtcagagaaccccattggatacttttttttttttggacaatggagtctggcatgatgcctaggctgaagtgcagtgccaagatttgggttcatggcaaccttatgcttcccaggtccaggtagattctcttttctaaacctcccaagtagctgggataacgggtatgcaccaccacggcgcgcggatacattttactacttataagtagcacgcgggcttgcacccatatggacgggtgggtctcgaattcttgacctcgagtgatcggcctgtccgggcctcccaaagtgcggggactacggggcatgagcacccgtgcccgg

SEQ ID NO: 608776 - DNA, 829 bp, Homo sapiens
gggaggagcactttttttccaaaaaggaacagaacgtctctactgggttcttttcctcctgatattcagcacttagagtagaacagaaactactcgtcctggccacattagccgtggattacgcaggtgctgcaagcctttgccactgtatattactttttaacagggcagaaactgcctgacaggtgaagactttggaccaggcaatacagctgggacaggtatcaattccaaaccagatgaaagacccaggctcagccactgtatcgcagaatcatggatgaattctcaagcactactttcttcaaagaaccatgtctcatttctcacaccagccagcagcccatggcaaagctcataggatgataccatggctctggatagctgatgtgcaccattatcacatacggatcctacgaggaacagcttaacatatccctgaggggtatatatctcaaggctaatctacctgatgagttggttgatcgcagttccatagggtggttcccatcggctacgaaaacgtggtacacatgccctaatttggcgaacaacccacccacactaataccaagcaaacacacactcccacgttccacgatcacatgccctggaaacacctggcgcattactaggggaaaattaggggacggacacttagttatttaacactcaaacgcaccagagcacacacgggtcgaccgcaacgcaatccctgcaacgccccacaatttatcaccgaacaccaaaacgtctcacccaaggcgtatttgacccccgttgcacattcaacgaccttactaaccaagcatcttttcgtgtaccataa

SEQ ID NO: 608777 - DNA, 329 bp, Homo sapiens
  misc_feature (96)..(96): n is a, c, g, or t
  misc_feature (185)..(185): n is a, c, g, or t
agcgctggcagtacggatctgaacaaccggaatggcaggtcatcacctgtggcacggcagcgtcggcgtcagtgccttatggttatggttttatgngattgggcaattgccgctggcaatggcggtgacgctgaattatatgtcgccaatctggatcgccgctattctgctggtgagcgcctggnggcgcaggcagcgcaatatggactggcgcctgatggctgcgattatcatggggtttggcggtgtggtcttgttgctgcggccaagcatacatgcagaccagtggatcggcggagtggttgttcagatccgttactgccagcgct

SEQ ID NO: 608778 - DNA, 170 bp, Homo sapiens
ggacccccaacgcggagccactgagtaccggatacaagtgcagtccctcacttgtaagtggtgcccttaaaggaaccaatgagtgcctgtacgccagatgcgtgaaatgcccgagaactttgccgttgaagctgctaactaccaagacactattggccgccagcaggatg

SEQ ID NO: 608779 - DNA, 314 bp, Homo sapiens
ggaaaacagtggatcctagactcattgcccagagagagactatgaacattccaaatgaaggagaaacagttgatcctagactcactgcccagaggaggactatgaacatcttagcaagtctcccctcagttgtcctagaatagatgtctctacgtagttgataaggacatacattcaagttttgcagctttttgttccactttacattttaggttgacgcttacactcccattcaggatcttcagagacatgtttagagacagaggatatccaaccacagtctgtttacctctcccctaattgctgactattgt

SEQ ID NO: 608780 - DNA, 449 bp, Homo sapiens
gacttgagagttgagggaacagcacatatggagtggagcagagctggatccaggtgccatgggcagttggagaagtgcacggcagagtagctgaggccatggcgctggtgccctgggtgtctgtccaccttacccttgactagttcaccttccacacattatgtagcctggcagtctccatcactgggcatgttcctaaaaatttccagtatgctctcctgtccatcagcagctctccattccctgttctgtgttctgtccctcagtcctggtgtccttccctcaattccaaggccagtcctacctctagacattttgatttgttatccaatacagttccttggcttatttacaccaggtgagtcaggtttcgttcgtctgattgtttgtactattttgtcacttacaacaaaaaaagccccgaaaaaccactggaaaaatacctggta

SEQ ID NO: 608781 - DNA, 100 bp, Homo sapiens
ctctagaggatcttaaagggagtcgggtagagaaaggcagcagtgctggtcaagcgggtcgcttggggggtgagcagtgcaggaggggcgaggggcggga

SEQ ID NO: 608782 - DNA, 252 bp, Homo sapiens
tagtagaaggccgtcatctcacacatgatatgtctacaaggagctaaacatgccagtggatcccagcaaaacacatggacaaacaacgtacaaataataatccgtgtatctagtcaaaaggaacatataatcaaaaggtcggatcgtagctaaggttggctagcattcttccctctttaatatcaacaaacatttaatgcacaggcccactcatgtgccaagccaatggtacatgatggtgaatacaacaaa

SEQ ID NO: 608783 - DNA, 312 bp, Homo sapiens
acctcataggttcgtcaggcctcggtagcacgcagccaggtaggatgcgggcggcgggagtggtggagggggtctattacagagtcggtgcttgactccactaacaagtgggttactgtattcgtttcttaaacctattccttcaagtctggaagcctgtggagggcctgtcacctaaaaggcaaggatcccttgtgagcaccaggcagacaaatgtcaaaccacgaccccaggggctgcactaggcgtcgggcccagaagcgcctggccatccagccccgagtctttcatgcctctcctgcgaacctatga

SEQ ID NO: 608784 - DNA, 133 bp, Homo sapiens
  misc_feature (4)..(4): n is a, c, g, or t
ctgntggagttgcaaccaacaggatctggtgattcgaccccagcttttctttccaggccctcatcaccttgatcctcgggtaacctatcctgctccagctgcactccagcctgggtgacagagactctgtctc

SEQ ID NO: 608785 - DNA, 169 bp, Homo sapiens
aataaagtataggcgatagaaattgaaccatggcgcaatagatatagtaccgcaaggaaaagatgaaaaaatcataacccagcataatatagcagggactaacccctataccttctgcataatgatttaactagaaatacctttgcaggagagccaagctaagaccccc

SEQ ID NO: 608786 - DNA, 156 bp, Homo sapiens
agactactgaatcatcattgatctaacacacaaagcaagcgaaaaaccttatgatagttaaatgtttgctggacggccctgtcagacggagatcacaaccgcgtgatcaattggatccaacctttatcacgagtatttagtatgaaaataatgtta

SEQ ID NO: 608787 - DNA, 310 bp, Homo sapiens
  misc_feature (1)..(1): n is a, c, g, or t
  misc_feature (261)..(261): n is a, c, g, or t
nggatacagtgtgacattttaatacatttacatattgtgtaatgatcaaattaggataattagcttatgtatcacttcaaaaacataatttctttgtgatgagaacattcaaaatcttctagtattttgaaatacataatgcaatattgttaaccacaatcaccctactgtgcaataggaacaccagagtttactcctcctttccatctgtaggcttcaggacccattgaccaatctctccccttcggcccccaccacccnccccccgctggtcaccactctcctcccctccccggcagggggcttggaa

SEQ ID NO: 608788 - DNA, 960 bp, Homo sapiens
gagcgggctccacgctgcggcagccccggcggccccaggtgcgcggcccccgccatcccggccccgccggcctgcgccatggatggagggccctctgcctgggcgggctgctccagccccgaggatgcgatggtgacggagctcttaacgccccgagggctccagtatcgcttcgtgagaacatcggcctgaagggcccccgtgaaagtacgaggaggacgagttccacgatcttcaaatgaagcgtacctgggcccggcggtaccccaagggaacccgtacctgcacgcgttcaacgcccgcagctggggcgccgacatgcaacggccaggtcaaggcgaagctcgcggggggcgacagcgacggcggggcagctcctcggggagtaccccgggatcccagagctcatctgcgctgcgacgacgtcgcgctcctgcatggaccctgcatgccgcccgcctgcaaccgtgcacattcctgtcctcgctgctaacccagaagcaccagaaacccagcgcggtagtatgccccatgtgagcgcctaggaggtccctgcgaaacggaagccataccacacaccaggattcgtccgcatgatcccagatatagaaatccaggaaagcagtgtggtagtaactacaaagtacactaattccggacagaagccaagcttcagcggcaatccttcttgcttccagcgaatccctggtgcacagttcccgactcgtaccccaggaacctagacggcatgccttcctgcttggatcctcttcagaacagatacaaaccccaaaagggctgaatatgccccaattgaaaaagagagggacccacaaaagtgctaatgtagtagtacataattatagcagccatgaaacctaaacacccaccccatgagaggatctcagaaatcagatcttcccatactatataaagccagaatgtccaacacccaacacc

SEQ ID NO: 608789 - DNA, 243 bp, Homo sapiens
gagtagctgggattacaggtgtgcaccactacaacttggctaattggtatacttttagtagagatggggtttcaccatattggccaggctggccttgatctcctgacctcaggtgatccgcccgcctcggcctgccaaagtgctggggttacaggcgtgagccaccgcacccggatgagaatatgtctatttattaagataaagatttgagttagatgtttgtaaaacttgttattaatgtca

SEQ ID NO: 608790 - DNA, 625 bp, Homo sapiens
  misc_feature (173)..(173): n is a, c, g, or t
  misc_feature (350)..(350): n is a, c, g, or t
  misc_feature (372)..(372): n is a, c, g, or t
aaaaaatatgtgaaaaaaacctgccaggaccagaaaaccccatacaaaaaaacttggagtgtttaaaagcattgttaaatcccattatgaaagatttttttgaccaatgcccctgaacccttataaattaatataaattcccaattcttgtttaatcccacaagtaaagattnttttgacaatgaacctgagacttatgtaataaacaagattccaaatcctgcggaacacattggtgttccaggctcttatcatcaggaagttctaggaaggcaaagacacccacaccaagacatgtgctcctacagaatcggaacacgcactctctgcttcacaaaatgcttctcaantaccactaggccacatgacatntgcagtcccaccatcccacttctcttatgttgccttacagtttttctaacaattaaaaattgcctgaaattagccaggcatggtgaagcgcagctctagtcccagctacttgggagggtgaggtgggaggatcgcttgagcccaggaaggttaaggctgcagtgagctgcgttcacgtcacggcactccagttgggtaacacagcgacaccctgtatctaaaaaataaaaattgccagccgggcacggtggct

SEQ ID NO: 608791 - DNA, 827 bp, Homo sapiens
cacttgatactatgaggtgctactattaagatgctcaggagatctgaaaattaagccaggccatatcgtgagtgaaatcccccatgtacgtttagaataccaagaatttattttagggtcagttggcttgtgatggggtcacacctgattgctttcaggaatatgtcgggagaggctgacggcgaggatgaaatcatttgaatgtcctgtggcagtgggtgatgggttgaatgtgagacgtcaatattcaagggtcaagtggatgtccatgccctgagtaagacatgtggtcgatgatcttcggatctgaataaaagtgtatataattaaattagaagacaagtagtttacaactaatgttaggatcaaggttggttctcaaaactcccatgacctcagtagtagaatcgcacccagcctcggcacatcctaaagttgctggcaattacagggtgtcagccaccaattccgcagcccaaatcctttacctttataattggagtgtggagttcatgtgtatgtttaactagtcagcgaatcatatgattgcatttcaactctactgtctagatgtctctttactatatgtcccatttgtttgtgtttgccccctgggtggtctccttctaggacttcctttgtgtgaatcaggaatcttctacggcattgcatctgttcatgaatttttgttatactttgaatgtgtgtggcgagggtggagtgttacatggttgctctggagcaagccttctcagtgaggtctatagagagaattaagccctaactccttaggcatcaatatttccggagtgaattactctcttctg

SEQ ID NO: 608792 - DNA, 187 bp, Homo sapiens
tgcaggtgactcgtaggaggacccgagtctcgataccgtggttgagacaggaataagaacaagcgagtgagcatcaataaagatgagctgaagtcgacgtcacaaagctgtcgaacaccgttcacgaattagtgtagcaacgagtaactaaggggcctctgcaactaggtggcagaatagagacaca

SEQ ID NO: 608793 - DNA, 334 bp, Homo sapiens
aggtcaataacgtgccagccaccgaggtcacacgattaaaccaagtcaatagaagccggcgtaaagagtgtattagatcaccccctccccaataacagctacaaactcaccatgagttgtcaaaaaactcccagtttgacacaaagagtcagactacgcaaagtggctttacacatatcatgacaccacacaatcagctacgcacccaaactgggcattagcatacccccactcatgcttcagcccataaacctaccaacagttcaaatcaaaccaaacactgctcgccaagtaacactcacgagcccaccagctttaaaactccaaaggcacc

SEQ ID NO: 608794 - DNA, 172 bp, Homo sapiens
  misc_feature (118)..(118): n is a, c, g, or t
aaacaaggaaagtcaccaacaaagagcacaaaaatgtggaaaatgtgccactatattgatataaaaaaggatacttgggttaggtctgagggttgaaacaagaaggcaaagtgtctcncttattcaacctacagctgggaacctagtgcatcgaggtgactaagaatttttt

SEQ ID NO: 608795 - DNA, 943 bp, Homo sapiens
caccattccaaataacttaatttgggtgcataatcgggcgccaagggcgccaaaccattaatgagatccgccagtatgtactggggccccaagatcaataattagccaaccccaggtgacaagtggctcctctggtaggcaggttactatcactggctctgctgccagtatttagatctggcgccagtatctaatcaagtgctcaggctttcctcatgagaagggtgcatggggtgcagccataagaacaagtgtagggttccctcaaataatcgcccttatctcgctgttctctcgcactgattccgaacttgtgtaatgttctggtacagtgattccatggtttgaagattaatttgtataggtgttcagtgtatctacacaaatttatcatccagcataatgaatttaaaaagtcacatttctctgttcatgcatgttaatgcatggtgagtcctatatttagttttataagcttttccctgttttttagtgtttgtgaagggtgtatcataggtcgtcaatgaattttatttcttgttggtcgataacgaaagtgtaggagtggcaactgttaatagaatttcagttcagttctgtcatgtcgagagtttatcagttcatgaaaccggatcgggctaatcgttcaaacttgaccaagccctttgctgccttggcctctccaggatgtctggcgcggctgcggttggaattggtccctgtggcggcggctgagtgcggaccggcgttttctgagccagggtggccgccacgtgggtccagttaaagtaacccgcgggggccgggttttgcgactgccctgggacatcgggtaccgccgtctggggggggccgcctccggtgggacggtctttcggccgcttccccgaggaggcgggggacaaagctcctgttggggggccccgcctttttctgaattccg

SEQ ID NO: 608796 - DNA, 318 bp, Homo sapiens
gacctagaggatcccctgacatgctgataacggaggattgtgcacatttattttccgaaaagctgtggcctttagatgggccattttttgtatatcgcccttttggggtccattctatgggggatgctggtcagttgccggctgagcgtaacgggtatgtgacctttgggtgcttatcccggtcgatccggattaaccataaggtgatccggatttgggctgcaattctggatgcgatgccaactgccagactgattattgacagcggtgactttaaagatcctcagatctgcgaggaaatggcggctcgctttgcag

SEQ ID NO: 608797 - DNA, 123 bp, Homo sapiens
gcatggtgcaggcggtactcctcacgggagcatccgctccagggccaaaacgagagcatgggcagctgaatagcagacactcttccttggtcatgccttcccggtaggtagcatcaacatagc

SEQ ID NO: 608798 - DNA, 140 bp, Homo sapiens
tctcagcccctccctgcactgagacgtcaaatggaaggggctcctggtcacagcatcacttttaaacttctggaacctgcccaccactgcccaaatctccatctgtagccctttccccatctgccattaaaggagctgtt

SEQ ID NO: 608799 - DNA, 2413 bp, Homo sapiens
  misc_feature (2199)..(2199): n is a, c, g, or t
attccgtcctgcgcggctgttctctgtgagccagcgcttcttttatctccggtccgccttctctcctacctaagtgcgtgccgacacccgatggaacgattcgactgagacatggacatgagccccctgaggcccccagcacactcatctttatcaggtttgttgaacatacacagtgccagcacacaagcattatccactatcacagtgtggcatcatgatagacaacatgcatgccacccagattcatcgtttctcaagaacacaggctcagcatatcagcgaggctcggctgcacgaggcatcgcaggtatgcaacatatgtactgaatgcacgtagtgacacactgacattaacagacaaaggacaaggagtcacaaagtttacacagattaaccaaacctgtgcccacacgtctatgaaacataatgtacgtggtaccaaggcaccaaacgggatattcccccatatgggcggggggcaatactgcaacgacttccaccacacacacatcggactggggctccattcacagcgggtctgaaacgtcaggtgggcttgcccgtgggaacaactgatgtctatacctaaacgatggggaacgcaagaccaccgtcacagaagcagacacagaaggggcagggacacggaaatgccacgcaagccgaaggacaagaaaatgaacagggcagtgctgaggaacagcacgagaggcacccggcaccaagacacgaaacgtagtccagggcaagacaggacggggagcactaggccccaccaggcaggcggtgggcgacgcgaaggggcatctcaacagagacaaacaggcaggaaacacagcatcgacaggagcgacaaggacaggcagcacggacacagcggaatgaatggacagcgggggcggagacagcagccaggacgagcaggcagagcacagccagggagcggaagacgcaacgacggagggagagagacgaaagagggaagaggacgcaacagggagcaccaagacagaacaaacagaagaaaggagcagacaagcgcagaagagcaggcgaccgcggagaaggcgtgcgcgaacggagagagcgcacggcagccgagacaagaaatacgagacccactccagcggagccacagcacacgcaggcaacgacagcggcaccgccccgcccccacgaggaggacgagcgaggagaccaaacagaaaggggaggcgcgagcacgacacagaagagggccagacgcagacagccgcggggacaggcgagggagaagacgagcgcggacggagagagcaagaggcaggagaacagagcggcgacacgcgcagggcagcagaagacagagaggacacgaaagaagacggcgagagaggagaagagagagacgggagagggagggagagacaaaaagaagaagagagcgaagcgggagcggagagggaaggcgcgacgagagagagacaaagaggaagacgggcaggaacggaacgaagcggagaaaagaaagcaaaagacgaagcgagagagaagagtgagccacgacagagacgacgagagcgagcgagacaacagacggacacgaccagagcagcgaagaagagaggacagcggagacagcaaacaacaaaagcagcagcaggacgaagaggccaacgaaccagagacagggaagaggctgacgacgagagaccagagcagaaggagaagacaccgaagaaccagaagaaggaagaagagatgcagcaggagacgaagaagaagcagacggaaaaggaaaagacacacgagcagaggcgagagaaagacggaggagagagggataagagcaaggaagccacacaccaggcgcacgaagggagcgcacgaaggcaagcaaagaagacaacggagaagacaaggacgagcgagcgcgggacacgcgcagaagcggagcgacgagcagacgagagagcaagagagcgagacaaaagcaacaagagagaacacagaaggagagagagaaagacgacgacagcaaagagagaatggacgcagagacagcagcagaagagacgcgaggcggaacaagacgcgccaggagcgagcaagcagagaagacgcgagagacacgggaagacaagaagtcagaaggaggagaccgcagagccagagcgacgcgagcaaacgagagaagagaggcacgaggaacagaangcgaacagcaagaggccgagatgagcagacaagagacgagcgagaagacgagcaccaacagacagaaggacgaaagaacagagcgagaggaggacagagcgggggtggagagaggcgaggcagagcgggcacgagaggagaggacaggcgaggggagcccagaaagagaagaggcagaggccagagaacagagcgagcaggagcacaggcagac

SEQ ID NO: 608800 - DNA, 174 bp, Homo sapiens
atctacaacaactcaaactggatatcaacagatagaaattactatgtctgaaataaatatgtactggctggaactagcagatttttagtttaatgagggagagtcttgctcttgttgcccaggcatgtagtacagatgatcgaccaacgggataccgacgctcgacattcgtaa

SEQ ID NO: 608801 - DNA, 116 bp, Homo sapiens
gttcagaacatgcagagtgtatctttttttaaattctccttccgtttctaaggtatgcgggattgtcactctgtaatatgacacactctttttccttgggaaacactgtatcagct

SEQ ID NO: 608802 - DNA, 303 bp, Homo sapiens
acgtccatctcgtcctcgatgctgatgctcttggactgctccgggtcactcaggatctgctccaccagctctgtcccgtggtccgacaagtgacgactgggagatgccctgcacgtcgtcttaatcggggtgctagtgtcgtgcggcggtacagaacggtccaggtgaggtggtcgacggcatcctgcttgtcctcgatggtcttggttacgatctcgtcattgaagtgctcatgcatacggtgctccaggtgtgattctactggcagtggctcatataagaacttcttgaagaactccttct

SEQ ID NO: 608803 - DNA, 196 bp, Homo sapiens
  misc_feature (12)..(12): n is a, c, g, or t
  misc_feature (114)..(114): n is a, c, g, or t
  misc_feature (118)..(118): n is a, c, g, or t
agttcggcacgnggcagttcttcatgctccagacgtacggccagcagcttcagaaggccatgctgcagctcctgaggacaaggacacctacagctggctcctgaaggacgtgantacnctagcgacaacgtatagttcctgaaggagcggcttgcacggctgacgcaggctcggcgccggcttgccagttccccgg

SEQ ID NO: 608804 - DNA, 138 bp, Homo sapiens
taagacgcgatccctgctgtagctatagtttgagatgcttgacttcctctctattgctgcttgttcactatacaaattgtctccgaacaatctacagtcaaaaagtgcactcccgattgcttcatagtctcgggctcc

SEQ ID NO: 608805 - DNA, 160 bp, Homo sapiens
ttggttggacgacggcctctccaatagcgcgaggcctttcggtcccgcgctttcaccctcaggtcgtacgcggtattaatccggctttcgccgggctatcccccactactgggcacgttccgatgcattactcacccgttcgccactcgccaaccaatat

SEQ ID NO: 608806 - DNA, 164 bp, Homo sapiens
cctagggagcctagcaactccagcctgattgctatgccctcaaaggcccattatatcacaggaatttaaagctactttagcggtcttcgaatcgaagcaaactctataaatgccataccctcctagatttgccaatcttccgttcttggcgaacttttgataaa

SEQ ID NO: 608807 - DNA, 352 bp, Homo sapiens
agtgcaatcggagaagtccctactgagcagagagcagcccaggctgggactagggcccacggtcaccccaagggtgtcttggttttccagacaccactcgaatgcctctccaaaggctggccttcttaaagctgggccagggcacaggccctaggagttgcaagctggctgggctgagtgctagagaccaagtgcatgtcagcccagcagaccactgccctcctggagttctcaggatgaaccattgtcgtcctgagtgtgcagagcttctcagggcacaaagccctcacctcctctgccttcccagaggtcataaggtgcccaggccattagttggatatacagaggcatg

SEQ ID NO: 608808 - DNA, 1194 bp, Homo sapiens
gtctcagaaaatgtgggttctgtgtgtggccatgcatttcatccaagcacaagcagggcacatgcttccccttgtcaacctttgcagcctgtttctgtcatgtagtttcaaccaagtgctcaccttctgcgtgtcaaactaaaggtcagactacttatggggcaaatgcagcacacatgcaaacatccagcgcacactgggcttgtcagcacaggcacacatctcaccttttcaacccaggcctgcatcttggcagtttgcagccccagcacaccaacacccaactccaacaactcctccatccattagggggcgtgggctcaaactccatcaatcccacgcgcccaacacacagcccccatccacggcacccacccccacacaaacaccccacgcccacccccacacagcaccaccacaaaccacccacccccaccccccccccacccccacaaccccccgcggcccaaaccgcgcccacaggcgcaccaaatctcccacgaccggccaccaaacggccacacgccgaaccctcaccgccccgcacccaagacacactcacaacccccacccccacacggccccaagcacacacccgtgaggcccccccccaagaaacaaacaaccccaggacctacaccaacacccacggcggcccaaaacagggcacaccgaaccaacaaccgcacacccgccacccggcccctcaacgcacaatgaggcgaacaacaacccacgaccacccacagctagcaaccatcaccaacccacccgcaccccaccccaccacggggccgcccccccccacctgcccccacacgcccgccccccaaccacgcccgtgacacaacgggccacacatggcaacacgtgccccccccctataccccccgcacctgtgcaacacaaacaaagcgcccaccacacaaccacccccgcaccaacaaggacggggcaacgctctagacaccgcacagatacaacaccctcgggggtcacacgacgggcaacgacccaacacgccgacgccgcctcacacccgtccccccgctaacgacggccacccaccgcgcggcggcgccgccagcgccaatcgacgacccagttggccatacccgacacccgtcgcgactcacaccaccacccggcgcccccaccacggacacacgctactaccaccagaccaacagcaac

SEQ ID NO: 608809 - DNA, 365 bp, Homo sapiens
atgatttgtgtctcatccgggttcccgcatccagtagaatctctatccattgtgagcggctacacaatgatgttgtctccactggtttcccacaagtaagagttcagatacagtctggagccccgtgatcacagtgttctgtgtgtcaataatggcacacccggtaatcctgtcaatgttacacagaaaaagaacctggggagtgccgggctatttatgcgagcaatctatgttttagatacaaatctccgctgtttatcccatgaacctcttgttatagtgtgaggcgtgagaaaaacaccagaggtggcgagccacacagggtgaggtttgtgcccatagcagtagcgcacaaggtatatatg

SEQ ID NO: 608810 - DNA, 300 bp, Homo sapiens
  misc_feature (73)..(73): n is a, c, g, or t
  misc_feature (91)..(91): n is a, c, g, or t
aaatttaaaaattagttccttagtcacattagccacatttaatgtgttctatagccacgtgtgactggtggcnaacatattggacaacacnggtaaaagatattttagtcatttcagaaagttgtatagccctgtctctacaaaacactaaaaaattacctgtgtgtagtggtacatacccgtagtcccagctactcagaggccaaggtaggaggatcgcttgagcctgggaagtcaaggctcctgtgagccatgatcgtgccactgaactccagcctgggcaacagagtgagaccctgt

SEQ ID NO: 608811 - DNA, 541 bp, Homo sapiens
  misc_feature (71)..(71): n is a, c, g, or t
  misc_feature (83)..(83): n is a, c, g, or t
  misc_feature (108)..(109): n is a, c, g, or t
ggcggccaaacacgagtcctccacacggcaaatacggcgacgcgcacaggtgtcggcggccttgatccgcngggccgcacatnggccagctcgccaaactcacccaanngggcctcgatggcgtcatgcagatcaatccagcgacgacgagccagtggactgaggctcaacgttgaaagcaacagagcaccgtcagccgaaagtgaccaaggctgatgaaaaagagccgaaaggcggtggtgatatcgcttcagagcgggatcgttggacaagtcgacagcctggtagctgcgctgtccggccaggctggcgggccaggtcatcaggcagcgaccgaggatcccttgcccctgcagcaacgggtcactgagtaattgcatggccaagtacggttgcagcatcaggtgcaagctcaggcgccggtcataagcccgtaagctttccccggccatggggcgcgcacgatcaattggactgccatcccagagtgaggacaaggtcgtgaccgctttcaaacggttatcccgactcaggtggtgtg

SEQ ID NO: 608812 - DNA, 1084 bp, Homo sapiens
gcaataaattgcggcgagaaggaagcgaggagggcatgtacgtgctgaggtgtgacctgtaccgactttgacaacgatcctcatgaccgtcgaccgtgcttagagaagtctgagcaggtgcagggtgcccaggaagcagttcaagaactttcagatctgaggtgcagaatgggccgcatacaggtctggcatcggttctggaacctggaggcttccccgagcttgggagaactacatgagccacctcaagaagcagatcctgcgcacggataacatcagcttcatgctaaaacgctgactgccagcccaagccccgagaaatctccaacctgctggtggctactaagaaagcccaggagtggcaggccgtcgtaccccgatgagccagctgagatatcgatcggatcctcaagaaggatctggtgcagggcgagcaccttggcgagaggcacgagaacaaacatctattctgggaccctgatggattacaaggatgacgaaggaacatctgaagagaagaagataacagtgatcgtcaaagtcttagacccgagaccacaggcatatttccctggacttacccagaggcagccagcatgatgagaacaggtctcccaaaaacacatcgagtacctcatatggagtcatggagtccagacgcacagaggacaatatcatggagggaagcagtaaagtggaacaaggaggaccaaatgaaatacccaaccagtgcaaccaggcaaaagacgaagaccagtacccaaacaccatgagaaaacacaccgaaaggccaaaaacaggcatggccacaagtgacccccgaagacacaactcggacaggagtaacacaagcaccgcgaaggaccagagggcgaaaaatggccagagaacacacacacaaaaagacccacccacataggacaccagaagacaggagacaataagagaaacagcaacaaacagagggcccacatgagaagacaagagcgcacagaagaacccacgcgagaagcacccccaatcagaagagagagtcagcaaagagacgactagcacgtgacagagagagagcacaacacaacag

SEQ ID NO: 608813 - DNA, 330 bp, Homo sapiens
aaataggttcatgaagcccttaagtggtggttttgtccgtcaaacgtttaaaactttaacattttcaaagtgccccggctgtgtacaaagacacatgtaattggggttgtaccggttgtttttttgtttgaacccttgaaaggggtttattttaacgttttttaattttaaaattttaaaattttgtttaacaaaagcttgttttaaggtactgttttcatttccttaccgaattgtttttaaaagttcatttgttgaaaaataaggatcctttttaattccaccgcatttgtactgttcccttttaatttactggaaattttaaaggga

SEQ ID NO: 608814 - DNA, 260 bp, Homo sapiens
ggcagatcccacattgtatgatataacatatctattaaaaacatgcctaatctggccaggcgtggtggctcactcctataattctagcactttgggaggctgaggcaggcagatcacttgaggtcaggagtttgagaccagcctggccaacatggcgaaactccatctctactaaaaatataaaaattagccgggtgtggtggcgggcgcctgtagtccgagctacttgggaagctgaggcaggagaaacgcttgaaccc

SEQ ID NO: 608815 - DNA, 106 bp, Homo sapiens
acatgaccatccgcatccgcctttattgacaatgagaagatggagtcccggacgcatctatccctctttggcccttacaggtttgccacgagagtgagacgccttc

SEQ ID NO: 608816 - DNA, 375 bp, Homo sapiens
ggccaagggggggggttcccctaaggtcgggggttcaagaccattttggccaaggtggttaacccccgtttttactaaaaaaacaaaaattacctgggggggggggggggcccctgaagtcccagcaactggggggggtggggcaggagaatcctttaaatccaggaggggggggttccagtaaattaaaattgccccccggcattccagcctgggggcagagggaaaccccgtttcaaaaacaaccaccaccaataccaccaccaaaagcaagggccaaacaaagcccccttccctttttaccccccccggatttttttccattaacatttaaagtccctggggcccccgggcctttttgtggctttgatttta

SEQ ID NO: 608817 - DNA, 236 bp, Homo sapiens
  misc_feature (137)..(137): n is a, c, g, or t
  misc_feature (140)..(140): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (169)..(169): n is a, c, g, or t
  misc_feature (176)..(176): n is a, c, g, or t
  misc_feature (181)..(181): n is a, c, g, or t
cacaccatgccctttgtcaggttaccatgtacagagattacttggagagcctcatgccgtctctaccttcgcacactggtcaagtatctgctgagcttcttcgccgcaaggatgcagaaataggctgagggtccatnggnaggaagacacaatnaggnantaggaggtnggggagnaaagnagacagactttcaaaattggattaggcacttgggagagatcaatttcccacatca

SEQ ID NO: 608818 - DNA, 193 bp, Homo sapiens
tggcccgagtaattttttaagttgaacaaaaatttgtccttttttttttcaggttatttgagttcattggaggggggggttgggcaaaaaagttagggattttttgccatttttttttttagatcaggggaaatgtttaagttaaaaaaatttggggggttttttgttttgttttgttttgttttttttggga

SEQ ID NO: 608819 - DNA, 453 bp, Homo sapiens
  misc_feature (36)..(36): n is a, c, g, or t
  misc_feature (331)..(331): n is a, c, g, or t
  misc_feature (351)..(351): n is a, c, g, or t
  misc_feature (378)..(378): n is a, c, g, or t
  misc_feature (398)..(398): n is a, c, g, or t
  misc_feature (430)..(430): n is a, c, g, or t
aaaacagctaatgtttgttggcacatctgcagacanctattctaaatgcttaattttaatcatcacaacaaccctatgaggtagatattgttatccctgtttttcagatgaggaagccgaggcagagagaacttaagttgctggcccaaggacaaacagctagtaggacagcagtcaagggcagcgtggcttccatgggtgatgtgcttgggtcagagatctggaatatatagggacttaggattttgttaggactatttgaggctgttaggacttcattttaggaccaattgggtaccccaggatattttttaggtaggattaaatttcntaggggttaggtagggaccntaggacccacatgttttattaaggctngatatcccgtttgatggggnaggaaatggggttttttcccagtttttttttnccgggtcccccttttcccaaccc

SEQ ID NO: 608820 - DNA, 102 bp, Homo sapiens
cttagaggatccctatcttctcccatcaggtcagagcaagaaatatggcaggattattccttagaatataacactaaattttctttagagttatccaagatg

SEQ ID NO: 608821 - DNA, 904 bp, Homo sapiens
  misc_feature (81)..(81): n is a, c, g, or t
  misc_feature (91)..(91): n is a, c, g, or t
  misc_feature (132)..(132): n is a, c, g, or t
  misc_feature (137)..(137): n is a, c, g, or t
  misc_feature (164)..(164): n is a, c, g, or t
  misc_feature (168)..(168): n is a, c, g, or t
  misc_feature (172)..(172): n is a, c, g, or t
  misc_feature (189)..(189): n is a, c, g, or t
  misc_feature (204)..(204): n is a, c, g, or t
  misc_feature (206)..(206): n is a, c, g, or t
  misc_feature (217)..(217): n is a, c, g, or t
  misc_feature (219)..(219): n is a, c, g, or t
  misc_feature (227)..(227): n is a, c, g, or t
  misc_feature (236)..(236): n is a, c, g, or t
  misc_feature (249)..(249): n is a, c, g, or t
  misc_feature (260)..(260): n is a, c, g, or t
  misc_feature (262)..(262): n is a, c, g, or t
  misc_feature (276)..(276): n is a, c, g, or t
  misc_feature (280)..(280): n is a, c, g, or t
  misc_feature (291)..(291): n is a, c, g, or t
  misc_feature (302)..(302): n is a, c, g, or t
  misc_feature (307)..(307): n is a, c, g, or t
  misc_feature (311)..(311): n is a, c, g, or t
  misc_feature (313)..(313): n is a, c, g, or t
  misc_feature (323)..(323): n is a, c, g, or t
  misc_feature (325)..(325): n is a, c, g, or t
  misc_feature (330)..(330): n is a, c, g, or t
  misc_feature (333)..(333): n is a, c, g, or t
  misc_feature (337)..(337): n is a, c, g, or t
  misc_feature (341)..(341): n is a, c, g, or t
  misc_feature (349)..(349): n is a, c, g, or t
  misc_feature (382)..(382): n is a, c, g, or t
  misc_feature (386)..(386): n is a, c, g, or t
  misc_feature (417)..(417): n is a, c, g, or t
  misc_feature (422)..(422): n is a, c, g, or t
  misc_feature (425)..(425): n is a, c, g, or t
  misc_feature (435)..(435): n is a, c, g, or t
  misc_feature (438)..(438): n is a, c, g, or t
  misc_feature (441)..(441): n is a, c, g, or t
  misc_feature (446)..(449): n is a, c, g, or t
  misc_feature (459)..(459): n is a, c, g, or t
  misc_feature (461)..(463): n is a, c, g, or t
  misc_feature (469)..(469): n is a, c, g, or t
  misc_feature (480)..(480): n is a, c, g, or t
  misc_feature (486)..(486): n is a, c, g, or t
  misc_feature (488)..(488): n is a, c, g, or t
  misc_feature (493)..(493): n is a, c, g, or t
  misc_feature (496)..(496): n is a, c, g, or t
  misc_feature (525)..(525): n is a, c, g, or t
  misc_feature (536)..(536): n is a, c, g, or t
  misc_feature (549)..(549): n is a, c, g, or t
  misc_feature (553)..(553): n is a, c, g, or t
  misc_feature (559)..(559): n is a, c, g, or t
  misc_feature (563)..(563): n is a, c, g, or t
  misc_feature (567)..(567): n is a, c, g, or t
  misc_feature (667)..(667): n is a, c, g, or t
  misc_feature (824)..(824): n is a, c, g, or t
  misc_feature (883)..(883): n is a, c, g, or t
gaagttgggagttaggaaggtgaacttttctatctgaattctccgggtccctgaagccctccttgccgctctccatctgtnttgcactgcnagctgggtccctgctggggctctgggacttccacttctcantccanataggaacccagcttccactgaatcantgcnaaanctgcctcccagcctggntgggaagggggaaancnactggtaggancnagccccanatggaggtnaggagccactgcnaacctcccgtntncaggtgctgatgtnggcntgcagagtgtngggctggtgcnttcanccanancccttcaatnanataangtntgtntatntacatgtntgtgtgtgtgtgtgtgtggcactctcaaaagtntttnaaagggtgcagatgtaaggctcagtgttggnaaaanacnaagggctatnatnatnaaaannnnaagctttatntnnnccttanaagtgggaaanccagancnctgtnganttcctaccacaacccagtaggggcctctntctcccatggnctggacagcattnaaangaagcnattnagcncccacagttgaacacccacagggctttaggtgtccattccctctcaactgcttagaggcagctttgagcacagccttcctggaaggaagctaggcaaganctgccacacagcgaaggttggggtttacaagggtgacattggtacccccttggccaagagtaaagaagaacaagtctaagccttgcttttatcttagttgtctgggtggtagcagaactcatcagctccttatcctcagtctgttcctctataaaanatgagagatgttcactgactttgtgcagtgagaaggcagcaagtactcacggctggtgntgtgggactcacagcttctaa

SEQ ID NO: 608822 - DNA, 262 bp, Homo sapiens
gcggcaagcccgcttgctcctcagtcctagcaacatcaaagactaggttcctggaatcctgtctgctgctgtctacctaagataacactagaatccacttcagtgtagcacctgggtcagttgtccattaatgctagtcctcaggatttaaaaaataatcttaactcaaagtccaatgcataaacattaagttggtaattactcttgatcttgaattacttccgttacgacagtccttcacatttttcaaactaagctacta

SEQ ID NO: 608823 - DNA, 1232 bp, Homo sapiens
  misc_feature (154)..(154): n is a, c, g, or t
gggggaaacaaatgccgaggaaaattcccccgggtgggccttttgtggcccaggcactgggggcgggtggtcggaaaaatatgtgctgccaagacccaaacatgggtgggggaaagtaacaaaggtagaaatggaacacaagacgtcccctgcntgaggttaaggggtttcccaaacctaactgaagggaaattcccaacgcctcaggtgagaaaaagcctaataatgaaacccccccctataataaggtaggcgtggtaaacacacaggggggtaacccctcccaaaattaggggaatagggcctctgtgtccctaatggaaactatttgtgccaatggggcaagacgacacactttttgccacacaacagttgggggctcacaaaaagggttgtgaaataatcgaaactccaataacgtgggtggacctccatcggcatgatgcgacaatgagggttataacacacaaattgtggtttactcaaagtggcactacacgacactaactacggagatttcttaacgtcacgtccactgagaaaagcgacactgagaaattctctggaacacacacgggcgtacaggcactggaaatgggccccagaggggtccacatataatggcgtggaaggtgagaactatacgcgcacggtcaccaacacacacagggcaaacaaaccctcggctgtgagagatatccggtgacatacacaaggctaacctacgatagacccgtcagagttttcacgaagacagacacacgaagaagtggagtgtggtaacgtgtaccacggggactagggggtccggaaacggtgtgagacgttagtggctttagaatgggtaacggaagtttcttgtttaagggtgactggaaaggatggtggacggggtgcacaggcagctgtagatgtggaacttcagcgcctgctctcaactgataacaacgttatcaacatgccttaaagacggcaatatatgtctactgcctataattcttaatatcgcaacgaagtaatacaaccttgtagtaaaccgtggatttaagcggtgtagaaatgtctaacgtttgtaaaaccaagcgttatcggaaattttcaaatcgtgcacagaaatagaaagtgaactcccaggtccctctaaactcactttaaggcatcagcttgtgttcacctatcccctcgccctcctacccccggtgaattaattaatcagaaccaggtccagcctg

SEQ ID NO: 608824 - DNA, 97 bp, Homo sapiens
tggacctggtttttagcccttgggcactgcaccctgtttaacatttcaccccactttggacaggggtttttacccattttttttacctcacacccaa

SEQ ID NO: 608825 - DNA, 216 bp, Homo sapiens
agcaggctctaggcgaaggctatacccttatgttagaatcgttcctgataatacattagtgtgcccccatgtgtgaactttccctcttacatattggtgttgccattgttgtcctgcatataccaggaattccaatccaaatttggagttcccacagagccaccacgccacgccacattgttttcagtgtgtagagcctcatttgggcttatcgag

SEQ ID NO: 608826 - DNA, 392 bp, Homo sapiens
cttgcaataaatcttatattacacgattgtctactggtgctgtcatctgtggttaatccaatactaacacagaaggtgtaggacccagagtggtggctcatgcctgtaatcccagcacttcgtgagctatggggttgggcggatcacgctgaggtcgggaggtcaagactagcctggccacacatggtgaatagcccgtctctactgaaaatacaaaaatgagccgggcatgcgcctgtagttcccagctagctgggaggctgaggcgggagaattcagttgaacccgggagacaaaagttgcagtgagctgagatcatgccattgcattgaagcctgggcaacacacagagactctgtctcaaaaaaacaaaaaaaagaatgcgttggaga

SEQ ID NO: 608827 - DNA, 324 bp, Homo sapiens
gttaaatgggtgtcttagtccattcaaactgctataaaaatataccttagattggataattcatgaacaaaatttatttatcttggctgggaagttcaagatcaaggccccagcagattcagtgtctggagagggcccaccctgctccacagatggtgccttgttgctgtgctctcacatggaagaaggggcaaggcaattcctttcaacctcttttataaggccactaatcccatttatgaaggcaaagatctcaaaacttaatcattttccaatgtgctgcccccctcttaatactcaccaataaattctacttcctgtcca

SEQ ID NO: 608828 - DNA, 256 bp, Homo sapiens
aaatgttgctgctgagtcactcgggattttgcagtctcaaaattcatctggtagcctggccagccagccctcgtaacctagcaccagagcacccctgctggaatgcttgggtatatatcctgatcattgtccctccccctgtgctctcaggtgatatatgatttgactatttctttacctcctgctttagcctaatttgtattttagtaagtcctctttactacctgattagttggatgtgagctgagctacagcg

SEQ ID NO: 608829 - DNA, 735 bp, Homo sapiens
  misc_feature (75)..(77): n is a, c, g, or t
  misc_feature (79)..(79): n is a, c, g, or t
  misc_feature (82)..(83): n is a, c, g, or t
  misc_feature (140)..(140): n is a, c, g, or t
taggacgttagaaaacgcccgagcaagcacgtggaactgcgcccagcaacacaggaagaggaggcgcccctatcnnngngcnngctgtgaggagtagacagcgggtggacctgtggtttgcaacacaggaagaggcggcngccctatcactgtgctggttctgtgaggagtagacagcgggtggacctgtggtttgcaacacaggaagaggcggcggccctatcactgtgctggttctgtgaggagtagacagcgggtggacctgtggtttgcaacacaggaagaggcggcggccctatcactgtgctggttctgtgaggagtagacagcgggtggacctgtggtttgcaacacaggaagagactatgacataacacattggaaataaatgccagaggcccttaagtccaggccaggaacaggacagacgagaggcagggtgcaggattccttactgtgccactgaaagtggatccacagcttccccacctcactcagcagccgctgcccagctccactgtctcttccccacacccgaatctcatcaccaggaagtcccccggccgccactgtcgaagcgtatccagccctgaactcttctcaccacctctgcggccaccaccccagctgggcctcccgcctcctggccagatctctgaacagcccccaactcgttccctcctgaccctcctgtaaggtcaagcctcacccgagaccccgaacgacgggtacgag

SEQ ID NO: 608830 - DNA, 1257 bp, Homo sapiens
  misc_feature (683)..(683): n is a, c, g, or t
gggcgccgcgcggttgaggtttgtctagttccacgctcgtagccatgccgttcaatggtccgcgtgcgacgtctggtgcaggtactatcggacgccatgattgatatgcagacatgcgtgttggcggcatgtgcaaacgctggctaatttggtctcatccaaaggtcgacaccgggacggccccgtggcacgtatcgcattcgatccggggcaccgctaaagtcacaaggcttgcttggatcgcagttcgtgcttctcaggactcggaagcgattttgcatggatgtaacacacatccagatgtccggtgattactggagtcgcgtgagatcatcgctgcgactcaagactattagtcgctagtccagcccaagctcgcatactcacaaatggcaccataggattgcgtccgtaattcaccaagatatactatgtgggatgatgggccgttctcgaaggcacagggaggatgcgccaaacgcacaattcgccttcgaattgcaaggctgaattggaaccccggcactccatagaccttgcgatagagctcgaacccacgtacggatccagacgtagtcggaagtttccgagataatagctttttggaagagtcctttgagattgaccccggggaccctcagtgatttacgctagggacacaattccctaagcgcgcagtgtgnaggtcgcctaactcgtgctgtaacgttcccatacataggtcccaacctatggctaacttggagttcagaatacgaagtctaattgtgtgacaagtcggtggatatgttacagagagcgttttcaacacagacaacgtagaatatgaccccccagaatacatactcgcgaggggggggcctttaactgtgagctgcgttcagcagcagtcgccgaaccgtgcccacatcatacccttggcggatacctatgaggaaccacgttgggaccataggagttcccgggtgacgaaatcaccgttgggaagatctggaaccctttagccgacattcccaaagattggagtcatgcacacttcgcacgttccaaccattggatggtcgggaagaggcgcaattaccatatagagccgtaggttcagatctcccacaccccaaataagagggaccgggaaaaggaccggggggacaaagaattcctgtttgcgccggaccaggaaagaccaagctccaaagaggggggtatacgaccaccggccgtttgttttacaataaagagaaatgtggggcagcgctt

SEQ ID NO: 608831 - DNA, 435 bp, Homo sapiens
ggaggcaacagtgcggggagctgctgagtcgggtgctccactgctggtgtgttaggggcttcgtgtagtttgttcctctggctggcctggcatagttggagcatgtggcaaaggatcatttgggggtggccatagttccctctgagagaaaaggggtcttggacgagggggtcattgccagggtctggctcagtcttaggactttctttccgagggccagtgttaggagctttacagattgaagcattctgatacaaagccataaaggcttcactgtatggtatttctgaccatttaccctgccttttgcaaagtaagtataattgtaggttagtattacgatgtagccttcaatggtctggccattgcacctgactgtctagctgatattgtggccaagtagtattaaaataaaaaactcaagcatttttttca

SEQ ID NO: 608832 - DNA, 553 bp, Homo sapiens
  misc_feature (2)..(2): n is a, c, g, or t
  misc_feature (92)..(92): n is a, c, g, or t
tnaaccacaaagtcaaaagagcaagaaggccatacatatgggtaaaggatcaatcaacaagaagagctaactatcctaaatatatatgcacnccatacatgagcacccagattcaaaaagcaagtccttagagacctacaaagagacttagactcccacacaataataatgggaggctttaacaccccactgtcaacattagacagatcaacaagacagaaagttaacaagtatatacaggacagacgagaggcagggtgcaggattccttactgtgccactgaaagtggatccacagcttccccacctcactcagcagccgctgcccagctccactgtctcttccccacacccgaatctcatcaccaggaagtcccccggccgccactgtcgaagcgtatccagccctgaactcttctcaccacctctgcggccaccaccccagctgggcctcccgcctcctggccagatctctgaacagcccccaactcgttccctcctgaccctcctgtaaggtcaagcctcacccgagaccccgaacgacgggtacgag

SEQ ID NO: 608833 - DNA, 951 bp, Homo sapiens
  misc_feature (951)..(951): n is a, c, g, or t
ttggtgtctggggacaactatcctccccccaaccctggatatcctgggggtgggccccagccaccatgcccccctatgctcagcactacaactaacactgagggcccacttacccaacatgccacactaaccagaacacacaacgagtacgagacaaggaaagtgctacacaacgaaagaaacaccagagagcagaaagacaaggcacagagaagaacaaccgaagagaaagcagaagcaaaaaggaagagagacaacaaacacaccacaaaagaacagaacaaagaagaacacgaaacagcacagacaagaagaaaaaaaaggaaaggagaaagaaaagagaaacaggaaagagagcagagaacgagcagaaagaacagaggaaaaagaagaaaccggcgaaagcggacagcaagccgacggagacgagagaccaccgacaacagagacagaaagcaacagaaccagaaagcacacagaagaaagaccagcgtagagagacaaccgaacgaaagacgaagggaaggaagaaccagcgcacgagacaggacagagacagacagcagacagcggagacaaagacagcaaaaacaacacggagcgaaagcgcaaaagaggaacaaggcagagggaaagccagaaacaggaagaagacagcgcaggcagagaaagacgagcaagcacagcgacacagcagcagccaagacaggagagccacagacgcgcaccagcgcgccacacagacacaaaagagagcaaacgagacaagcacagagaaacgagagagcaacagaccagcgaagagcaggcaagccagacaacaacgaagagggaagaccacccaagcagacaaaacagcagaagagcagcagacaagagagacaaacaaggagcaacagcaccaaggcggcagaagcaagacacacgacgacagaccgccagcaaacgcgn

SEQ ID NO: 608834 - DNA, 245 bp, Homo sapiens
aggatcctttccagctactcagtgaggctcatcgaagggatagaggtgggaggagctcacaggttggccatgctgaagggtgggccgaaggctgtgggtgagcactgtctgagggtgagcacttggctgtggtccggcagcaggcccaggaggccgggcctccttcttagcctgagggacgttgccatgtgaacatttggctccccaagcctttccggtcccacggctccacagagtgtgttggg

SEQ ID NO: 608835 - DNA, 587 bp, Homo sapiens
  misc_feature (75)..(77): n is a, c, g, or t
  misc_feature (79)..(79): n is a, c, g, or t
  misc_feature (82)..(83): n is a, c, g, or t
  misc_feature (140)..(140): n is a, c, g, or t
taggacgttagaaaacgcccgagcaagcacgtggaactgcgcccagcaacacaggaagaggaggcgcccctatcnnngngcnngctgtgaggagtagacagcgggtggacctgtggtttgcaacacaggaagaggcggcngccctatcactgtgctggttctgtgaggagtagacagcgagcgggtggacctgtggtttgcaacacaggaagagactatgacataacacattggaaataaatgccagaggcccttaagtccaggccaggaacaggacagacgagaggcagggtgcaggattccttactgtgccactgaaagtggatccacagcttccccacctcactcagcagccgctgcccagctccactgtctcttccccacacccgaatctcatcaccaggaagtcccccggccgccactgtcgaagcgtatccagccctgaactcttctcaccacctctgcggccaccaccccagctgggcctcccgcctcctggccagatctctgaacagcccccaactcgttccctcctgaccctcctgtaaggtcaagcctcacccgagaccccgaacgacgggtacgag

SEQ ID NO: 608836 - DNA, 582 bp, Homo sapiens
cagcccaagactgggcgaaggggacaccgaggtggaaatggcaccctgtggtagccagcggcggccctatcactgtgctggttctgtgaggagtagacagcgggtggacctgtggtttgcaacacaggaagaggcggcggccctatcactgtgctggttctgtgaggagtagacagcgggtggacctgtggtttgcaacacaggaagagactatgacataacacattggaaataaatgccagaggcccttaagtccaggccaggaacaggacagacgagaggcagggtgcaggattccttactgtgccactgaaagtggatccacagcttccccacctcactcagcagccgctgcccagctccactgtctcttccccacacccgaatctcatcaccaggaagtcccccggccgccactgtcgaagcgtatccagccctgaactcttctcaccacctctgcggccaccaccccagctgggcctcccgcctcctggccagatctctgaacagcccccaactcgttccctcctgaccctcctgtaaggtcaagcctcacccgagaccccgaacgacgggtacgag

SEQ ID NO: 608837 - DNA, 390 bp, Homo sapiens
ggtggccgattagtctttgaaaagttggtccattatcagatcgtctctgtaaatattttcctctagtctgtggcttttctgtgttcttttcttttctttctttttttagatggagtctcactctgttgcccaggctggagtgccatggtgcgatctcagcttgctgcagcctccgcctcccgggttcaagcgattctcctgcctcagcctcccaagtagctgggattacaggcacccaccaccatgtccagctaattctggtatttttagtagagatggtgttatgccatgttggccaggctggtctccaacccctgacaacaggtgattcgcctgtcttggcctcccaaagtgctgggattacagatgtcggccactgcacccagccct

SEQ ID NO: 608838 - DNA, 287 bp, Homo sapiens
tgtgatggcagggaagaatcacacgcctgtccaatatttgaacacattccataaacgcaactataaaatcaaagaactcagagagcttcagtgcggagttcatcatatattcgcatgatgtacacacattattggacaagtctgtacattaaaccccaaaagaacatcagttttgtggacaatggtttcctctgctgtagagaaacgtatgcatatatgatcagtaagcagctcacatctttctgaatgtcaaggtctacaggattgtctctgtccacctttagtca

SEQ ID NO: 608839 - DNA, 132 bp, Homo sapiens
aaatttactgggctgatctatgtaatcacagaggcagtttgtcagacaaggggggaggtttatttctgggtctcttcctccttggataaggtcttgatgatctcctccttcttggctgggaggcgctcttca

SEQ ID NO: 608840 - DNA, 81 bp, Homo sapiens
accgcagacacggccgtgtattactgtgccagagcggggcgcactgggagctacttcccccatgactactggggccaggga

SEQ ID NO: 608841 - DNA, 234 bp, Homo sapiens
  misc_feature (15)..(15): n is a, c, g, or t
  misc_feature (56)..(56): n is a, c, g, or t
  misc_feature (58)..(58): n is a, c, g, or t
  misc_feature (67)..(67): n is a, c, g, or t
  misc_feature (76)..(76): n is a, c, g, or t
  misc_feature (81)..(81): n is a, c, g, or t
  misc_feature (84)..(84): n is a, c, g, or t
  misc_feature (89)..(89): n is a, c, g, or t
  misc_feature (112)..(113): n is a, c, g, or t
  misc_feature (116)..(116): n is a, c, g, or t
  misc_feature (121)..(121): n is a, c, g, or t
  misc_feature (143)..(143): n is a, c, g, or t
  misc_feature (165)..(165): n is a, c, g, or t
  misc_feature (178)..(178): n is a, c, g, or t
  misc_feature (185)..(185): n is a, c, g, or t
  misc_feature (188)..(188): n is a, c, g, or t
  misc_feature (200)..(200): n is a, c, g, or t
  misc_feature (202)..(202): n is a, c, g, or t
  misc_feature (216)..(216): n is a, c, g, or t
  misc_feature (223)..(223): n is a, c, g, or t
  misc_feature (233)..(233): n is a, c, g, or t
ggctgccacgtgtcnaaattagattttgtgctgtatgaccccaaaaggttaaaggngnagccacagntgaaaagtnatggntanaaagnttgcagcaccacaactcaacagnnatnacttncccaaagacagccacaggtcanccagcctgggaaaaaagcgcgntcactactgttgnaaaatcnagncatttgaacccngntcctgccaaggggntaaaggntcaggaaggnt

SEQ ID NO: 608842 - DNA, 124 bp, Homo sapiens
gccagctcatatgcctatgggggcacatagatgtggacccagtgagaaatgcaaacctccgtcacacaagtggacctgtgcctggcgctcacaggtcaccgacgatccgtgcgtccatcgtgca

SEQ ID NO: 608843 - DNA, 214 bp, Homo sapiens
aaaatgtattttctgcttccaaagttaaatatatatatatacacattgacatcttttttacacactagatccaagtcgatagcgcctccaggcacctgcgagatgccaactcagatcatccctggtggaatatacctcaaccctggcttcaaacaattcttaaagatagattaccaccatatgtgagcttataatagtaaccaaaaaaaaaaaa

SEQ ID NO: 608844 - DNA, 723 bp, Homo sapiens
cccgacgctgcccacgggtggctcatcctgtggtagagaggtgacaagttcagaggtgtcggcgagggcatggcactcttctctcaaactggcctcccgggaactcaggagctggagatggcagttgtgggacagccccctgtgccgccttaccgggcctttctcaggactcccgtggactttgaatcctcagggagttctgagccccccgcccaggtaggccgacttcctggccatccagacagctgggggaggtgttggacgcggtcccgccggctcccaacagctcccaccagctatgtctaggtagcaagcatccggctacccatgcgtgactgggcaagtcgaagcctgcagcgtgatagtgccccttggtagacagtgggcaactacgtgagtcctatggatggcaagacgcagaccttagaggcaggcctggaagtaagaggcggtgggtgggcctggggcctggatgcctgggcctgcctccccgggcagggtcttcgctatctggcacatctgtgcctggtgctggtagcagatggtcaaggctcctgtcagctctacctgcagctgcggatccagaggtccccaggtgatcccggcgaggaggagtcgatccgagcccctttagcgtcccgttacacaccccaggcaatcgggggcagtggccaagggagctgtatgcagaagacccaggagcaaggtggttacccaagtggg

SEQ ID NO: 608845 - DNA, 2136 bp, Homo sapiens
  misc_feature (744)..(744): n is a, c, g, or t
  misc_feature (1847)..(1847): n is a, c, g, or t
ctcagatctgtagtgatgtggtactgccgttgcgctctctgtgcgcttcttggtctgtaggctgtgttgttggtgctcgtcgcgctgagcagctgaggaggttgtctcgtggcttgtctcttggctgctagattgctttaggttcagcttctgagctctgcggtctcgaggtgtgtctgtgggctctctgcttgcgggtctgcgtatcgtgctctggacgtgctgtactggcatctcctcgctttgcatctttcgtgctgcttcgaccgcgcttgctgtgctcttggcgctagtgttgtgccgtctctctttgttgttttgttgcttgggtggggttggagtttgtgggtgtttctggtctgtgttgttgcggttgtgtttttgctgtgtgtgttgatgtggtggtggtggtgtaggtgttatggtgttgtgcctcctgcagttgtttttggttgtggtcgcgcttccatcagttgtgtatatgccgtcgggcctcgcgtgtttgtgggatgtgtcatagatagacaccagactatacgccacgtgcgttataggagcggtgaatcccacgcacataatatattgagcatcctccgctagagggggagggtgacctactcaccaacgagggtgttgtggtcatccacacataggatagaagcatactagcgggccgttgttgtgttgttataatgattgccgctgaccgggctccccactgtggtggcccgtatggttagcganccgcggggttgccttcttatgcagtggaggtttatgctccgtggaacggtccaccttttggtgggtttgggtcgcgaataatttttcctgtggcgctaatctggtgagggggacgcccaaagccaccatgtgttgtgtggcggtcgggagaccacatgagaccaaagggaagtgtgtgtggggccgcctcccatagaatgttgtgggctgcccaacggagtatgtgtcgtggggataagtacccctcctcctgtgtgggagtggccccgctctagtatggtggttagctagcagcatcaagagtgcggtgataaccacagctggtagtagttgctcgttgcggcaggcgacacaataatggtgtctttagagaagagggttgtgggttgcgtagaacacacacgaatgtgtgtggcccctgtgtttgagacctggcgtgggggagaactgtcctaaggagagagaacctcgctgggggtgagtataggagagtaaggatgtgtgtgatgaatatgataatgaggaattacactgtgtccacggtccgcaacgacgtcccccgcacgagtggtggataattttttgtgagagggaggagaattacccaccagctggggggtccttcggtgtgcccccctgcgataatagggggttcctactcttgggaaatatgttcaacagactgaagagtgtgttgtccttgtcaccagatgatggatgtaccctctctgcggtacgcatcacagaggaatatgggagactcttggagtagtttgtgttttgtgggtgttggaatagggagtaaagagagaagtgtgtggggacccacacatattatggtgaagcccgacgataaaaaaacacacgacacagtggtgtagcctgctgaagtttgggagtgtcttctgagtatatataggattgtgtccacaggagtttgtatttggtgagatagtgtgaggtggggagcgccgcacagagactgtggtatgacacacacaaagtgttgtgtgtgaagtgtgtgggaatactctctacagaggcacctcaccctctagatgtgtgtggaaaaaaactactgtcgtgggagagggaagatgtcngaaagcacagggcacacccgacacacaggtgtctgtcggcgcacacaaatgtcacacactgtctggagaactctggggtatataagtgtgatgcacatagtgatggggtgtgatatatgattgatggacacacaggattcttatggtagtgtgtatataaatagatatttgtaaaaccgaacacacgcccagcccaataataggggcaccaataccgtgggacccccccttcttctggtatgtgataggagaatttagaataaacccaggtttccgtgtgtgaatataa

SEQ ID NO: 608846 - DNA, 437 bp, Homo sapiens
  misc_feature (223)..(223): n is a, c, g, or t
  misc_feature (227)..(227): n is a, c, g, or t
  misc_feature (232)..(232): n is a, c, g, or t
atgaccatggaggtcgcgtcgttccagttgcggcccggcgagcccggatcgacgtagttcttcagacgcttgaaggtcgcgagcacccgcttgaaagcgtcggagttgagcgctgccatgtcgcggtctcggtagaccttgaggaacagttccgagccgccgacgttggcgaggatggcgtcgaaggtgatcttctcctgccacgactgcccgcccagcgcangagnacganggccggcgctttgaagcttgtccagcgcggcaaagagctcatcgaccgtcctgggctcctgggcgatgccgccttctggaaggccgccttcgagtaccagaaccagccgatcgcatggatgttgaccgggacggcgtagttagcggccctttgaccttgacggtgttgaggattggtgccggcagcagcttgtcccaacctcctt

SEQ ID NO: 608847 - DNA, 258 bp, Homo sapiens
gaaaaagtgaccggaaactttatgatgctgggttgcagctttcaccatctgaacatacaagaagcctgggagctggagtggaccgtggaggagagctgtccaaccagaaacacccgttccatgtagaatacgttaaaaataaatctgtggtgttacatcactgacatatgggagccatttcattacagaagttggctttccataaaagtctaccatttattatattttaaaacacataggcccattcttacatatatt

SEQ ID NO: 608848 - DNA, 851 bp, Homo sapiens
aagctctgctctggcctcaaaagccactggctacccattggcattcactgctgcaagaagaattgccctaggaatcccacttccaggaaattaagaacgtcgtatccgggaagacatcagtcctgtttgaacctagcctggattacatggtcaccaagtattcgcccgcttgggatcttgagcgttttcatggaacatctagccgaatggtagctctatgaaaagtgtaggagaggtcatggctattggtcgtacctttgaggagagtttccagaaagctttacggatgtgccacccatctatagaaggtttgcactccccgtgctcccaatgaacaagagaatggccatctaatatgagatcttagaaaagagtggtctgaaccaagctagcacgcgtatctatgccattgccaaggccattgatgacaacatgtcccttgatgagattgcgaagctcacatacggttgacgagtggttgtgtattaagatgcgtgatattcttgaatcgatggaaaagacacggaaaggcctcaacagtgagtccatgacagagagaaaccctgaaaagggccccggagagttgggttctcagataagcaggatttccaaaatggccttggggctcactgaggcccagacaagggagctgcaggttaaaagacaaaacatccacccttgggtttaaaccagatgtgtacaactggtgtcgaatacccatcaggtaacaaactatcttctatggtgaccctacaatggttcgggcacctgtcttgtcactttggctgaccatggcagactgggctcaggagggggcctatcaagttgggcagcggcggaaatgaatgggg

SEQ ID NO: 608849 - DNA, 270 bp, Homo sapiens
actctagaggttcccatggactcctcatcgcggctgcgagcacagcatccagtgatcacatgctccaaggagaaccaggccagcaatagattcccactgatggtgtatggtggtgctgggaatggacagctccccatctcacgggtgagtgggcttgtggcctgaccctcactgctgcacactagtcatgtgtatttctggctccgtctccagaaggtcatccaccacagtccgcccagcttctggggcgatgactgggagctccatagt

SEQ ID NO: 608850 - DNA, 137 bp, Homo sapiens
ggtgctggagaatctggaaaaagcaccattgtgaagcacgatgaggatcctgcatgttaatggatttaatggagatgagaagtcataccaaagtgcaggacatcaaaaacaacctgaaagaggcgatgggtaccgag

SEQ ID NO: 608851 - DNA, 463 bp, Homo sapiens
  misc_feature (24)..(24): n is a, c, g, or t
  misc_feature (74)..(74): n is a, c, g, or t
  misc_feature (153)..(153): n is a, c, g, or t
  misc_feature (234)..(234): n is a, c, g, or t
cactatcacgggacagcgcaagantgccccctgattccattaccggtccctcccacaacacgtgggggattcangtgagagggtggggacacgccaacctttccgtaggtatgaataagggtagttcttagctgatgtcaagtaacaattgangttgtgcttatacttttttttctttgaggcagtggctggtcttttaaatgccttcattaagtttctagtacttataccaanggaattaaagacatgcaagttgctgctggctggcatctatatcccagctattcaggagtctgagacaggatgattgcttaaggccaggagtttgagactagcccgggcaacatagtgagactctatctcctaaaaaagttagctgaatgtggtggtgtgctcctgtaatgcccactcctcatagatatttcaaaatagtaatatttattgctgccaatgtgagtaggcc

SEQ ID NO: 608852 - DNA, 386 bp, Homo sapiens
gatggcggctccctggaacatgtgctgaaagaggacaagaggattcccgaggagatcctggggaaatgtcagcatctgcggtatctccggggcttggcgtacctccgagtagaagcaccagatcatgcacctgagatgtgaagccctccaacatcctcgtgaactctagaggggagatcaagctgtgtgacttcgtgtgtgagctgtgccagctcatagactccatggccaactccttcgtgggcactgctgctcctacatggctccggagctgtgtttgcatgtggcacacattactcggtgcagtcggacatctggagcatggtgccctgtccctggtggagcttgtgccgtcgtgaagtgtaccccatccccccgcccttcct

SEQ ID NO: 608853 - DNA, 727 bp, Homo sapiens
tgtcctcgggaactgcaaggccctgtgagacgggaggactgggatcccgggcgcggctggtggaaccgtcgaagctcagcggggccgcggacactgacctgtgcttagaactcatcctggcccgcagagcctgccgcgagtccctggtgtcccctgtggtcgggctacttggacgccactttcccgagcggaagtcagcccgcggcttcggactccggcggtgaccttgctcgagaggaatggcgcctgccggggttcaaggcactgtcttcctgttggccctgatcagtcattatgccagcacctgggctctgactgcccacttcacatacctcaccaatgattgacgtggagagactagaatgcctcgctggtatcgccctttcgcagaatttggaatcatgcgcttctactccgatcgtggggactcagcagccttggtgctcgaggtgcccagatgcacacatgaaagccatgtacctaacatcagatctaacgcttgatcccagcaatgtggattccctcttctacgctgcccatggccagccaggccctctcaggatgtgagatctctatttcaaatgagaccaaagatctgcttctggcagctgtctagtgaggactcatctgttagcccagatctaccatgcagttgcggctctaagtggcgttggcttcccttggcatccaagaagcacctcagtgtccttactgctcgtactcacag

SEQ ID NO: 608854 - DNA, 929 bp, Homo sapiens
tttgttgtctgttgttggtgtgtgcgtcttgattgttttattgtgtgcctgtttttgtgttgctgccttcgcgttttgctctgtgtcatgtccgtttttctagcctttgcaacgctgtgttcgtgctgcgtttttgcgggtggtggtgcatgtctttgtgcttatcttgtgttctgtgttgtgcagctctttggcacaagcattttttgttcgtttgtggtattgctctgtcagtttagttcgtcggtagtctattttgttgcgttttccttaaatgtagtgtattagtgcatcaatgttgcttggctctaatgaaattgtttagactctggtacatgacctatgttaatcattacttataatggactctttttatgtctgcaactgctttgactagtttttatgtggctatagctcattgtacactaatagtaagcaagatagtgcaatatatctagaaggtatgctggcatttagtgttggacctcaaattgtcaatctcagagaaatcatctgatgttttctaataatcacctttgccagctcgaaagtaaactataccctatgtagttgtggaagtgttatgcctaatattgtgttaactgatattaaaccgtccaatgttctgcctacccctgcttggtatcacagactattctttgagacagtctgttaaccaagaccaaaacagatcactgcattcttagcaaaattgcctagctatgttgaagtgtgctcaaaatacaatggtgttgatttcagtgcactttgtcgctattaacatcctttttctcatgtagattgtcaataattgagtaatctctagaagcattattttaggaatatatgagttgtcacagtaaatatcttgttttgttctatgtacattgtacaaatttttcattcctttgcatatcctgccggttgat

SEQ ID NO: 608855 - DNA, 522 bp, Homo sapiens
cttctctagttcgcactcaattctatcgctggcttgaaaacgccattggtctgctggtcacagacatcgcagcgcgggttggtgcggaaatgctgcagtgcacagctctcgcagaaataatgcctgcacttggtgacaactgggtttgggaagctctggcgacagataaaacacttgaatggtattccctcatcatcgctacccacttcatagttgtcatcctcatagacaccatagcgaccctaatcaagctcacgttcgatctgccacccatgcttgtaatctgaacggtcatgaaggaatttgcagctatctccgaagccgcagaagccagtctcttggtagtccttacagatgtcgggctgttaatcccagcgcacggtggcacgtagatcctcgggcgctcggatggggccctttcctcaccatcccggaagaggcattgccccatgacgtatcctatggctccatgtctctctgctacatgttgatccccgatacttgcattggtcccgagctcga

SEQ ID NO: 608856 - DNA, 814 bp, Homo sapiens
gaggccttaaccaacgataacggctgtgcgatcggcgaaacctcgtgagctcgcagtggcggggtgcgatggccctggtgccttgtgatgatggagaattctcagttgtgtaagctgttcatctgtgcgtgcctcaatgttgcatgactgatgtgagtctggtgcctgctgctggccacttttgatgtgcctttgtggactctgactgtgactgctgtggttgtgtgtgttgaatccccatgaccaatgctgctccctgtttgcttttggcttctgtgacctactccaattgttggagtgatgtgctgtgactgcctgcccatttgtgcctgccttctgtcccccattgcctgttgtgacttgttgcagaacacttgttggatgctttgagatgctgtggtggctggtgttgtccctgtgtgatgggagttctggtgctgctgtagccccctggtgttgcccccaactgcccgagatgggttaacagctggacacggctccttatttttggtacctgggatgggtgccctttacacatggtggatcgacacctggtttgtgcttgacaggggtggctgaaaccctttgaatttccggaagcgcaacattttccatactggccgagggtttttgagccaacccctgtttggcgcaacaacatgtgtgccctgagggactttattttgcgctggagacaaaatgaccagtgtcccttgtggccacaagcaaacgcctggtttggaacttttcctggggctttcccggttcgttatttatcccaatggaaattccactggatctggcgtggcatgga

SEQ ID NO: 608857 - DNA, 225 bp, Homo sapiens
tggaccgtcttcatcatacctaccaatattgtacctataatctgtgatatagcaaaacatccatgcccctgtcagccacccgtcctgtttcatggaacttatacagtgccattttaaatattccagttagtgaagatgatacatttatttttaaatgatattaaagttttgatattatattattgcaaaaataggtttaagatgaggtaggtatgatgaaggacg

SEQ ID NO: 608858 - DNA, 129 bp, Homo sapiens
tgtcatgtgagaggtgcctgagctgtttgtgcgcgtgcatgcacgcgtgcctcatgatttataggaaagagtttattctctctctgttaagaataaaggagctggcttagtcacatggccactcaatac

SEQ ID NO: 608859 - DNA, 357 bp, Homo sapiens
gtaggtacatactcagcattccctccatcaacaacggcatctcctaagtcaaagtcatcccctatcaagagcgggaaagagcagtaaactaccaaattccagagagaaacgagtaagtgatatgacctcgtgaactagtatcagaaatataccacggacccacattccttaatacttctctgaatatcagcttgaccaggatctcattagaagaagtgaattcgctgaccatgtttacatcactattctcgtcaaatgacaagaagaaaaaacagagagacagatacagataagaagctaggagagaagctcccagaggagaggcagtggggatagagagagcgaggtacagtagtt

SEQ ID NO: 608860 - DNA, 632 bp, Homo sapiens
  misc_feature (74)..(74): n is a, c, g, or t
  misc_feature (91)..(91): n is a, c, g, or t
  misc_feature (163)..(163): n is a, c, g, or t
  misc_feature (169)..(169): n is a, c, g, or t
  misc_feature (389)..(389): n is a, c, g, or t
  misc_feature (395)..(395): n is a, c, g, or t
  misc_feature (413)..(413): n is a, c, g, or t
  misc_feature (436)..(436): n is a, c, g, or t
  misc_feature (471)..(472): n is a, c, g, or t
  misc_feature (477)..(477): n is a, c, g, or t
  misc_feature (488)..(488): n is a, c, g, or t
  misc_feature (499)..(499): n is a, c, g, or t
  misc_feature (502)..(503): n is a, c, g, or t
  misc_feature (605)..(605): n is a, c, g, or t
catcgtccccacctccacctgggccgcccggcaggcgaggcgacggaggcccgggagccatgggtgactggggnttcctggagaagttgcnggaccaggtccaggagcactcgaccgtggtgggtaagatctggctgacggtgctcttcatcttccgcatccncatccngggcctggccggcgaagtcacgtatgagcggtgacgagcagtcatgaatcttcgagtgtaacatctggcccacgccaggctgcacacaacgtctgctatcgaccaggcctctcccgcatctcgccacatccgctactcgggtgctgcagcttccgtcttacgtcagcacacaccacctctggatctacctgggtccatagtcatttaacctgctctcggncgaganagagcgggctgcgggcancaagggaggggggagctgcgggncactgccggtccaaggtacccacaggatggagcgnngcgcntggcggccgangatgcgatacnagnngccaacaatgtcggtggcagaagattggtcgcctgcgcatccgcggagcacgtgatgggcacctatgtcgccagtgtgctctgcaagagtgtgctagaggcngggtttctctatgggcagtggcgctgt

SEQ ID NO: 608861 - DNA, 120 bp, Homo sapiens
ttcatatcaacattgtcgtcattggacacgtggtttcgggcaagtccaccactactggccatctgtctctataaatagcggtggcatcgcacaccgggcccattcaaaattttgagaggg

SEQ ID NO: 608862 - DNA, 249 bp, Homo sapiens
ctcagctggaccaaattagttgaattactcaccatcaataaactataaatggcgccaatgaccaacccgccaacgattcccgttgtcaaagaacctaataacaagtaaccaaccgcagccccaacaagcccaactaggtttaaaaaaaccaagcaaaaggccaactgtccgtcgtttattggattgtatctgctcatataacattaaaacttaaccgttggcacttctttctcagacccgccgatactg

SEQ ID NO: 608863 - DNA, 286 bp, Homo sapiens
atgttttgggggtttttttgtttgtttgtttgtttgttttttcattttttaaaaagcgaagtagagacaaggtcaaataatggatgtttaaaacatttaaggatcagcctggtcaacatggcaaaaccccatctctacaaaaaatacaaaaataagccagccactagggaggctgaggtgggaggattgcttgagcctgggaggtcgaggctgcaatgagccatgaagtatgccactgtgctccagtctgggtgatagagcaagactctgtctcaaaaaaaaaaaa

SEQ ID NO: 608864 - DNA, 279 bp, Homo sapiens
taggtagttaaattacccccatgttaatgaagcggaattaggctcccgagctaagggactcgcctagggtctcccagtgagtaggaggagggcctgggattttaacccaagggtttgaggccagggccgcctgccgtaaaatgggtgtttaaaagtgagtcagggcagggcagctggtatcgaggtgccccatgggagtaaggggaccccttccgggcggatgcagggctggggtcatttgtattttaagcccctcggaataaagggcgttgcccccca

SEQ ID NO: 608865 - DNA, 594 bp, Homo sapiens
ttcactgttattcttaatattacccataatgaatgtctttgtattgggttcttattttagataactccttttctttacttatcccctttttatgaggggttgaaattggagcctgtgggcccaacaccacgcagtgtgaagcaccccgtgctccttcaaaacacactatctatccacactatccactacacacgtgacacacaaacaatagactgcgctaataccccatcatattcactactacccccccgatacagcacattagcagcactccgtctacacgtattctccgaggggtcactactttcgcaccataccattgtttaacaacttcaacacaacccatctaatttaacacgacttccaccaccacaaggtgtgaaacaacacacatgttaggaacaaaatcaatttctgatcgcccccaccacaattatgattgccgggcataaaactacacactcatattacaccttatgtgcgcccatgctttataaccaaagaaaagattctgctgagctatgagggtaggctccaccatctcacccacaccatattaaacctatcgggctaattcgagacgcctccagcgat

SEQ ID NO: 608866 - DNA, 1413 bp, Homo sapiens
  misc_feature (7)..(27): n is a, c, g, or t
  misc_feature (30)..(30): n is a, c, g, or t
  misc_feature (96)..(96): n is a, c, g, or t
  misc_feature (101)..(102): n is a, c, g, or t
  misc_feature (989)..(989): n is a, c, g, or t
gcaacannnnnnnnnnnnnnnnnnnnntcnttcgctgaacgaagtacggcgaataataataagagagagtgactgcctggctggagaccactgctngtgtnngcctctagccttttaagtgtgtatgggttgtcttattagtctcggctatcgcaccgctgtgggtagtctgtggtatagttttattttatccagtgatagattgtgtgtttgattctcttattattgtgtgtatcatcactctcccatgctgctggctgtttgacaccaaactaaagatgcttgctgtgcactgaagagacaccacagtagtgtgcctgcgctcagtggttaagtatgtatcgcaggccccggtggtggtgcgtcatagtgttttgttagaggaggggctctccttctctgttgggtgacgcttaataattgagggcgttgttggtaacacagagctgccacaaacatttttgtgtggaagatttttttattccccacgcggcgtcccgccacagtggggtgttcgccccttaggccccctgtaggccctcttcttttttggtgtttcctttccttctctggggtgtgtgttcctccctccccgtcgccgagcctttctgtgtccttccaccaaagagccgcgcgggtttttcagatagtggtttcacactcaggtaaacagcgcgctgttttgcgccgccctgttttcccaggggttcccccccccgcggggtggtttccctgggtggccttatactagtttcggggccactcacgaggggcgatttttccagggaccattttgtgttctatatatggagggttccctccccccccctgctctctccaattcttgtgctagagagccaggaatgtgtcccgcccacacatggcttttatggatctcttttctatatattgcctggtcccacttgtataagtgttacagaaatatattagagagcatggcgggcccccgccttctttccccacaccangtttattgtttcacccacgcgcgggcgccgttctgtgcacagcatgggtctttgtgacatgggagtgcggcctgttgttgtaaaacgcagtcgcgcacatgttctctcgcgagagcctcgcgtttttgtgcgacgagtgctctccgggaccccatctgtcccccccctgggaaacaatctgtctctccggtaaaggacgccacccacaggtgtgcgcgtgcagagatctcgtcattaacacagatttgtgcagatacacaacctttctctaacgaatggttctgggagtggtgcacttcttgaaggcgttggccactcggtgcgacgccgccgtggacagttatagaagcttctcttttctgaattctttgttttaagaaaattgtacgttctttctggctcgccaattgaacagcagaaatat

SEQ ID NO: 608867 - DNA, 115 bp, Homo sapiens
ctcacaaaagtacttttgtcagtagaaaacaatccaccagccatgacagggcaccttattgtatcagtttctttaattctgtttttttgcaatgacatctggaggaattgttctc

SEQ ID NO: 608868 - DNA, 124 bp, Homo sapiens
gattgctggcactgtagaattgggcaacagttcttcagacctggctcatagctacaatgcatttagtatattaaagcagctgacattgatgactttttgcgagccttcccaggcactggagttt

SEQ ID NO: 608869 - DNA, 163 bp, Homo sapiens
gaggaccatgctaagccatgaccagtgaggagaagcaacagagccttgtctgtccccattgagcggagtcttgtcctctgctctactgcagtcaggtcactgcctactgcctcggggctgctagtcattccagtcgaggacgattgtaacctgcgtggtgatg

SEQ ID NO: 608870 - DNA, 116 bp, Homo sapiens
cccctagtttagaagttcaatagcacattgcgtgctggggtagtaaaatgggcaggtaagggtgtgattccattgctgcctgggggttctttttgtaggtgctattgaaacttcta

SEQ ID NO: 608871 - DNA, 288 bp, Homo sapiens
aatgacggatgtggcgttgatgatgaggcgtggggtttatgacagagcgtggggtcaatgacagggtgtggggttgatgacggggtgtggggttgatgacggggcatggggtttatgacagcttgtgtcagacgaagccacatcaactcattctgagcacccctttcctcaaaacataaggatgagcatgaccaaaatctcaagacatttttcctaagtccttaagacggatgaacttctacaggtaagtaggtagattaataaacagaggtaaggaatgttggcatg

SEQ ID NO: 608872 - DNA, 982 bp, Homo sapiens
  misc_feature (241)..(241): n is a, c, g, or t
actggtgcatgcccgccgacgcataaagcagagcgatgcttgtaacacccgtgagatagagcgcgtggggaagttcgagagggaggttaaccccttatgagggccctgttaaaatcctgcctggggggagggtaatgcctttggggcccacaaactaaagggtcaaacgcactcgccaggaaaaggtgagaggggttttccgtgtccaaccgacagggttgtctccctagggtaggcacgngtgttccgcacgggtcagcgcacgcggggcttggaaaaaacctggcggtgccacggtggccctgaggcctggatataaatgagcggggcggcaaccccattgatggggaggccacactattggtgaaccaatagagaacgccttggggtaaacagccgataaaaggcttttggggcgaccctccgcagggtgaatacacttctaaggaggtgcgggcgcggtctcttcttttttattttttgttttcatttgtcaaagagtcgtcgcagacttttattcaacgtggtctcaaagtcagatgtaccagggtaagccgctgcgcatgcactccacccagtctccacgggagagccaaagaaggccttcagtacatactccaagttgtgtgggacaaataaatgcgagggtggaaaggaggtggaggggcaacgaaaggctctaatcagttccaagataactaaatagaccaataactaaaaagagtacttacaggcgaagattaaaaaaattttgcattacatatatttacacgaaagcaatgcatatcacctcccctgtgtggacgttgggtagaggaatgggccattctccttagagtagacagtggggatggcttttaggatggcaagggacttcctgtaacaatgcatctcatatttggaatgactagtaaaacaacaacaaagtgcaatcgaagtcctcggccacattgtgaacttagagcggagtggctcgctccaa

SEQ ID NO: 608873 - DNA, 728 bp, Homo sapiens
ggctcctcctccccagacatggtgttcacgttgcgcggtcttctgctacatgctggcgctgttgctgcactgccgcgctcatcttcttcgcgcatttggcacattaggtacgcattctgatgaagcgtgaacgacttgattacaaagaattccgtatatgaccagtgtagataccctgaatccgccttgtactcccagacgtacctcatccacgctctttcttctgtgtcatgtgtctttgtgcagcatgatctggcttacactgggtctcaatatagcccctcttggcatatcatatttgagaaggtatatgagtagagccatgtgactgaagatggccccacggatcgtctattgacccttctacaaggcattcatgtatatgcaggtactgttctagcattacttgtcacgaatggaaggatggtgccacattatgctttgtatcttctagcatttattgttactagcctatatggcagtgaatctatgttcttggtgagctcttaagaacagacaacacagaagaattggtcctagttaagtgcatgcacaataggccttagccactgtgaatggcatgcgtatccagcatagatccgtgtccgaagtagtagcctgtgggaagtctgatcgagtgtgactttatagatatgactccttattcgtttaattgtttccacagtttttgcttgtggtcaagactggttcatatgttgtactcagat

SEQ ID NO: 608874 - DNA, 281 bp, Homo sapiens
ggaggaatgcgagaggcaggacggatgttgccgtgtgctacgttctggtcctggcccttcctgctcctgaggccccttcctcatcggtgccagcggacttctttctagggtggcctttccctctgtggggtggcagagcccacaagtgggggatcacacgtagcagtgtgaggccctgagtgggaggggtcttctctagtgcaggagacgtcgctgagcacttgctccaggcgcctggcacgcgataggccatgcacggcagggcaggacagatgcctggg

SEQ ID NO: 608875 - DNA, 136 bp, Homo sapiens
atcgctgaggtgcattagaggatcctgtagtcgttagcacggcagtgttgtgctatctagcaaatatgctgttatgtccagaaattgtgtgtgcaagaaaactaggcaatgtactcttcctgatgttatgttgtca

SEQ ID NO: 608876 - DNA, 980 bp, Homo sapiens
atgtcgtactggctagctgacgcaggtgcgagggcccacgtttcaattcaagatttcttgtaaatggaactcttagtagtgtagcaggtacgccatagcttcataagtggtaaagaaaggtatacgattggaaccattagtggggcatagtagtgatggggtgaaaaggataagtatatcaaaatgagaatgtgctgtagtcggaaggtagggaggtaaaggatgttgctttcagggttagtagaaacagggacgtttctactatggaaacgaatgcgtttctataaatgcatggatccaagtaatttatattcaatggtaagtatataaattactgctgttcagcttattaatgtttgaactgtgcccattacatgaattagaaaatttagagaaatcagttggttctaggtcaggctagcagtttagagaagagttgaagaactaagagcacttaataagagaatttgtggatgaatttcttttataacatagaaaagaaatgaaaatacataaataatatagatatgacaaataaaacttaacaactatatatgccaaaaaatgtaagggtagtgaggtaggttgttaatcatggacactgaggctgtggttaataactttctaactatgtgagctgcatgttctttccattggtaagaggataatcaatgaagacaggttggcttcctactatggctacgcgtactagagaggcggccttggacaaaaaataaagcatgtctgcggtgaggcaaaaaagaaatatgcaatacttttaagtgtaaaacatgtcaataagagatacaaggggacaaaatttggagacctgcatatcaaatctttttggcaccttccaactctctctgttaatgaattacgttatacccgtggcgtaatgataatccttccacagtagagagatatccggcataaaactacggagcaatattgtgcgaagaaaaatggacgcccttatg

SEQ ID NO: 608877 - DNA, 727 bp, Homo sapiens
  misc_feature (105)..(105): n is a, c, g, or t
ttcggacgaggctgcccacaagcctgtgaagcaatagcaggggtaaagcaaaccccagcccacaccctggcaggcagccagggatgggtggatcaggaaggctcntggttgggcttttgcatcaggctcaggctgggcataaaggaggctcctgtgggctagagggaggcagacatggggaccatgaagacccaaagggatggccactccctggggcggtggtcactggtgctcctgctgctgggcctggtgatgcctctggccatcattgcccaggtcctcagctacaaggaagctgtgcttcgtgctatagatggcatcaaccagcggtcctcggatgctaacctctaccgcctcctggacctggaccccaggcccacgatggatggggacccagacacgccaaagcctgtgagcttcacagtgaaggagacagtgtgccccaggacgacacagcagtcaccagaggattgtgacttcaagaaggacgggctggtgaagcggtgtatggggacagtgaccctcaaccaggccaggggctcctttgacatcagttgtgataaggataacaagagatttgccctgctgggtgatttcttccggaaatctaaagagaagattgcaaagagtttaaaagaattgtccagagaatcaaggatttttcggaatcttgtacccgacagatctcgtttctaccaattcagcacactgcgcctactatgatcat

SEQ ID NO: 608878 - DNA, 157 bp, Homo sapiens
tctagaggatccctcccacaccgttacggacactggattccacaaggtagatgggctccatgaggcgtggtgggcggccagcacactggcgtagagtcagcgcgtgctgtgggaatatctggccccctccgcggtgtatggcgtcggttgcagggtg

SEQ ID NO: 608879 - DNA, 363 bp, Homo sapiens
agtgttactgaatctgttatggccagtgttttataacccccttcacattacctggtcagtaacttgcttcagatgaaaataacggcagaaagcataattttttgttgagatcttgtttgagacggtgtctcaactctgttgctcgaaggtggagtgcagtggtgtgatctcggttaactgcaacgctcagcctcccgggttcaggtgcttctcctgtctcggcctcccaagtagctggcattcccggtgcctgccaccaatgccgggttaaatgtagtattgggagtagagtcaggggtttcgccatgttggccaggatgttcattgaattcatgcactaggcgatctatctggctcagtctc

SEQ ID NO: 608880 - DNA, 433 bp, Homo sapiens
  misc_feature (66)..(66): n is a, c, g, or t
  misc_feature (114)..(114): n is a, c, g, or t
  misc_feature (116)..(116): n is a, c, g, or t
  misc_feature (120)..(120): n is a, c, g, or t
  misc_feature (123)..(123): n is a, c, g, or t
  misc_feature (126)..(126): n is a, c, g, or t
  misc_feature (135)..(135): n is a, c, g, or t
  misc_feature (141)..(141): n is a, c, g, or t
  misc_feature (266)..(266): n is a, c, g, or t
  misc_feature (297)..(297): n is a, c, g, or t
  misc_feature (319)..(319): n is a, c, g, or t
ctcgttttcgccccatactcgatgccgttctcaaccaccatgcctgtcgtgttaagggcggggatnggacatgactggtagcgattcggtgcccataggcttgaatatatgtcntngtcntanctnttgtcaacngtgaangtcggtgtggcagctgttgtgcgcatagtcccaggtgtggtgaaccggacactctcagtaggattttctgtttgttgggttgatggagcctcgggtgcagtagttgtggctgtgaagtctaccanctcttgctcctcaagagctgtagtggaaacngcatggctgagttcaatcgaanagcgggtggagcggctgctcgagggtgtggtaacgtcacacttaaactcttcgtcgagtagggaaccaagtgggcggagaagtagagggtacggattacgacatatcacatcct

SEQ ID NO: 608881 - DNA, 398 bp, Homo sapiens
  misc_feature (36)..(36): n is a, c, g, or t
  misc_feature (107)..(107): n is a, c, g, or t
  misc_feature (118)..(118): n is a, c, g, or t
  misc_feature (124)..(124): n is a, c, g, or t
  misc_feature (127)..(127): n is a, c, g, or t
  misc_feature (136)..(136): n is a, c, g, or t
  misc_feature (139)..(139): n is a, c, g, or t
  misc_feature (145)..(145): n is a, c, g, or t
  misc_feature (149)..(149): n is a, c, g, or t
  misc_feature (152)..(153): n is a, c, g, or t
  misc_feature (159)..(159): n is a, c, g, or t
  misc_feature (204)..(204): n is a, c, g, or t
  misc_feature (226)..(226): n is a, c, g, or t
  misc_feature (245)..(245): n is a, c, g, or t
  misc_feature (247)..(247): n is a, c, g, or t
  misc_feature (249)..(249): n is a, c, g, or t
  misc_feature (251)..(251): n is a, c, g, or t
  misc_feature (253)..(253): n is a, c, g, or t
  misc_feature (259)..(259): n is a, c, g, or t
  misc_feature (271)..(271): n is a, c, g, or t
  misc_feature (282)..(282): n is a, c, g, or t
  misc_feature (287)..(287): n is a, c, g, or t
  misc_feature (294)..(294): n is a, c, g, or t
  misc_feature (299)..(299): n is a, c, g, or t
  misc_feature (304)..(304): n is a, c, g, or t
  misc_feature (307)..(308): n is a, c, g, or t
  misc_feature (311)..(311): n is a, c, g, or t
  misc_feature (319)..(319): n is a, c, g, or t
  misc_feature (324)..(324): n is a, c, g, or t
  misc_feature (327)..(327): n is a, c, g, or t
  misc_feature (331)..(331): n is a, c, g, or t
  misc_feature (345)..(346): n is a, c, g, or t
  misc_feature (350)..(350): n is a, c, g, or t
  misc_feature (360)..(360): n is a, c, g, or t
  misc_feature (363)..(363): n is a, c, g, or t
  misc_feature (367)..(367): n is a, c, g, or t
  misc_feature (370)..(370): n is a, c, g, or t
  misc_feature (392)..(392): n is a, c, g, or t
gatttgggtcccgggatttgtgaggtggtgtgattnctgtcagtgtttctctatgcctatgttgtcaaggctcagatgcgtgggggtcacttgggagactgtcaaantggtgattccnggttcnggnggttcaggnggncgcggnggcnggnngggggnggggcgggcccccaactgtcggcatttttggccctttccctgggngattgtggtgcacgtgaggcgnctgtgtttccctaaacgcngncntntncggggnttgggggggggnttgcgggattngggtnggggacnttccntgcgntgnnccnttgggggnggtgnggngcgntccgcctgacgggnnacgngcctttggcnccngggngangggtggtgggttgggggcggtnttgggc

SEQ ID NO: 608882 - DNA, 785 bp, Homo sapiens
  misc_feature (274)..(274): n is a, c, g, or t
  misc_feature (276)..(276): n is a, c, g, or t
  misc_feature (284)..(284): n is a, c, g, or t
gcgagggccgttgggttggcgcgtggttttgggttggcgccgcgccgccgtgtgtttccgcgcgggggtcgtggtctccgcccgcaacaccctggggtggccgcgcaaggtatggaccttgttgcgtcgcgggagtgttgtgcttaggacgctgattctcgcatcgagttggtgcgtcgctcacatggatgtgtctcctgttacagagggcgaccgtattcgtggtcctgttgttattgctcgcgccgttgtgcgttgcgcgctggcgtccgcncncccgcgtnctgtcttgtgatacgctccgtggttgccttgtggtaggagagaggccgcgctcgtgtcgtcggagcgagactctgcagtgttgtggtgtgttcccaccatgcgcgcgcgctcggttgtgagagtgtcgccacgtcagtgcgatgcatagtggctccgtgtcgtgtgtctgccgagggcgccccgacactgcgtggtgtgggtctgattgactcgctcttgtctctccagacagtgtgacaagcgagagcaatactctttgtcttggctgtgccgcgcacctcgctcgcattgtcatcctctttcatgtgcgcgtgtgaggagcacctagtctcttgtagagtctatgattgtttcgtataaaactcctcaacgctgtctttggatggcgaaccacactgagtgacccccacgatgagttgactgtctccaggagatctttgtgtgagcgccccactataagaagaagagtcaaacaggcacaacaaataacaaacaaacaa

SEQ ID NO: 608883 - DNA, 338 bp, Homo sapiens
  misc_feature (179)..(179): n is a, c, g, or t
  misc_feature (224)..(224): n is a, c, g, or t
cccaaaagtcctggaccagacagactcacagctgaattctaccataggtacagagaagagctggtaccaattctactgaaaccatttaaaaaatcgaggaggagggacttctccctaactgattctataaagccagcctcgccatagtaccaaaacctggcaaagacacaatgaaaaantaaaaccacaggtcagtacccctaataaacatagacacaaaaaanttctcaacaaaatgctagcaaaccaaatccagtagcacatcaaaaagttaatttgtcacggttcacgtaggcttcattcctggggatgcaaggttcagttcaacatatggcaat

SEQ ID NO: 608884 - DNA, 303 bp, Homo sapiens
tcttggcctctccccatgtctcagtgttgcctgcatttctcccaggacttgggggtggggtgaaaagcgtacacaaaagatacttaaaagggctcctggggtacacaagcccagcaggtcctgagtgaagccgtgggccctccaaatgctcgtcttatcgcaacctctctctcccctagtcctccaaatccactcctgccttcctcaggttcgctacctcgcagctttgactacccagcggcaattcaatatttctactatcaacttaacttataatgcacatcgccaaatcctttcctctac

SEQ ID NO: 608885 - DNA, 468 bp, Homo sapiens
  misc_feature (331)..(331): n is a, c, g, or t
ggggaccctggatttaccttgatcggtggcggtctccaggaaaagtgtcccctccttcaagcctccccacaggggtttgcccaggatgtgggcggcatgttcaagcaattcaacaagttaattgggggcaaggcaaaggggcagtccattatgggcctgcagggtttttttaaaaggggcatgaacgaggccttcggggaccccaagttttttgttggggtggtggagccccccccaataagcctgcctggggttggcctgagttcccaggagatgtttgggggccctggtgatggccccttagggtggagcccccatggcaagcccagcntggttttgttttttgtccggtccccccatcccccctccccggggggcctgattccccctcccggggggccccctcccccagttcctcccgaaatggtttttatttttgggggtttaataaaaacttcccccgttcca

SEQ ID NO: 608886 - DNA, 845 bp, Homo sapiens
tggtctttgtccaaaattttataaaagggtcttaaaaagcaacatccaaactccaaaatacagctgccaaggaaaaccctgtaatgctgtggggactggctggggcatggcaggcggttcgtggtcttcccacccttctggttctggaaatgggggtggtggggcagtatctcatcttaggggtcccacaatgctcacgtggtcaggcaggggcttctatagggccaatctaaccagtgggtggtcccagggcagaataggatcttcaccttgatgcccagcaacaccctgtctgagcaaacactgtggcgcacagacagtgtcaacgtagtagttaaccagggtctccgctgtggatcatcaggccatccacaaaccttcatgggattaagccctctgtcctcggagtttcccagagaccacaacctcgacagccttgggccccactctccatgatgaaccgagcacaccataagcaggccctccgaaatgaagccctcctaggagtttgtaacgcaaagactctgcctggggcaatggcacacagaccctctatggtgccaccttttcagacataaagctctatagtgccctcgtgaaaagccaacctcttttgaactacagaaagtcagtcccggaatccggcggccttttcaccaagaacatcctgcgtatctggggggcaagaaaatgattcggccctgtaggtgtaacccgaactcaatccagagttgctcacttcagacactccccgaatagaaactcttcagtacagttggaaagcccacaggaaaactccctctggaattggctggccatgaccggccccggttatggacaggcgt

SEQ ID NO: 608887 - DNA, 228 bp, Homo sapiens
tagctgactctagagtatccccacttcaatgctgtgagccatcaccactaaatggacatacaaagtgccaggtataaatcagcactgtctcttataatagcttttcctaactttgccctaggcaacaagatggattcaaaaagtgggaaaatctgtattgcgatcgctctcacctgattcaaaatacacactacacgtttctaagaagtgtcattgttggccgggcat

SEQ ID NO: 608888 - DNA, 272 bp, Homo sapiens
cgtttaaggcgagccgggtacttgaacggaggatagtgcctcatcagcttcgaggaggagcgggccagctgtccttcaacactggacacgctctactgaacaccagagctggccagtgaggagacgctccactgaccacccagagctgggccagggactcaacaatggggacagaagtcccccagtgcctgccagtggactagagtgtgggtacaggaccaaggggcttctggtcctccagcccctgtactcgtgcatgccctgcggtcact

SEQ ID NO: 608889 - DNA, 435 bp, Homo sapiens
  misc_feature (4)..(4): n is a, c, g, or t
  misc_feature (78)..(78): n is a, c, g, or t
  misc_feature (81)..(81): n is a, c, g, or t
  misc_feature (83)..(83): n is a, c, g, or t
  misc_feature (86)..(86): n is a, c, g, or t
  misc_feature (129)..(129): n is a, c, g, or t
  misc_feature (140)..(140): n is a, c, g, or t
  misc_feature (147)..(147): n is a, c, g, or t
  misc_feature (159)..(159): n is a, c, g, or t
  misc_feature (212)..(212): n is a, c, g, or t
  misc_feature (224)..(224): n is a, c, g, or t
  misc_feature (277)..(277): n is a, c, g, or t
  misc_feature (304)..(304): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (335)..(335): n is a, c, g, or t
  misc_feature (374)..(374): n is a, c, g, or t
  misc_feature (378)..(378): n is a, c, g, or t
tttnggtcttctcttttccccctccttcctctcctccctccccctggttaaaaaaaaaaaaggtaaagaaagccccanttncntgngggggggttgctgatagcaggggggggggcctggaaggggagntggggcccgtnggggggnggggctcccaantccctgggaagccagggcttgtggcttacagagaggagagggggtacgggcantggctgctcgtntcctctgccacccctgcccactgtccaggggacttcaacacaaccgggggggnaggtttgtgtggggtcaggtctgatanaagaggagcagganananaaatcgttaaaanctagcgaattcccctaagaaaacatttcttcctcctttncttntggaggctccttaggttggtagggaaataggagtgggtgggaaagaggggggagagg

SEQ ID NO: 608890 - DNA, 723 bp, Homo sapiens
ttttcccatgaaatctttcgccttctaatattcaaaaagtgggttttttcctctcataaatatgactctaatagcccctttgtcattcttagcccacatatattatgcgacattacttcctcctctccacacctctgacctctctaataatacttctccgtgactttcacacacacgcgcccactcattgaagaagtttctctagggtccgccacacagaaaaattatgctgagtattaaaatactatctgcgtatagcaatgttttttctcctttaccagggtactattcccgagcgttaatcactataccttaacattctattctatggctcaacaagcatcgtgagaaaaaattttcacacaccccatcggtgttcttttataaatagaagtggtttgtacttcaaacacttcctaataattattatgtttctcccccctcgaagaccccccgcagatattatcaaagtcctagaatatactccacagacagcacgtgccgataccaccacgcatcctctagatcttttctataagatattttctcctccaatcttattatgttagcgaggagtatatctattaaacaacccacttttaagacgagtatttcaacatatctacattcactattccatccacccctgatttccattggagactatggaaatctgtctttctctttccccccaatacaaattctcattcccccacaaaacaa

SEQ ID NO: 608891 - DNA, 432 bp, Homo sapiens
  misc_feature (8)..(8): n is a, c, g, or t
  misc_feature (16)..(16): n is a, c, g, or t
  misc_feature (73)..(73): n is a, c, g, or t
  misc_feature (79)..(79): n is a, c, g, or t
  misc_feature (171)..(171): n is a, c, g, or t
  misc_feature (174)..(174): n is a, c, g, or t
ccccttcnaaaacccntcgaggtttaagatctccctcactgcccgaaaaaggcggccctgtgtatcctttttnagaaanaggagtgcctgtttcctatacctaacccagtcaggacctagtacaagatgcctgcctggacgaataaatgaaaaagcttctggccgggtgcnagntgtcacgcctgtaatcccagatctttgggaggctgaggcgggcggatcacgaggtcaggagatcgagaccatcttggctaacacggtgaaaccccgtctctactaaaaatagaaaaaattagccgggcgtggtggccggcagctgtactcccagctactcaggaggctgaggcaggagaatggcgtgtggggtgaacccgggaggcggagcttgcagtgagcagagatgatgccactgcactccagcctgggcgacag

SEQ ID NO: 608892 - DNA, 137 bp, Homo sapiens
aatagcattctttctaaacttacaaatcagacacatagtgctgtgggtgtgtgcatgggtatatgtgtgtgtgtgttctctggagttatgcaaggaagacgttttctttacatatgtgatgatttgcctcattgaca

SEQ ID NO: 608893 - DNA, 327 bp, Homo sapiens
cagcgatgaggatattgtgtgagtagtatgtgcccatgggtatatgaaagttgtgtgcgtatattagagtataagtgggttttgtggttttatttatttggtatggtatgggtttaatcgggagagggagaggtgtgaattcagggttagttggtgagtgtgtatataaggggttgggggtatataaagatttaggggtcctcggtgtctgtggtgacccggtaatactcgcagacacttgggtgtggcccatggtctgtgtgtcctcacgacgttcgtgagggggccttactactgtcttggactaacacacctagtacaggcggg

SEQ ID NO: 608894 - DNA, 904 bp, Homo sapiens
  misc_feature (40)..(40): n is a, c, g, or t
  misc_feature (60)..(60): n is a, c, g, or t
  misc_feature (62)..(62): n is a, c, g, or t
  misc_feature (248)..(248): n is a, c, g, or t
  misc_feature (274)..(274): n is a, c, g, or t
  misc_feature (392)..(392): n is a, c, g, or t
  misc_feature (405)..(405): n is a, c, g, or t
  misc_feature (435)..(435): n is a, c, g, or t
  misc_feature (455)..(455): n is a, c, g, or t
  misc_feature (475)..(475): n is a, c, g, or t
  misc_feature (590)..(590): n is a, c, g, or t
  misc_feature (617)..(617): n is a, c, g, or t
  misc_feature (661)..(661): n is a, c, g, or t
  misc_feature (667)..(667): n is a, c, g, or t
  misc_feature (671)..(671): n is a, c, g, or t
  misc_feature (682)..(682): n is a, c, g, or t
  misc_feature (690)..(690): n is a, c, g, or t
  misc_feature (749)..(750): n is a, c, g, or t
  misc_feature (798)..(799): n is a, c, g, or t
ggagctgggggaggattggtggcccgcgaggctcgtcgcngacaacgcggcggcgatgtncncgagccaggcgagtgccgcggcggcagcggcggggccttgcgcgcggcagggcggcctgggcttcggcctccctccggttccctggaagcgggcccgcgaccagcgcgggagcagcagcagaggcggaggctccagcgcgtctctctcctccccctcagcctgagccgggggaagccaggcggccngggtgtctggaggggggggggtccgntgcccgagaatgggaattctcttcactagaatatggagacggttcaatcaccaggagcacaaagttatcatggtggggctggataatgcagggaaaactaccattctttaccaatttnctatgaattgaangtggtacattacatctcctacaataggaangtaatgtacgaagagatagntgacttaataatacacgttntcctaaggtgggatatgggtgggccaagaatctcttcgttcttcctggaacacttactatactaacacagagttggtaaatacgtggtgggacagtacagacagagagaggattnctggtaactagagaagaactctataanatgttagcgcatgaggacctaagaaaagctggatggctgatttnggctantaancaagatgttanagaatgcntgactgtgcagaaatctcccagttttggaagctaacttctattaaagatcaccagtggnntatcaggcatgctgtgctctaactggcgagggatggtgccagggactnnattggctgatgtcgcgacttagattagatgatctctatgacctcttctcatagatttgttaaatgaagtgtggatttacctgaaagctgcaaattaagggttaga

SEQ ID NO: 608895 - DNA, 471 bp, Homo sapiens
  misc_feature (30)..(30): n is a, c, g, or t
  misc_feature (38)..(38): n is a, c, g, or t
  misc_feature (46)..(46): n is a, c, g, or t
cagaccaaggcagggccagaggggacggtncccgaggncagcggcnccggaaacggcaacaggcacaactcggccccggaacatcccggaggccccggggcctttagagcccgcgaagggctgtctcctcgggcgcggcggggccggggctctcagcctcgccgccgacctcgggaaaagccccccagcctctccacccggcagctggaggaggctggtccggggctggggacagcgggatcgacccgcctggggctaggccgacggctggggatcgcggaccgcggggggcgcacgtgcgagacccttttcccggcccgcagggaggcaggacggagccccaacttcaggcgccgacgccgcgtcccgcccggaggccgccggggagggccgagtgcgcacgcgcctgactctgtccccacggcgcgcccgggggcgccggggccgccctgtgattggcccgggcggccg

SEQ ID NO: 608896 - DNA, 184 bp, Homo sapiens
attctgttcatgtgttagtagacagagaatgatggtttccagcttctttgcagcgtctgtgttcttccaatagttcccagccgcactcttttggacttgagtcacatagagggaggcagaggaacatgaaaaagctgcagttaccgtcccatgatgggcaggggctgcctcagagctgagctga

SEQ ID NO: 608897 - DNA, 1791 bp, Homo sapiens
gtttatagtagtcagtcatgtaactcattaaccctaatcactagagttaaagcaaaaaacaatgaagtgctcatatgtaattgaacctacttcagatcacatgaaaatgactgatttaacatttaagtatcacagccttaaaagaaaaagaaagtaaaccagtcctttgtcattcagttacctaatggggtgccatcaatcaagctgcgcatacagccctggcagctcagtcagccacaccttcctgcatcctcattggccttattcattttacaatgcagttaatgaatctgccagatctgtgaatgcatagagcattcatgctcaaattacatagctgattctttgtcgtagtgtcgggacatctctgtagagcaccttttctttcttagcactaagtcacccagtacaatagtagtgcaactgcatccttccacacttcaggctatctctatcaggcaaacagacgacttcctagtcatcaggtgtcctactggggcaccactcactccaccaactgtccccgtcaccttaaatgctgccaaactaatcagtatacataaacggacacggacatggcccaactcagcaagaacagagaacaagggagaaaacaagactcacccgaacaccatcatgtacacgaacacgacggcacacggcaaacagggcaagagacaaaaaaaaaaggaaaaaacacagtgacgaaacacaaagacaggcagacaggagagcaacgagagaaaaaaagaacaccccccacacggaccacacagggcgaccaaggactacaatagtaaacaacaaacaaaggcaccacagcaagacaaacaagaacaaaaaagcgacacagaaacacggccaccaaacaggcaggccgacacagtacacagcaaacgacacaccaacaaacaaaaacgagaagcagagaagacacagaaacaagaaaacaagagacgacagaagcagagcgagggaaacgaagcggaaacagagcgcggaacgagaaaggagaagcaccacggacagagagcgcagaaggcacgagagaagcagcagccagcaggagagagaaggcgacagacaaggagacacaagaaaagcaggacaggacgagagaacaagggtgaagagggcagcgaagagaggaagacgagaggaaacagaacagaagggacgagcagagcacaaggaggcaacaacagaagacagagacgaacaccgcagggagaacagacagcccagaaaacaagcgaggagaagggcaaggacgagacgatgagagaacgggcgagggacacggacaaacagcagacggagaacacgcacgaagacagcaaggagcagacagaagaaaagagcgagaagcccgaacagcggagagagaggaggaaaagacaacggagagaaggagagggaaaagcacggcagaaaaaggagagagagaggaaaagcaaagagaagagaagagaaagagcaagagagggagggagcacacacgaagcgcgagcaaacaagagaagaaagggcaaagcaaccagagagcagagaaaagcagaaacaagaagaggaagacagaaagacagggcaaccaaaacacgaggaggcaaaccaaagagagaacacaaaggcaaacagaaaagacgaagacaagagaaagcaaacacaaacgacaacgaacaagagacgagagagacagacgaaaaagagcaagcaagaaaaaaaacgaggacagacgagacaaaaaagaaaagagagaaaaaaagagcaaagagcaggaagaagagaggg

SEQ ID NO: 608898 - DNA, 324 bp, Homo sapiens
ttacctgtgattgtgcatgtctgaagaataggccccgagcactggcacactggagggaataagtaatgctctggcggcaatggtgcactatgtagggcttagtgtcatcatcctcgtcctcatccatgtgctatgtacatgttaagcaactggggcagatagaagtccacgtcctcgttgcgaaagcagaagagccggttgccaatgtaggcttgtactccaggctccttggagttatacaggtatgaaatggccatggagatgtcaaacagttttgactcaaacagcctcagcagccaagactgtttagctgagttgttctgc

SEQ ID NO: 608899 - DNA, 240 bp, Homo sapiens
actctcctctgctgtaggaaggcggtagaggggcggtgggacccaggccatcaggagcgggatgccaccgagttctcaaatgaccttgttccgccctggcccttcctgtccggcctccagtggtggcaccgtgatctccacccaggtgcgtgaccacccccatccccaccaatcacctcatgcgagattctacgcagagtgggagtagagccagtgggcctgtgtgggaccccagggtgt

SEQ ID NO: 608900 - DNA, 125 bp, Homo sapiens
ggttatgtactatactgctagtactagacaagatattgtacataaaagaaaattttttgtctttaaatagatacaaatgtctatcaactttaatcaagttgtaacttatattgaagacacattga

SEQ ID NO: 608901 - DNA, 427 bp, Homo sapiens
ctgagtttccccagaccaccctcctcttccctacactggccgtaaccgtgccgggacacaggtctctttgcctttgcttctttgtatcctatggctgtgactggggtctgatcattaaattacatgacttttaaggccagggagctgggcacgggtgctcacacctgtaattccagcactttgggaggctgaggcgggcggatcacttgaggtcaggagttcgagaccagcctagccaacatggtgaaacccccgtctctattaaaaatacaaaaaaattagccgggcatggtggcgggcgcctgtagtcccagctactcaggaggctgacacaggagaatggcgtgaaacccggaggcagagcttgcagagagccgagatcgcgccactgcactccagcctgggcgacagagtgagaatccgcctc

SEQ ID NO: 608902 - DNA, 181 bp, Homo sapiens
ctacttttcaggctcagaaatgggtaaaatcacaggacatctctcttcccaccaagaaaaaagttgcatattttggtaagtgtttgtcctagagggaaagatacaagctgaatatttaccttatgcagtgctggtgcaagattctctacataaatttcaaagaccgtagagacctagcggg

SEQ ID NO: 608903 - DNA, 136 bp, Homo sapiens
ttctagctcggtacccccctgtcaccttgtgctcctgcctgaaccaagaatagtccaagtaagttccactccctcatagccactaagctgttgcccaagctactccctcttctagaatgtgtcctttctatctgat

SEQ ID NO: 608904 - DNA, 238 bp, Homo sapiens
gatccctaatgttagccacggggtttctctttggcggtgatgatacggttctaaaatcgattatggtaggtctagcatggtggctcacacctgtaatctcagcacttgggaagccaaggcaggtggactgcttgagcccagaagttcaagaccagcccaggcaacatggcaaaacctcatctctacaaaaaaaattcaaaaaagtagccgggcatggtggtgggcacacattatggag

SEQ ID NO: 608905 - DNA, 406 bp, Homo sapiens
gaaatttctgtaggatttttattgggggcacctggggccacatggagggagtcctcacctcatgaccttgaaggagggttaatttggaagcccctcctgggatgtcaccctttaagtcctcatgagtcaatcttgagattctccttcactttcttgaatgtctcttgaaaccactcccgcatcttggcagaaagttcacttttgttgatgcggctgatgagttcccgagcctttgtctccagtgtgttttcaaactcctttagcttatccaaagcactggagacgtctggggtccctgtgaatgggcttggccttccaagacgatcgacagaaccaccacacagacccgggagcgacaggaaagagcctcattgcgaggccggaggggcactcttaatccctgctg

SEQ ID NO: 608906 - DNA, 267 bp, Homo sapiens
ttccgcgagcagagccagccgactgtggggctgtgggccatggagacgtgctggctaggccagactgcctgctgccctaggtggggcctgctccctgccctggaagctagactgagtggagactcaagcactagagtggggcaatgggatgtgctgtcctcctgcagcaggaggaggagcacacgaaccctgaccctgctactcggtgcaggccactccaggccttgcttctctaacagcccctgtggctggctccagagctgcctg

SEQ ID NO: 608907 - DNA, 396 bp, Homo sapiens
ggagcatcctcagctcagtcacatcctcaacccacccacccatgcccaggggcagttgttaaagagatgtggggccaggcacggtgtttcatgcctgtaatcccagcactttgggaggcagagaccggaggatccagaccctgtctctaaaaacagaaacaacaggagtctgcgcacagtgtgctcagcgccgtgttaatcccaagcatttgtgcggaggccaaggggcgcagatcattttgagatcgcggagatccaagaccagcttgctcgacaacagtgaaaccccatctctactagaattgcaaaaatatagccccgctgtgtgttgcacgcctgtgttccccaatactcgggaggctgagcggaaagaatcacttgaacccggggaacgag

SEQ ID NO: 608908 - DNA, 425 bp, Homo sapiens
agcgggctgcccggagcgctgagccgcgggagcggagccggggtgagcggcgcgtgctggaagatggcgagcggcgggatgagcggcggcttggcggctagggcggtcctgtggctcatgtgcctgcatgcggctggggagctcgggacccagggcggctcacatcaagaaggcgggaggcgactaccacgaattacgagcgcgggcgccgaggtggtcgagggccagttcgaccgttacttaccagtgaagaggagtgggagtcggcgctgagggacggcggaggcctgcgggtcgtcctccggtcgtggtcccgactctgtgaggcatcggcacgctctggtgtgaatggtcgtgccgctgtgggtgtcctctcgacctcaccgccggacctggggtcgcataactcgctgagggcgacgcgg

SEQ ID NO: 608909 - DNA, 308 bp, Homo sapiens
cattctcaggttaagccattctaagtcacaggatgatataggaggtcggcacaagatacaggtcataaagaccttgctgataaaacatgttgcagtaaagaagctggctaaaacccaccaaaaccaagatggtgatgagagtgacctctggtcgtcctcactgctacactcccaccagcgccatgacagtttacaaatgccacggcaacgtcaggaagttaccctatatggtctaaaaaggggaggcatgaataatccaccccttgtttagaaataaccacaaaaatgggcaatgagcagccattatt

SEQ ID NO: 608910 - DNA, 517 bp, Homo sapiens
cgggcaaagcaagtcattggcactcccttctagcagcaaccaaaggactgaccttggtctcgtcagcatggtcagagtacgtagcctgtatactcctcctctgcctggcagtgactctgtgtgtacaagtccctccctgaccattcatgttctggaagcaaaagtccgaaggtggagttcctacacaggatgccacgagccgcatcacgagtggtcagtgtccatgtaccatgtccccaagtatagagccaggccgctcttacagtgttaagtctgccctcagaatgcaggaattgctgccagcccgcaccaagcgcttccattcctcaagagagactgggcgatcaattgccctgcgtcatggtgccaagtgggcttggtcttgtcttcagccagtcaaatatgtgtctctttactagaaggagccggcagcgtagggaggggccaggtgtagaccttacttccccgggtagcgcgtgacgtggcaatagaataagatcagatgccccccaagaat

SEQ ID NO: 608911 - DNA, 385 bp, Homo sapiens
  misc_feature (281)..(281): n is a, c, g, or t
  misc_feature (294)..(294): n is a, c, g, or t
  misc_feature (322)..(322): n is a, c, g, or t
  misc_feature (334)..(334): n is a, c, g, or t
  misc_feature (359)..(359): n is a, c, g, or t
  misc_feature (376)..(376): n is a, c, g, or t
attatcgcgtccggtgagttgttgatgacattcgctcccccacgctttgagatcgagcattgcgccgtcgcacaccgggagcaatttttcccagccggtttcgctcaacatgccgttactgtccaccagacaggtgagatggcgcagttgcggatcgtttttgatagcagtaaacagcgccaccacaaacggcagctgggtcgtggcttcaccgccactcaccgttatcccttcgataaacagcactgctttgcggtcatggctaagcacttcggtcacgntcatggattgcgncatggggtgggcatgttgcgggcacttnttcaggtaggtntcacactgttcgcaaacccacaggngttccacacaattttgncgtaaacaa

SEQ ID NO: 608912 - DNA, 3199 bp, Homo sapiens
aatgaatgcatctaaggcacttagacaggacctggcacacagtaattattcaacaaatatgttgtcactattgttataataacagaggtgaggtttctgtaggtgattcagcaataggaatcaactctatgttgtttgggggcactgaggatgatatcaaaaggctagagtgttattttctccaattttacattttggctagtccttgttgaacacagagcagttttttccaaagttatgtcctaaatcaagtcatgtcaaatgccattgtttaggttctgttcaacagccatccaatgagcacatattaagtgccagactctcctaatgaacactggggagatttaaatgtatgagaaatgacacatcccccatagaagtgcatataatttactggagaagacaggcttatgaacaaattatttcaaaacaatttcagccaggcatggtgcctcatgcctataatcccagcactttgggaggccaaggcatgaggactgtgctgagctcaggagtttgagaccagcctgggtaacatagcgagatcccatctctactaaaaataaagaaaatcagctgggcgtcggggtgcttacgtgtagtcccgcctactcaggaggctgaggtgagaagatcgcttgagccctgcagttgaggctgcagtgagccatgattgggccattgcattccagcctgggtgacagagcaagaccctgtctccaaaaaacaaaacaaagaatttccatttggtcattactctcataggccatgacaatctcaaaaaagtgactcaccaattcataaaatatttgttcctccttgttatcaccttcctcactactcatcttctgtcctatttatgcctcctcattaatagatgagaggagaggaggaactggggaatggtggtgaggaaggagcagagaaataattattttagtgaaaatgctaacaactaagtataaaccaatgcacagtgtacaagtgcataatgagaaaacatgcttaagatatcacatccctccctgccatgccattcttgagaagtgccatgtagggatacatgttatgataaagcaaatatacagcattggattttttttttaaggggtctaatttcaaccattgtgctttaccgttccagaaagataagagattgtaacccagaagaagtgaagtttataagctcttcttactggtttgccatccaggggatactttacggaaagcctagctcatagctatttaatagtaatatcaggctgggcatggtggctcacgcctgtaatcccagcagtttgggaggctgaggtgggtggataacttgaggctaggaatttgagaccagcctggtcaacatggcaaaacactgtctctactaaaaaaaaaaaaaaaaaattagccaggcatggtagcacacgtctgtaatcccagctactagggaggctgaggcaggagaattgcttgaacctgggaggtggaagttttggtgagctgagatcacgcctctgcactccaacctgggcaatagtgtgagactccatctcaaaaaaaaaaaaagaatcttccaagcaagcactttacagttgagagacatgttccctataataacatcataagaactttaccataaagctgtgaactaggcaaaggtagacattattatattccttctttacataaatgaaatggaggctcagcaaagtgacatttcaaataattagtacagaagacttctcattatttgaacttttttctacattaattccaatttcattttgttcttaattttgccatgtttctaaaacagagtggttcctaaggcaagaggaaagccaacctagaagggaggacctgggaaatagcaagctggtttagcaactacacagagcacctacaaaggcacacatcaggcagggcgcggtggctcacgcctgtaatcccagcactttgggaggccgaggctggcggatcatgaggtcaggagttcatcaccagcctggccaacatagtgaaacctcgtttctactcaaaatacaaaaaattagtcgggcgtggtggcaggtgcctgtaatcctaactaatcaggagtctgaggaaggagaattgcttgaatctgggaggcggaggttgcagcaaactgagattgtgccactgcacaccagcctgtgggacagtgcgagactctgtctaaaaaccaaaaaaggcacacatcatatatgcagaactgaaaaatttcaaaaggcagcacttcgtatttttaagagatggactaattactgagatatataccatcaaaaaccaaacctgatgacaccttgactcgacaaaacttgcaggaataagaggtacctaggtgggtgtggtcactggtgaccagtgggaatggcatgaattcaagtatagctgtcatctcagtcttcctgcctcatcaagtcaagtgcagcgtgttctaggagaacagcatgcttgcttgtcctgatagcaagtggttctgcttgtacctgtaattgttacatggggtcaaaagttaagagctcagactttacagaacaaaggaacaacctgcccaaatcatctgcatttcaatttactcttgtgaaaaatggaatcagaacaaaacttgaaaggagagatcccattatctttattgcctaatgtcaagtaggtgttagggctttttaaagagatgcatggaagtctgaaagaatgtcaccccagtagccaagtaatgaagcaggaaaaggttgaaaatggcctatatcccacagtgggaaagaaaagacaggctgccttcagccccaactcttaactaaagggacagaggatgatcaagttagagcttaaatattcaaataggtgatttggtgatatcttagaacctctgacatcaatagagcataagaaagatatatttgggggccaggcacagtggctcatgcctgtaatcccagcactttgggaggcggaggcgggcagatcacttgaggttaggagttccagaccagcctggccaacatggcaaaactccatctctactaaaaatacaaaaattagcaaggtgtggtggtgtgcacttgtaatctcagctggggaggctgaagtaggagaatcgcttgaacccggggggcggaggttgcagtgagccaagatcacaccactgcactccagccggagcaacagaatgagactccgtcta

SEQ ID NO: 608913 - DNA, 105 bp, Homo sapiens
aggtatataccctccgttctacttctatgcctttgttagtcttgtcctgctctgcgttctaatgtgtctcttcatctccgttctcctgtgcgagtccgctgcttt

SEQ ID NO: 608914 - DNA, 226 bp, Homo sapiens
tttagcgattgcccccacccaactctgcatacttaccatttccaaactacggtttaaaaatctactttatatccaaaaacagtaacactgacattcctacccctattttcaagggagacagagtcaaggtccattcaaatctatatttacccaacagatttagacaacatgttttaaccatccaaatcatacaggttttcacttccaaatccaactatcagccagg

SEQ ID NO: 608915 - DNA, 978 bp, Homo sapiens
catggtgagtcaggccggggaaaggagaccaggtggttggtgagagtcttggcctctgggtatgtgctcaggagcccttctcatgagtcctcggacgttgtggacatgcctaggttctgatgagtcagaatctgttgtgcattgtccaacatgaggcctctgcctgggcgtcggttacagtctctgtgttcttggtagggcattcacatagatcgtggccactatggatctgagcatcccattatgctaccttccagcctccgtggctttgttagtgagaagtgccaagacccattcgtcattcctcttcccaccatacttgcctgcgaagagcggtttgacaggacttgattctcccaccttcttggccttatgtatatttcagcatagtagatgtacttaactacgactgtcgagacacttttctcctgttagttggcgcatacgtgttgggccccttttgcaggcctgaaacttttgggcccttatggtttgtatgataaggcactaaaggctaggaatttatccactttaccgtgatgtctaaacgatgggggatttatatatcgagatgtgggtaaagagggggcggggttcttgaggggtcatgatcagaggagcggatccaacataaatatgttgaaacaaaccccaaaatggccttatttggctctaagttgacccgtttaacccctcgcgcaggttagtcccgagcgccacggtctccatgccctcgcctttgtcaccctatagatggagataacgactgtggtaaacccgtcgaacaccaattttatgtcggggtcggtcgatcataccttagttgttctgtcttcaaggaacgtccttgaccacatagtctggactttcattacgtactttgtttacatccaggttcccatccatttttttcaataaccgttccattagctagtcaacttcttggtcttgggattaggctcgtgactgtgtcgacaa

SEQ ID NO: 608916 - DNA, 1281 bp, Homo sapiens
cccacagagtaccgatatggccctggcatacgtgaagcccccatgagtacgctttactactagttgcgcgtctatcgacccagtcatagcacctgattaacatcatcaagatgtatcagcgtgacgcatcgcctacagcaatacgcccgaatagcaaataacaccttgataaactacaacggcataggagaatagccataggatatgaacgtaccatattctggatatactgtctctcagttgcattagtctccccacatccaactcactgaagagcacaaactctgcgcgcaagtaccttgctgcatttctaatattcaccccatactatatcgcatcctccaaacgggtccaaaatattatacgtttgatccatacatatacgcatgcaatactatataccatcgtaacactgaaacattcacttgggtttataaatacctaaaagcatcaagaccgtacagagattaattacaaattcggatcaaacacgcattaataataaatttacataagtacgtgtacttgcaggccattgaagtcattccatatgaatcgcttaggattggataccataaaaatacaattaaaatgactcaggcgcgcaacgaaaggtaaagccctagccttacagggaactggctctgtcccgtaaaacctctactttttcttagcgcaacatgcaaatcacatgaacataggtgcaaaatcaagcttctacacccaaatgggtccaatttcccccacgttaaatgtaggccgcgaacagcccatgaaggatttggttgaacggtcttcccaaggtttcgggacaggacatataggctagaatgcgcctcttaagttcctagctgaactataaagcgaacaaggcgtggcaattagtcgtagcacaactccgttagtatccccctatttaccttgatgggaaatttacatacagcgaaacagcgcaatccatggtccctatccgcgggttgaccataacttcaagatagaacgccttgggtcgcgataactgggccataaatcccgggtttatcccagtgttgacaattggccgtgggcgcaatcctttacaattcactgtcgaacgcataagaatttggcgatggggcggccaacccacttagggcaaaactgaggataaaaggcccaatttttaccaaggacaattatcccgtttacgtcataaccgggtgtatttcaaattctctggagagagaggttcgttaaaactatcgtagaggttggaacacaaaatacgctatatcgaaccag

SEQ ID NO: 608917 - DNA, 245 bp, Homo sapiens
cttccccctgggttcaaagccattcctcatgcctcagcgtccccaagtagctaggattataggcaagcaccaccatgcccagctaatttttgtatttttagtagagacggggtttcaccatgttggccaggatggtcttgatctcctgaccttatgatccacccaccttggccttccaaagtaatgggattacaggcgtgagccactgcgcccgtcccagtttcttttttaatatattttttata

SEQ ID NO: 608918 - DNA, 1083 bp, Homo sapiens
gatagcaagaggcaagaaaggaacagtctgaggtttgagtctgacccatggacctctttgtggtcaaaaagtgatggggggaggacacaggatgaaatggcttgagatgtggcaaaagcttttcagcccagccaagggtgctccatggcaagcgctggggcacctctctgggagaggaccttcaccaaggtcagacgatgaacagcagtgctcggggacctgggtgttggcggctgcagcctctgggatgaccctgctcgcttcatcgtggtgcccgcggcctatgccttgtgcacttgggcctgtgggctgccagtcaatcgtggcggcctgtgcaatgttcatcctgacgcggctggcgcgcctgggccaggccctgcttctctacctgttcaccctgcgctctggtttgctgcagttctctcacgctcacgctgcccgctgtgcgctcacctactacctgggcctgagccggaggctgtctgccactgcggccggggccacctactacgtgtccacctatgcgcgctggtggcttccgccgcgctcatcacgcgtgtgccgctgccggcttcgtacagcggtcccagggaccagggccggctcccgcctggcccggtgctacaggcgcaccgagtgctgctagactagcgcactaagccctgggctggctcagtgccttggccccttcctctgcttggaagcacctgctgcgccaccgctccgcgctggacttcggccagtggagagccttcgatggctgcctcctgcaaggatggacaaacggcaaaccgacaacgactgagcaagagcgacacaaggagccatcatagccatggagcccaggcgcctcaaccgccaagacgcagcccgggagccaagacccaacaacaatagagcccgtggccccccacgacattacgccacatcctctccgccaacaccctactgccgcaccccactaggtacgcgcagcaacaaaacgccaagcgccaagcaccctctagcgccagcctaccaccaacagcggccagagaggagacaaacgcagacgacacagcacgtgcggcatcgacaaagaag

SEQ ID NO: 608919 - DNA, 251 bp, Homo sapiens
acaataatacttaataatgtactcctatcactcttgatgtcttatagaaattctcgccatcaacttctcacggtggcgtctcaaaaccacaccccatatccgacgactcaagatttcataatagacattgcttgaccactctctctatctaacgacagtgcgactcacccaccttatcgaaaggctcgacacccacgcaagtctaatcttattttaactatgtcccgattaatatacataggcctttcagc

SEQ ID NO: 608920 - DNA, 226 bp, Homo sapiens
tacttctgaaggacatctttaccatcttccaaaagttttctggagccaattggtagccaatccctggcccgtagccaactacggattggcttggccaatagattaaccttttctggcctttcattttaaccggattcttccatttggtagcctttggggtgaaactgctggaaaagtgaattacactgtaaaagctggtaaagtagctgcctaacggaaccaacag

SEQ ID NO: 608921 - DNA, 176 bp, Homo sapiens
  misc_feature (1)..(1): n is a, c, g, or t
nttctgagacatcaaactggacatctgagaagatgatcatgagagtgatttaagaaagaaagacagtggagaattgcaatcgatggagacattcaaagaaaagacttttggcactacactcaaaagagagtacaataagtagccctttgccttatacacttttaacatgaacataa

SEQ ID NO: 608922 - DNA, 418 bp, Homo sapiens
aggacaagacaggcagcacatcggaagtggaagcagcgacaaaggtacctgagaatagtcgacagacacaggttacccccggcccactcagattttgaatgaaagccagtatcgcggggactcatgatgccttcttcgaagccagagaaaatacatgcagtgtatgccttcttcaggcttgacagccccacctggttcaaaggacagcagaagtgcaagcaaagcagcacagcatgcaaccttaagcacggtgctttaagcatcctgaaaaatgagtctccatggcttttctcaaacatagcagaattagcttagcttcaaacagaaatcaggcttcaagttgcaatacatagcttcgttgggttttcagatgcaaacattcaaagtgaatacaaaattcaaatcagctcggggatcc

SEQ ID NO: 608923 - DNA, 386 bp, Homo sapiens
ctagcttttagctataaaccactcaaagattcagcccccagatcccacagtcagaactgaatctgcgttgttgggaagccagcagtggccttgggaaggaaccatgctgtggtcagagagggtggctggcaacacttccggggaaaactccttcgcccaggttctctctctagagagattgttccacaaccctgctcatgctgccttcaactagatcatgtttgccttgcttagagaattactgaaacagcccagtcttgcgatgcatttacagattctaggcctcaggttttgtagagtgtgagccctggtggcagggttggggggtctgtcttctgctggatgctgcttgtaatccatttggtgtacagaatcaacaataaata

SEQ ID NO: 608924 - DNA, 160 bp, Homo sapiens
  misc_feature (33)..(33): n is a, c, g, or t
  misc_feature (65)..(65): n is a, c, g, or t
gaaaaaaaatatagaaataatataaaaacatgnctggcatttcacaccatcaaaaaatcaccctnatccttcattttctgacctatggagtgatgcctgtttgactataagaggtctgcaacccgttatggaaacctgatttaatgatgtgctctgaaaa

SEQ ID NO: 608925 - DNA, 284 bp, Homo sapiens
ggtcatttcagttctagtaaaaaatacaaaaaacaaaaacaaaagatttttatcaaatgttatgatgcaaaaaaagaaaaagaaaaaaaaaagaaaagaaaacttcaattttctgggtatgcgcaaagaccatgaagacttatccaagtgcatgaccggattttggtggtttggttcatttggtgtttaatttgtgtttttttttttccagctgtatgagatgggctttctgaagtttaaatagtccgatttcacccatggtgtcctgtgcttgcagtgcgagt

SEQ ID NO: 608926 - DNA, 102 bp, Homo sapiens
aattcaagcttctaacgatgtacggggacatgaaatatgtgttgttttcatttgcaaatttaaataaagatacataatgtttgtatgagataagaaaaaaaa

SEQ ID NO: 608927 - DNA, 344 bp, Homo sapiens
gaatcgagctcggtaccatgtgttgcttggttgtagtgagctgagatcgcgtatccactccaggctgggcaacaaagcaagactccgtcttaaaaaataaataaaaggaaaaaaacggaaaagaaaattggtttcttccacccagccatattctcatagccattttacaaaagggcatcacaatcaaaattttactgccgtccagcagtaaaagctcagaaggagaggaaaattaggccacatactttttaagctaaataagtggaggccaggctccatagggagcagcaatcccatattctcatacctcttcatacctcttcagtgtgacccaggcaacccct

SEQ ID NO: 608928 - DNA, 896 bp, Homo sapiens
gatgatgtgattccgtcctgtgcggttgtactctggagctccgtgcttattatactcacgatccgcactttctctcctacctaagtgcgtgccggcacccgatggaagattcgatggacatggaccttgagccccctgaggccccaagaacctatctcttctcggttgtgaactaacaggccgacaaagattatcactttaagcgctggataatgatgaaatatgagcaccagtcatcttgtaagaacggctcaggctcaagcgggctggtgccaacagcgatgagcttgcacaatagttgaagcagcaggcaactgaacttcacgaaacggccagctccaacttcacaagctaacacctggccaaacttttggcaactgtctgtaacaagccaaccggttctcccctttggcgggctttcgaacataacaccaccagtggtctttaagcgttgcaagttgtgcgtctcacgggccacgtgcattatcagccgcgacagcacttacgtcgctgtcgcagccacggatgcagcacgtcagaccgatgcacacagcgccaggagcgattgtcaaacactcttacgtatcttctgcaacgcggtctgaccctggaggctggctagccaggcttccacagcaaacagtaacacttgctgctgctcaccatgctgacgagctgctcacgcagcagctgctcaacagctgctgcgccaccgcgaccgataccacacacaccgccccagaacccaccaatcccccaaatcccaccccaccccagccaaccaacccccacccaccccacacaccctcaccccaacccaccaagccccacacacacccccacagcccccgcgcccactcaccgccccccactggccccaccccccaccaccacgc

SEQ ID NO: 608929 - DNA, 584 bp, Homo sapiens
gctactctctagatctgtgaatcttagtggaagggctgagggtttaccggtgttagtcagcaaattcccctgtgattcttttgcagttagctcattcctggacttttcaggaacttaatactcataagaactatagatgacagcaatttttctgtttagatggggagatagaaaaagacatgagggaggtgatgagagtataatggttaaaaggtaacatcaattgagcacaaattaatttgagggaattaagtattaagaatctgaattctgtaagaagattcagttaaaaaaagttaaaaaaagcattggaaaggtccgttaaaaaaagcagaaaaggacagtttatataacaaacacctgtatttccaccacccaacatgaacaaatgcattggaatgtcatgtgttctttagctctttctttctctctctctcttttaaaaaatgtatatattttcaaatggttcggctttgtttttttttgagacaaggtctcgcactttgggaggccaaggcgggaggatagcttgagcccaggagtgcaagaccatcctaggcaatatagtgagacctcatctctat

SEQ ID NO: 608930 - DNA, 924 bp, Homo sapiens
  misc_feature (16)..(16): n is a, c, g, or t
  misc_feature (178)..(178): n is a, c, g, or t
  misc_feature (273)..(273): n is a, c, g, or t
  misc_feature (409)..(409): n is a, c, g, or t
  misc_feature (554)..(554): n is a, c, g, or t
  misc_feature (586)..(586): n is a, c, g, or t
gagaacaataagagcngttgcccaaatctgcctattgcagctgtgagaaggtggtcaaagcaaggatctttcacccacagaaagagagcactgaccccgatggcgatggactactgaagccctaactcagccaaccttacttacagcataagggagcgtagaatctgtgtagacgaanggggcatctggccttacacctcgttagggaagagaaacagggtgttgtcagcatcttctcactcccttctccttgataacagctaccatgacaancctgtgtttccaaggagctgagaatagaaggaaactagcttacatgagaacagactggcctgaggagcagcagttgctggtggctaatggtgtaacctgagatggccctctggtagacacaggatagataactctntggatagcatgtctttttttctggtaattacgtgtgtactctggcctctgcatatcttcacaatggtgctcatttcatggcgtattatccattcagtcatcgtacgtgacttgaaggtcttgacttgtctagaatgatgcacatntcatgtattccagtttgttaatacttattggncgttgatcaaaatgtctgagaataatctttgatatgactggttttaaactaggaaattgacattagcatacaaagatataaacatgctagtgaactatggattttacaagatctgctttgagaacagattgtgacttgatctcattgagaatcgacgtcctttacttatgaaaagatctactatcatgtattttggcgtaagagtagttaccataggtaattctctgaataatccatacagatgcccatcataattatcattggaagctcaggataagcagccgaagagttggactgatactcagaataactttccgtttgtacttggtaaaaaaaaa

SEQ ID NO: 608931 - DNA, 213 bp, Homo sapiens
acaagcatccctgttgggggatcttgacccagtctagagccgctggtactagcccattcttggaaaacaaaataagtactccttaaaaagtcaagtggtcatcaatttattttcgctattaaattgtaagtgtccttctaagaggaaatagttctaacttaggggtaagtgcaagcgctctaaaggtattactgtaaggttaatttactaagt

SEQ ID NO: 608932 - DNA, 667 bp, Homo sapiens
  misc_feature (4)..(4): n is a, c, g, or t
  misc_feature (145)..(145): n is a, c, g, or t
  misc_feature (152)..(152): n is a, c, g, or t
  misc_feature (166)..(166): n is a, c, g, or t
  misc_feature (199)..(199): n is a, c, g, or t
  misc_feature (285)..(286): n is a, c, g, or t
  misc_feature (288)..(288): n is a, c, g, or t
  misc_feature (292)..(292): n is a, c, g, or t
  misc_feature (296)..(297): n is a, c, g, or t
  misc_feature (341)..(341): n is a, c, g, or t
  misc_feature (394)..(394): n is a, c, g, or t
  misc_feature (476)..(476): n is a, c, g, or t
  misc_feature (653)..(653): n is a, c, g, or t
tttntaaaagctctccccggttccccccttctatccctactgctcagttaggccccccgctacctgggaatcggtgcttccccgccacccccatttcactcccacttgtctggggcagacggtagctccggggccgggcgggggngggggcngcggtggcgggcgngttgacagtaaagacattgtagtcctggaaccntcgtggccaccgttggcggctcccatgctctgcctcccccaggcagccctccaggagcctgctgcggggtggggctgtgggggggnngnctgngggnncgggcttgtgtgtttgggggggtgctctcggcctgtcatatgcncttctcaatcttctagaaagaaacccaaaaaagaaagcagacgacgacctcgngacagaggagaaaaatcccaagtgttcacacagttacacggagtctttatggcaaagagaacatttagcagctttgaatatngggcatctcctttttactcaacacaagcattctagaccctataagtgaacagggcacaagcctaaaaaaaatcaaagcgcaagaaattctaagaggactagttcttttgttgttgctgggttgtgtaattttttgtgttttcccagtgataagcccagttgttggtaggcagaggcncgagggaagggtga

SEQ ID NO: 608933 - DNA, 738 bp, Homo sapiens
gccggactggtggctggtctgcagggttgacctgcggcaatgcaagtgctgcatgtgtagtgctgggaccactgaggggtccaggctgattccggctggatgcctgacaggcctgcgccttgacctgagcggtgccccagataggccatcgtgcctgcgggcacgctggtggtgcgtgcaactgtgtgctgtgcatcaacggggacatcgtgcacagggagcaggggaccagcgagcagagattatcagaggaacgaccaacacacccagcagcagaacgctttcttcatcaggacaaagtccattgacccagactgggattcttcaaaggggaagcggatgacaacttcttgcaaggggcccagaggaaacccaagagcattaggggggagcacacaggttcagaatggtacgaatacgggctgaacaaaccattgtgttgccatagtcaagacccatggagagagcccagggggtgacaaacatcaattgtgacccccggagagtttcggccccaccgagggagtatgacctatgtgcactgaatgtgaacgcaacagttttgcaagccacatgggtaggaagaggggaaaaacgcttggatagacgccataattatggatcgccacgatgggatcccatggtaagggaaggccagcatgtattaatcgggatacggaggtggtcctattaaccaagggtgcaaaggggatggggggccgccataaggcacgaact

SEQ ID NO: 608934 - DNA, 278 bp, Homo sapiens
caggtcattctcatggtacagatcttccactgtctagtttgcagtatcaaacaagcccgttcacatgagtgggcacgggatatgagcagacacttctcaaaagaagatatttatgcaatcaacagacatgtgagagaatgctcatcatcactggccatcagagaaatgcaaatcaaaaccactatgagataccatctcacaccagttagaatgtgcgatcgattaaagaagtcatggaagacaacgaggtgctgtgcttaggagactgctgtcagggc

SEQ ID NO: 608935 - DNA, 170 bp, Homo sapiens
tgactcgattctcaggtggatgagaatacagtgataagcaaatcttgacatgttaccctaaaataggcactataaaatagactgtacgcttggagatacgatatagagttgacctgccctgcaagggttacgtggccgttctatctcacacagttgtgtggtgctatcaa

SEQ ID NO: 608936 - DNA, 768 bp, Homo sapiens
  misc_feature (268)..(268): n is a, c, g, or t
  misc_feature (426)..(426): n is a, c, g, or t
  misc_feature (475)..(475): n is a, c, g, or t
  misc_feature (673)..(673): n is a, c, g, or t
gccctccacctctgaagctacaatcacgatgaggatgaggaagggaaattaccttgatgatatcatgaagctcttggagcagtcggagtggctgccaacaaacgtggattggaacggggtaccgtatgtcaaatggaacgcgtggagtccaggcccagccgtcatgctgcgtatggaaggagcgtgttagacgtcgtacacgggagggagccaggaagacttgacgaggcgccagggtggggagtacttggggctggagctcgtacangcgtgctcattacacaggagtccttggaacggagacagtggaaattggccactccttggcgttggcacacatggcctttgctttgcatcgctcgccatgcttcgcgaggtgtcgttcgcccttcacgacttcgcaagggcccgaatgttcgcgctgtnttgtcgaacgctgcttaggcgatgcggtcgctccctgtgtggccctccntgcgtatcactttgcacatctttatgcgcgcatacgacaagtggaccgcctggtggctagtctcaactggtgggttgggccagtaagtatgggctggtcgacggatggataggtcgtgggtagctttcgtgggtagggcaccgcgccttcgatagccagcctctagagggtgtgttggagcccccccgacagtgcgcntcgacgaggtgtggggcgcacttgcgggtggccgctcctctttcaccttggggggcctccagttggggcacttctttccagggggggccctgtgt

SEQ ID NO: 608937 - DNA, 226 bp, Homo sapiens
cagacacgtggcagttgtgtgctgaagattggggaacacacccccatcagaccctcgccatcatggaaaatgccaatgtacttggccctgtaatgccagtatctatgccagcagaatgtgcattgttgcccatctgtggacgcctgagatcctccctagatggggaccatgactatgaagcgctgccatgtatgttgaccgagacaggtgcttggcttgcttgtct

SEQ ID NO: 608938 - DNA, 92 bp, Homo sapiens
ttagtgaaaccaagattaattccttggcacacctggaaaaaaaggaacccggtgggggcatttacagtggtttcaaaaggcaaataattaag

SEQ ID NO: 608939 - DNA, 532 bp, Homo sapiens
gttctctcagtgtgtcaatcacacagcacgcccgacatcaagtcccattatgccttccgcatctttgactttgatgatgacggaaccttgaacaaagaagacctgagccggctggtgaactccctcacgggaaagggggaggacacccggcttagtgcgtttgaaatgaagcagctcatcgacaacatcctggaggagtttgacattgacagggatggaaccatccccctttttgagttccagcaggttatttcccgttttccagactttgccagctcctttaaaattgtcctgtgacaacagccccagggtgtgtcctggccccctgtccaaaaacctttttattgttgagctgtggccaaggtcaagcctgtgttgccaggggggccccaattgccccacccctgaagtggggttgttacaccctccccccgggcagggggggcccttgttgtcagggcctttcctcactggtgttgtcattgccccgtttgggtttgtactaaccagtaaaaaaggtttaaaagtttga

SEQ ID NO: 608940 - DNA, 800 bp, Homo sapiens
taaagaggtggtgtacatctccactagctctccttacactagcaggtgtctcctctatcttacaggggccatcaatttcatacacaacaattatcaatataaaaacccctggccataaaaccccaataccataacaccccatctatcgatctagataccgtcctaaatccacagacagatccttaacttctacctgatactcatcccccagtccctagactagctagagccttcacatcatacatacatcaaccaagaccctgcaaaccgtccaaccaccaacctattcattcagaccaccagcaccggcaaaggggcagaaccacccaccatcattccagagggtacccgcagctaccgcaatttccataaaatacctaggtcccctaagactagttataccttgaaatattaacaacccaacaaaggaacaattacaaaaaactaaaaacacaataaaataaaaagcgtaagaagcagaggataatataactaatttataaacggagatataaaaaatgggacttcagaggttaatataaaaaaaagaaaaaaaaaaattaatctatatatattatataataatagagaataaagaaaaagagaataacaaaaaataactaagggacataaagttagagaaaaagagaaatataaaagagatggtaacatcaatataaagaaataataaaatgaatagaaataaaaaaaggtggaacgagtgtggaaaatgagatgataaaaagtggtaaagagattaaatattaaataaagataaaatgaaatagaacaaaataaaa

SEQ ID NO: 608941 - DNA, 127 bp, Homo sapiens
atcatactcgtaccgatagttgactggtatgatggagcaacacacctaaacgttctcgctcttcctgagggcaatgtcagtccagcatagagttttacaatttgatagaaagtacctcgtccattgg

SEQ ID NO: 608942 - DNA, 334 bp, Homo sapiens
gagacggagtctcgctctgtcgcccagactggaggagtgcagtggcacgatcttggctcactgcaagctccccattccaggttcaagccattctcctgcctcagcctccagagtagctgggattacaggtgtgcgccaccacacccagctaattgttttgtatttttagtagagacagggtttcactgtgtaggccaagctggtctcgacctcctgacctcaagggatccacccgcctcggcctcccaaagtgctgggattgcaggtgtgagtcaccatacccagcctgtgaatgcttgctttattcaccttttttcttaatgacggtcgacgc

SEQ ID NO: 608943 - DNA, 1466 bp, Homo sapiens
ggaagtgctttgccccaaggttgtgtatcattgtcacgcgcagctgtgtggtgtgtggcttagatgccgaggctgtagatccttgcactgtagtgcagactcgaaggttggggacgcgtcaagagactgcactggaggagggcgaggcacgatgcattcatgccaggtcgccactggcagggctctggctgcccgtccggtcaaatacactgtaaggttactggcctagccacgcgaggtcagctcgttcgtgacatcgaagggaatcgtgagaacccttgccgtcggggagcgtgacttgtttagtagggcagtgcctgtatttaaggttagagaggggttgcaaaataccgaggacttgcgtacctaactaactggtcgtggaagaaataggcgtgagtgactaacttgtacgaacgtaagattgttcgtggcttccagcatagcacacatagtggagcacgctctagttcagcaacattacgggacaggccttgggtgagccggggtccccagtggggcaagcactggttgtgcatgggtgcttaaggcgagtaagcacagagcgaactgcacggatagtctgggtgcctgtgtcaacataaccataatcttgtgtcaacgatgtgttgatctcatcaagcgggtatagaagccacgccgtagagcatttgtacgccgcccacgaggtcatggtgactcgtccaagggggtatcggtaggcacacctcgacgcaaggcagtttacccagcccagatgggacatggagacagtgggcccattttgtgaaccccttgagtgatacacaaaccccgggatgggtgtaagtgcacgtgggctagaaattcatttctggcggcaacagtttagcacgacgagacttataacaaacccgtggagactccgggaaaattcgaccgcgagagaatcagttgaggaattcaccaccgtgtgggccagacccgggtacccatacccttcttaaaggccgtttgcgactggctctctgtgaagcaactttattgcacacgcaaggactcccttcccatggttcacacgaaatttaaggctgggacttgtgaaaacataggacgatgtgtgcgacctgaaagcgatgtccccagagagtaggcgcgaagtactcaagggaacactgactgaagacatacagagcccatgacaaagcacagcacacacaggtcatcccgcagacgaagcgggcacaagacagagtgacatgaccgtaccataggtgtccccccacattgagcaaacaggaaagaaccgagcaatgagagtgcactcgagggacccaatacagggggcccgaacccagcggagggcaagcgagtagatcgcgacaaagagacaaaggccgggagggcagagggcacaccacctacaaggtgcgaaatgacaggccgcaaacaaacggaccaagccaatggaaacacaagggacaacg

SEQ ID NO: 608944 - DNA, 821 bp, Homo sapiens
tccaccgtgccgctccttcttctgccgctcctgtgctgctgtgtgtgctcgttgtgcggacctgtacctctttggtgaagcgcaagtgaggagactccgggctcgcaatgccggagaaaagccaaaggaaggagtcaggattggagaacaaaggatcatataatttggaaggtgggggcacaagagatggtttcctgtggtgcagttaaagataaagaggcaatacacccatttagtaaactatttgaagcgcctatttgtgaacgacaggttttgtcaatgacgggcagatcagatcccgatttttgctgggcacccaaatcaattgaaagcagacacatctgcagcagttggacactggcgctttgactgatacaactgtgatgtgtcccaacagcaagacgggaggtgtctacgtgaaaaagggacccgtgttctttactcaagaactctgtcttttaaagaccaagattacttctctcaatgagaaaccgtgcattgttgttccaccacttctgatactaccgtatagtcctctaatcctttcatttccccttccccatccttttatggtacattaaggtagtggtatatggtgacaacgatatggattttttgttttgaaaataaaaaaggccatggtttgtttgggttgagacaaggggagagggggggagaaatctggttgtgtgaaatctccttcccattaatgggtggcataaaggttattttattccaaaagttttggccccgtgtgcaaaaaaacaaataaattggactgtgcaggggaatttgttattggaagcgatatttggcgggag

SEQ ID NO: 608945 - DNA, 307 bp, Homo sapiens
atagttcgagagctgcatgtgtatgggagtgatgtccctgtgagcagccgggatcctactaaatttcagcatcatggatttggcatgctgctgatggaggaagcagaatgaatagctagagaagaacatgggtctgggaaaatcactgtgatatcaggggtcggcaccatgaattattatagaaagatcggctacagattacaaggtccgtacatggtgaagatgctgaaataatggccacaccagtgcactcatttgcaggatcctccctggcagaacacggagaatcatgatttcttaaatactc

SEQ ID NO: 608946 - DNA, 152 bp, Homo sapiens
gagctattgttaggtggttggtttctggacaccacttccgaaggcttttgctaggtgtcgcgagctccagatctccactcaacatttcttccatctgtctctcttgcaaacagtgcccttggatctatcctcaaagcacattcagctccatc

SEQ ID NO: 608947 - DNA, 462 bp, Homo sapiens
  misc_feature (1)..(1): n is a, c, g, or t
  misc_feature (17)..(17): n is a, c, g, or t
  misc_feature (65)..(65): n is a, c, g, or t
  misc_feature (217)..(217): n is a, c, g, or t
  misc_feature (243)..(243): n is a, c, g, or t
  misc_feature (259)..(259): n is a, c, g, or t
  misc_feature (344)..(344): n is a, c, g, or t
nggtggtggccagaccnagccccagggagggtgctgctgcccaatgacattgtaattgtagaaancgtgtgccctgacacaggtctaaggactttcccaaagtatccagtcagtcagtcagtcctcacaccaggattgtaggtactgtcataactcccatttcatagttgacgaaaccaaggaccaaagagaaataactcacatgaagtcacacacntgataagtgatgggatgtctcatccnaagccctgccctcttnaccaagatggccttgtgcctgatccatgtcagaaaacagaatagccgacataaactcatttgttagccaggtgtggtagcccacncctgttgtcccagctactccagaggctgaagcaggaggatttttgagcccaggagtctgaggctgcagtgagctatcattgtgccactgtactccagcctggacaacagattgaggcc

SEQ ID NO: 608948 - DNA, 414 bp, Homo sapiens
  misc_feature (60)..(60): n is a, c, g, or t
  misc_feature (296)..(296): n is a, c, g, or t
  misc_feature (303)..(304): n is a, c, g, or t
  misc_feature (306)..(307): n is a, c, g, or t
actggaggtcaggagtttgagaccagctgggccaacatggtgaaaccctgtctctccttnaaatcaatttagccaggtgtgggggggtaatcccagctggcctgtaatcccagctacttgggaggctgaggcagaactgcttgaacccaggaggtggaggttgcagtgagccgtcatcgcgccactgagccaagatcgcgccactgcactccagcctgggcgacagagccagactgtctcaaataaataaatatgagataatgcagtcgggagaagggagggagagaattttattnaatgtgnngnncttgcccccccccccccccagcaggagagcagcaaaatttatgcaaatctttgacgggggttttccttgtcctgccaggattaaaagccatgaggtccttgtcaaaa

SEQ ID NO: 608949 - DNA, 314 bp, Homo sapiens
  misc_feature (20)..(20): n is a, c, g, or t
  misc_feature (40)..(40): n is a, c, g, or t
  misc_feature (50)..(50): n is a, c, g, or t
  misc_feature (56)..(56): n is a, c, g, or t
  misc_feature (116)..(117): n is a, c, g, or t
  misc_feature (119)..(119): n is a, c, g, or t
  misc_feature (122)..(122): n is a, c, g, or t
  misc_feature (216)..(216): n is a, c, g, or t
tggtggttgaaacaaggaanaacagaattttttattgatngaatatttgnagaatnagtatttgttatgtcaaaggcagtgagattatataaaatgattattagttaattgaattnnanaanagagtggtcaattatagcagataggtgttttttgaagtcggaaagatggcttctcacaggacatagagggaaggaaggtagggagacaaatganttatagtttctctgagggagcctagtctctaccttgctcattatcccagtgaatttcaaaagcaggttggtcaacatagcgagaccccgtctctctcc

SEQ ID NO: 608950 - DNA, 288 bp, Homo sapiens
tcgaccccgtggtagcacggggcggggaccaggccccaggacggcgccccgggtaacccgcccacgtgacccccacccaggcccccaccctgtgctaagtcgcgaactcccggtactacagtgcggtcgccctttagaggggacggcggctttccctccgggccgtgaaggaaggaagaaaacccctaggaggttgtaccgaactgcactcccatacacaggagtcgtacttctcctaccgcccagtagtacacacgctacagtcgccacgtaccggaacgcctcgtg

SEQ ID NO: 608951 - DNA, 795 bp, Homo sapiens
  misc_feature (629)..(629): n is a, c, g, or t
tcatacggaactgtaagtccattaaacctctttctttgtaaatgcccagtcttgggtatgtctttatcagcagcatgaaaatggactaatacagtaaatggtaccaggagtggggcgttgctgaaaagatacccgaaaatgtggaagctacttggaactgggtaacaggcagaggttggaacagttggagggctcagaagaagacaggaaaatgtgggaaatttagaacttcctagagacttgttgaatggctttgactaaaatgctgatagtgatatgaacaataaggtccaggctgatgtgttctcaaatggagatgaggaacttgttgagaactgaagtaaaggtgactcttgttatgttaaagagactggcggcattttgcccctgccttagagatttgtgaaactttgaacttgagagagatgatttagggtatctggtggaagaaatttctaagcagcaaagcattcaacaggtgacttgggtgctgttaaaggcattcagtttcaaaagggaaacactataacaaaatttgaggggtgcattaaagttggaaaatttgcagcctgacaatgcaatagaaaagaaaatcccattttctgaggtgacttgggtgctgttaaagngcattcagtttcaaaagggaaatactgtaaacaaaatttgaggagtgcattaagctttggaaaattgcacctggcatggcatagaaaagaaatccaggcaggcacggactcacactgtaatcccagcactttgggaggcgaagcagggtccattagttggagtcag

SEQ ID NO: 608952 - DNA, 122 bp, Homo sapiens
catgtaaattagtcaacctctgtgcaaaacagtatggagatttctcatagagccaaaagtagatataccatttgattcatgccacgtccacgtactgggcatctaccctgatggaaaatgta

SEQ ID NO: 608953 - DNA, 396 bp, Homo sapiens
  misc_feature (35)..(35): n is a, c, g, or t
ccttaaggtaataaaagccattggcaacaaacccncagccgacgtaatactgaatggggaaatttgaaagccttcccctgagaaatggaacaagacaagggtgcccactttcaccacttttattcaatacagtactgcaagtcttagagcaatcggataagagaaagaaataaagggcatccaaaccagtaaagaggaagtcaaactgctactgtttgctgatgacatgatcgtatacatagaaaaccctaaagactcatccataaagctcctagaactggtaaatgaattcagcaaagtttcaggatgtacacaaatcagtagccctgctatataccaacagtgacctagatgagaatcccatcaagaactcaaccccttttacaatagcagcaa

SEQ ID NO: 608954 - DNA, 389 bp, Homo sapiens
gatcggttcggacctattcgctactacgccagcctcagtccattcgtggaaatcgacggccagtcatatgtatacagctcactataggccaaattgggtgccgggacccccctagagtagtgttatcctcgtccaaaataatgtctccatgcaactggacttgtattgtttattgaaaagaattcaggctagagttgggaggagtatgcaagagctctgtgcaagcggaagctcagtctgagcgtgagggatcagggtagtaggggactctcgccttgtccactgatggggggtctggctgttactcctctcccttcagcacagaaagaacttggtcagtatccatgcctgtgtaagtgctcatgactgctgtgccttgcctgtacaag

SEQ ID NO: 608955 - DNA, 529 bp, Homo sapiens
tggcacaaaagacacaactctacgtgtgatatccgcatcactttacctacatacacatatctcggtagtcctctagctctcttcgccagtctttcatttttgcgtttaggagacagggtctagctgtcacccaggctggagtgcaggggtgtgactgcaactcactgcaacctccgccgtccggggagtcaagtgagtccgtagcgttaggccgtccccaagtaggtgagacatagcagggtgtgcaccacacacacccaggcgtaatttggagtattgagtggggtaaacgacgagggtttcacccatggctgcccatggctggatctcaacactccgggggatcaaggtgatcacgcccacctttggtcttcccaaaggtgctgggaattacaggtcgtgagccaccactgcctggcactctcttcccagttctacagctttctacagacgcactctgagggccgtgtctgcccagtggaggaggcttccgctggtgttctagggggcatctttgggcatgactcag

SEQ ID NO: 608956 - DNA, 858 bp, Homo sapiens
gggatgaggctgtgtcaaaggcgccatgagcaagatcagcgaggccgtgaagctgcgccctgtgcctgtcttcagctcgggcaggaccctgtccgctgcagttccggatccagcagctggaggctgctgcagcgcctgatccaggagcagggagcaggagctggtgggcgcagctggcctgctagacctgcacaagaatgaatggaacgcctactatgaggcggtggtgtacggtcctagcagcgagatcggagtacattgactccaggaaggctccttgaagttgggccgcggcatttgcgcccgtgggagcaagaggcccacatagacttcagcgaggactgagctctacgatcgcactcgtgaggccacttgggcgttaggtccatcggtcattagggcaacccttggaatctttaacccctttcaaacgctacaagcgaattccaaggcaccatgagatggtggcagccctatccggcttagacaggtggaacacgtgcaatgtgggcggatccgccttacaagaggccgcgcgttccgggcaccggcgtatggacgttcgacaggcaacacatcattgcggccggcaggcccttggctttgagcataacccgattcaataccacacgcaagttatcctaggcaccgaatggggacatcttggtaacaccccaggatataacgtcaaacattggcggtgacttggatcccccgcatgcaaaacaaaccaatcggaggagacactgggccttccaacgggggacagcaagagtttaccggaaccgattatataccgcttggataacacaatcgtgagacaagaagaacaagtgtgcggattgaggagcacaaaca

SEQ ID NO: 608957 - DNA, 670 bp, Homo sapiens
  misc_feature (586)..(586): n is a, c, g, or t
  misc_feature (649)..(649): n is a, c, g, or t
gtttcatgtatgttgtctatattccacaataagaaaatatacaaatgaccagcaaatatgaaaagacatcgaatctcgctagtaattagaaaaacaaaagaataaacatgatcacctatcatgatttgccgaaaatgtaaagactgataatatccctctttgctgaggttgcaaagaaacaggcgttctcataggctctcaataggaaagtaaattaataactcctttttaagaacaatgtggtaatatgtataaaaatgtaaagctcatcttataagttttaaattccaattccaaatacctagcctaattaaatccacatgcattcaaaatatgtgtacaaagatgtctgccattcactacagcattgtttgcagtagtggaaaaaaagaataaatgtcaatatgggaagatttgtgaaaagtactataatccatacaatgaaatactatgcagccattaaaaataaatctttgtaaactgacatggaaagatatccaaaacatattaagtgaacaaaagcaagacacagaataacacacagatagcctaatcctgtttttaaaatataaatatgtacatatanttatatagaggtctgacagactatgcatttatgctgtaacctgttagcagtgattacctctgncgttcatattttgaatgtgtt

SEQ ID NO: 608958 - DNA, 661 bp, Homo sapiens
  misc_feature (622)..(623): n is a, c, g, or t
aggacactcaaaaattgtgtgggaaatggttccattggatgtagggctgtcatcagcattatatctaccaactctgggtcttcttcattaaatgccaataatgttcccccttcccccaattattgtgacaaccaaagagcattaccacagatttccaaaatgcccccatggagtgtgtggagggtgtagtttgactattctggagaaccattgaaaacaaacaacgggagatatgcacctcacagagctagcacttagagattttgcccatattagcacttaaagatcgaccattctttgtaacagttgcagaatattcaagcatacctctgtaccaggatttatttagctagtgatggtcacactgactttttcaatggtcttgttgcaagcaacgccgcagagatgatcgttagacattagcctttgtgcactcatacagttacatctctagaataaattcccacaagtcaagaggtacatgtctttttaaatttgtatggatattgccaaattgctctctcaattattgccagatatttcaccactaagtattgtagaaggttttaatcttggtaactgtagttctttagatgtacttagtagcgtccagccttgactnngctttttatataggatattcacgtggacaggttggctt

SEQ ID NO: 608959 - DNA, 785 bp, Homo sapiens
gtttggaagatgatgatatcacgcacgtcgaaggaagtgtagatcctattcgagatatagaattaatacagtgaagagcttcagcgttaaagatgaggaaagtgattgggcccattatagatgaaactagaagaggtggctgtgagaggaggagataaagaactatgaacctgagatatgatataatgtgctgagtataatcctgggttatagatctaaagaaacctgttcgcttctatcatgattggaatgacgaagagattgaagtgttgaataaacagttatttttgacttgcaaagaccaagtggtctactaggttaatcttactgaagaaagatctacgattagaacagagataaacaaatggttgataaaaaattaagagagtgggtggacaagtatgacccaggtgctgtaggtcattcgctttcagtgggggctctggaactcaagttgcaagcaattgagtgctgagggagagacagaagtatctggaagcgaacatgacacaacagtgcttggcccaaagatcattgacggctgggtttgcagcacgtccaactagaatactttttcagcggcaggcccagatgaagtgcgtgcatggaccatcaggaaagggactaaggctacctcagggctggcggggaaagaattcacagcagattatggaaaagggattcataatgagctgaaagtactgaaagtacgaacgatataaaagaaggaaggttctgaaaaatgaggtcaaggatgctggaaagtacaggagcaacaagcagaa

SEQ ID NO: 608960 - DNA, 1354 bp, Homo sapiens
gaaggtagcagcctgtctgtctccgccccacagtccacgagactttaccagaatgcagtgacatccctggagtgagactggagatgcctgcgactgtgtggagtgcatgtagcctcacgcagagctaagtgtgtgtgcaccatccccgcactgggcccaggtgacccacagctgcaagaacgagttactagaggtggggacataacacattgtggagactccacattattgccacatagatagaggagaacgattttgaacagaacatgcaaacactagtacactatggccagactctctgggcatccatataggatcacctagggggccattatagagcaagcctcagtgggcaattcaggccagcagagcgagccgcgccatgggtgaaccaatcccgaaccagcgtaccaacgcaacaagaattgcgacaggtgtgataccagttgaccgttacgtttcgcccggcaaagcgtattccgtgaccaacatctgtaatatacactgtgcagtagggtcaggaataaacgtatacaaggggaggggaagccggggcggacgaccagatagacgggggaacacaaggggaacaattggcgaaacaccaaggaccacaaaggggactccaccccgggggcacagtcggagccatatgaaagcacggaaccatggggcgctacaaactaacaggggacctcactgacaacggcagagtttgcattgatggtaccgttgccgccctacaccgggcgcaccgttccaccttgtgcaacacctgcacggacttgtgagacggaaagacgggccttggcaggaccaccaagaaaaagcccaaaacatggcacccatatagaggacttacgatatgaaggcacaagacgaagacaagagagcgcacatgacagcacagatacgcgcagcagacgcccatcgaaaagtcctcaaaacgacgacggggcacacaacaaaagcccacagataccaagaaacgggagagagcatgggagaaaaacaacaccagtggctatccatggacgaaggaaagacaaacaaaagcagcagagcaggacccacacaaagggccaaagcaagcacaagcaagagaggacaaaagagcaagccccggggacccaccaaccggagaacagagcgcggaccacagaggagcagaaccaacgagccgcacaaggacacgcgcgcagggcgaacacgagcaacacgacggacagaaggcacgcacagcgctggagcgccgagacacccaaccgaccgacaacataaggcagcgcggcacaaagaccaagcaccacggacagaagcgggacccaccagggagacgcagccgcccgcggcc

SEQ ID NO: 608961 - DNA, 223 bp, Homo sapiens
caggattccctactgctcgatcaatagcgctgataatgtgcggaggtaaactatgctcgtgtgtctacgtctcttcctactgtaaatatatggtgtgctcacacgagtaaaccctaggaagccaattgatatcctcgctcagaccatacctatgtatccaactggttcttttattccggagtagtacgttacactctgggcgctattgctgcacagagtgaga

SEQ ID NO: 608962 - DNA, 396 bp, Homo sapiens
cccagaccctgagctcccctgcagccctcccaggaggcaactgttaccaatttctgccatgatcatttgtaacagtgaaaaatgagaaacgatctaactctttcacggataaataaattacagtctgtccatgcagtgggatactctgcagtctctaaacatcgtgcctgttaccgcatccctcttctgttaagtaactgtgcattgcctctggccccaggccctcagcctagactactgcttctggctggaacccgcccccccaccaggccccacttgagtcctcagccttcagactctccaagacttcacacccccactgatgactctccgaggctgtccaaggcttcacacccccactgatgagggaaccccgcagttctcatagctacctgg

SEQ ID NO: 608963 - DNA, 492 bp, Homo sapiens
agttctagatcgcgatctagaactagtcgcgagcggccgcccttatttttttttttggagactgtcacccagtcgggagtacagtggcgccatcttggctctctgtaacctctccctcctgggtccagcgattctcctgcctcagcctcctgagtagctggggcaccaggtatgcaccatcactcctggctaattgtgttttccgagataatggggttcacccatgtggtgcccagggttggttcctcaaacctcctgtggaccctcgagggtgaatcatgctcttgccaatggcactcccaaatgttgctgcggatctccatgaccgtgagcccaccattgcccctagctcaaagaaatttgtccactgccttatactcgtcgccgtggttttccactatgttctccaactaggcgtctttaaatacctctaagttgtgttaccactacaccattttgggcgcatctgttcgactcacctcctctcccatt

SEQ ID NO: 608964 - DNA, 420 bp, Homo sapiens
ctataacttagcacacaccaataatcatgagtgagtctaacatacacaggaagtaaatgaatagtgtaggagataaaccccataacatggaaacttatcaaaaaattacttgagcagctgtctgatgatggtgatgtatatctccttcttcttggcagccaagcccaacaaaataatggcacacagcagttgctgcccaagcctgggtgctcctggtggtcctgcactgatcggatgtgcagtaggcttgtcaaggagaggatcctccctggcctctccttgggcagaggaggtgagggtcacctcacgaagatcaccatgcttgtcttgatgacccaatgcaactggggggctgaggctccttgaaccgggctcatcagcagagttgtgggcagcggacaggggatccctctagagtcg

SEQ ID NO: 608965 - DNA, 830 bp, Homo sapiens
  misc_feature (188)..(188): n is a, c, g, or t
  misc_feature (262)..(262): n is a, c, g, or t
  misc_feature (268)..(268): n is a, c, g, or t
  misc_feature (305)..(305): n is a, c, g, or t
  misc_feature (418)..(418): n is a, c, g, or t
  misc_feature (424)..(424): n is a, c, g, or t
  misc_feature (442)..(442): n is a, c, g, or t
  misc_feature (484)..(484): n is a, c, g, or t
  misc_feature (609)..(609): n is a, c, g, or t
  misc_feature (654)..(654): n is a, c, g, or t
  misc_feature (656)..(656): n is a, c, g, or t
  misc_feature (672)..(672): n is a, c, g, or t
  misc_feature (689)..(689): n is a, c, g, or t
  misc_feature (694)..(694): n is a, c, g, or t
  misc_feature (723)..(723): n is a, c, g, or t
  misc_feature (726)..(726): n is a, c, g, or t
  misc_feature (804)..(804): n is a, c, g, or t
ggcgccccgaaccctcctcctgctactctcgggggccctggccctgacccagacctgggcgggctcccactccatgaggtatttctccacatccgtgtcccggcccggcagtggagagccccgcttcatcgcagtgggctacgtggacgacacgcagttcgtgcggttcgacagcgacgccgcgagcnagaggatggagccgcgggcgccgtggatagagcaggagaggcctgagtattgggaccaggagacacggaatgtnaaggcncactcacagactgaccgagagaacctggggaccctgngcggctactacaaccagagcgaggccggttctcacaccatccagataatgtatggctgcgacgtggggtcggacgggcgcttcctccgcgggtatgaacagcacgcctacganggcaangattacatcgccctgaangaggacctgcgctcttggaccgcggcggacatggcggctcanatcacccagcgcaagtgggaggcggcccgtcgggcggagcagttgagagcctacctggagggcacgtgcgtagagtgactccgcagatacctggagaacggagaaggagacgctgcagcgcacgnacccacccaagacacaaatgacccaacaccccatctctgaccatnangccaacctgaggagcnggggcctgggcttctancctanaggagatcacactgacctggcagcggganggngaggaccagacccaggacacggagctcgtagagaccaggcctgcaggggatggaaccttccagaagtgggcagctgtngtggtgctactagagaggagagagaa

SEQ ID NO: 608966 - DNA, 405 bp, Homo sapiens
ttgcgcaggcactttgtgggtcggtgactggggatcattggtcctgagacttttctcatggtccttcctgtcccttttgttgccgcgctgctgtggtctttgaggatttgtttgtctcttctctcgggaagaatggcgagcttcttgatgatgctcagagacttttgtaccatgatgtgatgcttgagaactttgcacttttagcctcactgggtaaggtcctcatgcttttctgcctttaccactctgttcttcctatggtgggatcatgagcaccgcttccttcaccagtttcctggagtaggtgctctagatgcctggtctaagctgtatggagtgtcctccctacttgctgagtagtcttcacgccgtgcagccgagggtttggggtcatgagacttgtga

SEQ ID NO: 608967 - DNA, 877 bp, Homo sapiens
  misc_feature (94)..(94): n is a, c, g, or t
gggcgcaacgcggatcccgaggcgcgggccgcccccttggtggttggatccgggtcagtcgggtgccgagattgggagagacgctctgaactgnatgcccgaattaccggagcgtcccagctgcgaggagtgtaaaccaggaacatcgataagtagtgtaaaaactgtggcacaatgaaattccgaagccaaggatggagaggaggagagtctacaagactgctttcaaaaaaattaagagtggatgcatcagggtctgtagcatctcgtgtctgtgggagaaaggcacagggtgtcagagcaccagttcagaaaagcaacagatgataccaaagcttaaaaccagatgtgcatctaaagacagtggggcacgggtctaccaaggaagtcttcagcgagggagcagtgacgaactcagcggtcgtccggacgtctaaagtctcctgtcctccatcctccaaagtttatacccattggcagtacaatagcggtcttcttccaagcagtcaaaactcaagcacaaaagcagactgactcacctgtttggcagcaggtgggctggggaatttacatccccctaaagagttcagtgcaggagaaaggtctattctctacgatgtaatcacacaggggcagtcgttggagccttgagaacttctgttccagggtcccatcagagagtagcaggaagatcctttgaggttacaaagttcccaagagttcaaggccgggatctctctgacttcaacaggttccagctaaacagcagcatgcatgcttggcaggatgccggtagaaggctattgagggttccatacggggggggcccctgcccggcaaacccgggggacatccgggcgacaatgggcccctttaa

SEQ ID NO: 608968 - DNA, 692 bp, Homo sapiens
gggaaggggagaggaagagacgaggaagaagaggagtgaagaaggaggggagaaggagaggcgagagaaaggacgaggggaagaaagagaaaagagagaagagagagaggggagagagaagcgaagagagagaggagagaaggggaaagcgaggagggaggaaagaaggaagagagaggaagggagaagaagcaggggaaaagagagaagtggagcggcgggaaagaagggagcagcggaggagcagggaggcagaacagtgaagcaaagaggcaggcagaaggagaggagggaggaagaggagagggaaagaaatgaaagagcacggaaaggaaggggcgaaagaaggatggagataagacaagggggggaggaggagataaagagataggagggaggaggcaaggagggaggaggaaaggggaaaggagtaagacagacaaggagaggatagaaggagggagagaagagagacagaaggagatgaacatgaaaaggaatagacgaaaaaggacaatagggagaggagataaaagaagaagggcagaagcagaaggatcataaggagggtctataaaatatagaacaaaacatgtaacacgcactatctgagtctaactcgctgctctcgagctcactctctctctctctctctctctctctctctctctctctctctctctctctctctc

SEQ ID NO: 608969 - DNA, 192 bp, Homo sapiens
gatctagaggatcctgtagcgcctttttttgagacagggttcattctgtcaccaggatgcagtgagtggtgtgatcgcagctcactgcagcctcgactcccccagctcaggtgatacttacacctcagcgtcccaagtagcagggcctacaggtatgcaccatcacaccctgctaatttttgtatttttttg

SEQ ID NO: 608970 - DNA, 814 bp, Homo sapiens
agcgggtttctggccctgccagtgtctccgcctggttgaaagctgcgtgtctgcgtcgggttctgtcaggagtgcgttcggtgcgccgtgggtccgcgctgtttccagccaagttcctgtatagttaactctcctgtcacaatggcatgatctacggctcactgcgaccctctgcatacctgggttcacaggattctcctgccttcagcctcccaagtagcttgggattacaggaatctcaccagtgataacgcgtttgtgaaaaatgcttgttgaagtacttcagtagccacagggttaaacctcggtacaagaagcgagaaccctgctgggaagaagcaaagtggtgacctggcaacggagtagttgagggcccggtcatagtaggagaaccatgttggaagtgtacatagggctcagacgaatcacgcaggtccatggtgaacggccctgcaatattccgtaggccaaaggaccaaggttgccatctgctactatgaggtcgcactcaattgtcagccaggctagcactaggaagagtgctttggcatgaaaatcagcctagtgaaacaacactacgtagagcggaatatacggcaaagcaagcaatgggcatggggctactaaaagaacgacaactggagataatctcgacagcggtagaaagaaacccaaagggatccataacatgagaacgaaaccgccaattgacacgttgagacattatttaggagacgataattcaagaaactcaacaatagacacaaaacgtacaagggaacatggagaaccgaaagcctccaattatgagtaa

SEQ ID NO: 608971 - DNA, 1262 bp, Homo sapiens
  misc_feature (30)..(30): n is a, c, g, or t
  misc_feature (38)..(38): n is a, c, g, or t
  misc_feature (41)..(41): n is a, c, g, or t
  misc_feature (51)..(51): n is a, c, g, or t
  misc_feature (77)..(77): n is a, c, g, or t
  misc_feature (80)..(80): n is a, c, g, or t
  misc_feature (89)..(89): n is a, c, g, or t
  misc_feature (102)..(103): n is a, c, g, or t
  misc_feature (118)..(118): n is a, c, g, or t
  misc_feature (124)..(124): n is a, c, g, or t
  misc_feature (127)..(127): n is a, c, g, or t
  misc_feature (136)..(136): n is a, c, g, or t
  misc_feature (142)..(142): n is a, c, g, or t
  misc_feature (144)..(144): n is a, c, g, or t
  misc_feature (147)..(147): n is a, c, g, or t
  misc_feature (150)..(153): n is a, c, g, or t
  misc_feature (161)..(161): n is a, c, g, or t
  misc_feature (164)..(164): n is a, c, g, or t
  misc_feature (168)..(168): n is a, c, g, or t
  misc_feature (170)..(170): n is a, c, g, or t
  misc_feature (175)..(175): n is a, c, g, or t
  misc_feature (183)..(183): n is a, c, g, or t
  misc_feature (187)..(187): n is a, c, g, or t
  misc_feature (196)..(196): n is a, c, g, or t
  misc_feature (199)..(199): n is a, c, g, or t
  misc_feature (201)..(201): n is a, c, g, or t
  misc_feature (210)..(210): n is a, c, g, or t
  misc_feature (213)..(213): n is a, c, g, or t
  misc_feature (218)..(218): n is a, c, g, or t
  misc_feature (220)..(222): n is a, c, g, or t
  misc_feature (226)..(226): n is a, c, g, or t
  misc_feature (229)..(229): n is a, c, g, or t
  misc_feature (232)..(232): n is a, c, g, or t
  misc_feature (266)..(266): n is a, c, g, or t
  misc_feature (269)..(269): n is a, c, g, or t
  misc_feature (271)..(271): n is a, c, g, or t
  misc_feature (282)..(282): n is a, c, g, or t
  misc_feature (286)..(286): n is a, c, g, or t
  misc_feature (289)..(289): n is a, c, g, or t
  misc_feature (298)..(299): n is a, c, g, or t
  misc_feature (305)..(305): n is a, c, g, or t
  misc_feature (312)..(312): n is a, c, g, or t
  misc_feature (315)..(317): n is a, c, g, or t
  misc_feature (322)..(322): n is a, c, g, or t
  misc_feature (340)..(340): n is a, c, g, or t
  misc_feature (357)..(357): n is a, c, g, or t
  misc_feature (361)..(361): n is a, c, g, or t
  misc_feature (378)..(378): n is a, c, g, or t
  misc_feature (381)..(381): n is a, c, g, or t
  misc_feature (383)..(383): n is a, c, g, or t
  misc_feature (389)..(389): n is a, c, g, or t
  misc_feature (398)..(398): n is a, c, g, or t
  misc_feature (429)..(429): n is a, c, g, or t
  misc_feature (437)..(437): n is a, c, g, or t
  misc_feature (443)..(443): n is a, c, g, or t
  misc_feature (445)..(445): n is a, c, g, or t
  misc_feature (502)..(502): n is a, c, g, or t
  misc_feature (542)..(542): n is a, c, g, or t
  misc_feature (555)..(555): n is a, c, g, or t
  misc_feature (559)..(559): n is a, c, g, or t
  misc_feature (563)..(563): n is a, c, g, or t
  misc_feature (566)..(566): n is a, c, g, or t
  misc_feature (569)..(570): n is a, c, g, or t
  misc_feature (575)..(576): n is a, c, g, or t
  misc_feature (578)..(581): n is a, c, g, or t
aagagttttgggtagtatactcaacgctantacagttnctncagcaatgtncatggttctcacaccaacacaaaaanacncttatgtanttcctttttcccnncaaatggtaccatgnccaatnacnacaaatatnccctcncnacnccnnnnaatccctntcncccncnccccnccaggtgnaacncattccccncancnaataatctnaanccaanannnaaanacnccnccccatccctccattctattcactaataatgaanccntncctggaggttnccanccncctattccnnccaggnattatcnaannnaaatngatattccagttaaattnattttttgttgaattantttnaattttttcttcatttnagntncagatnatagaggcntgttggatatgtgcggctttgatactggagntctggatntaattngnaatttcacattagatatgatttaaccataagcagcagcacgatccagagatccattnccatcagtgatctcactaaaaatatacagctacttcccanctaatctccaccnaatnaatnatnatnntatannannnncataatggaaagttaccttactgaaaaaaaaaaaagaaggaacaattaagatgggcccaaaggtctatctactaaactagctctgggggaaatagcttcaggatactgtagttcctctatctaatagacgaacttttggttaaccagacactgtaaacatagtttggcttggtggaatacttccttgtgttccctaaaagaggtacgagcaaacaagtgtacattccaccatcagtgtcaccttgagcaagtgcttaagcgtttacttacagtgttcttcattggggcaaaggcacagcttgcgatcaatgtccaaatactctgaaatgcacttagaccatatacctgtgcatgacactatgaacatcatctgtaaaccttttataccaagggggtaaacaacgacagacacgcataggggactttggacctcaaattatgcaatgtagattttaacacaattccccttttcccaggaagtgttagactttaaagaaatacagcaccaaaatttaaaaccgggggttcgcatataaatcccggttggcaacaccacgaattcttgtacaataaaccggcaagtggatccatatatgtggcactcggggcgcacaattttcggtgtccgccaatatatagcaggaggacaccactattgggcaacgcccccgttaagagaat

SEQ ID NO: 608972 - DNA, 459 bp, Homo sapiens
tgggggacagctttgatccatcaatttgtgaaagcatgcgtttgcactgtttctgttgcctgtgttgccaggtgagacaggtggcactaactccagcatgttatggaaggcatcccaagggcgtcttcttacagttggagcagacctcccttttccagcccttgtggccattagaccacgtgctggaactagcattgttcaattcccattcccagtttccactcccctttatgtgaaatcctttcctttaaggtgacagtaaatcttaaaattcatggtctctttatgaacttttcctcagtttcttctctgctgaaattgtaggccatgctactttttactgtatttggaatttggtgccctttggaagttgatatgctattgcctcccccaccccccgccagacttttctttttttccttggtcttgtgtttacgggggtaggctgggcatgcttgc

SEQ ID NO: 608973 - DNA, 3164 bp, Homo sapiens
  misc_feature (6)..(6): n is a, c, g, or t
  misc_feature (8)..(8): n is a, c, g, or t
agcggngngggctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagctgctattaaattaatattgatatattcagtattctctt

SEQ ID NO: 608974 - DNA, 917 bp, Homo sapiens
  misc_feature (6)..(6): n is a, c, g, or t
  misc_feature (8)..(8): n is a, c, g, or t
  misc_feature (917)..(917): n is a, c, g, or t
agcggngngggctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtactttaaaaaaaatactatggatttcgcatgattctttaaatagatactatttttattgttattaggagactagactattaaagtctgttggattgagtaagtgtaaactggaagaatttttgtcttttatcatatttaaaggatttatttatgtaatctcaacagtgttaccatttatgtggagtattgcttatgatgatctcttaagaatattattgtaaaaacatcatatgggggattatcgtggtaaaacaaaattcgtgaaggtcttactctaaattcttttttctttcctataactttaattttgtatccatgtgatttcatgctttgacacataaacttgcctcagattcttttttcttatttttattatttattttagagatagggtctcactctgtcaccccagctggagtgtagtggtgcggtcatagctcactgcagtctcaaactctgggctcaggcaatcctccctacgtagcctcctcagtagctaggactatagctgtgtgcaccatgcccagctaatttaaaaagttttgtagacacgagagtctacactatgttgactgggtggtactcaaatccctggcttcaattgatctcn

SEQ ID NO: 608975 - DNA, 3218 bp, Homo sapiens
  misc_feature (6)..(6): n is a, c, g, or t
  misc_feature (8)..(8): n is a, c, g, or t
agcggngngggctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacagctaggactcagattggatcaaaattcacacggtggggatcacagggagaaagaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagctgctattaaattaatattgatatattcagtattctctt

SEQ ID NO: 608976 - DNA, 111 bp, Homo sapiens
aggcgctagcgccttagccaggatcgagcacgctacccttcgtatacgcggtgtgcacgacgtagcgcggctattcttccgtacgtcatcatcgccgagcgaccgggtacg

SEQ ID NO: 608977 - DNA, 3327 bp, Homo sapiens
  misc_feature (6)..(6): n is a, c, g, or t
  misc_feature (8)..(8): n is a, c, g, or t
agcggngngggctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctgatttatctcccaagctgtattctaggcctcctacaagtttcttcctagatagaccatgatattttaaactttgcatgttcaaaaattgaactgaggccgggcgtggtgactcacgcctgtaatcccagcactttgggaggctgaggtggatggatcacttgaggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagctgctattaaattaatattgatatattcagtattctctt

SEQ ID NO: 608978 - DNA, 3721 bp, Homo sapiens
  misc_feature (6)..(6): n is a, c, g, or t
  misc_feature (8)..(8): n is a, c, g, or t
  misc_feature (3553)..(3553): n is a, c, g, or t
  misc_feature (3556)..(3556): n is a, c, g, or t
  misc_feature (3558)..(3558): n is a, c, g, or t
  misc_feature (3566)..(3566): n is a, c, g, or t
  misc_feature (3585)..(3585): n is a, c, g, or t
  misc_feature (3613)..(3613): n is a, c, g, or t
agcggngngggctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagctgctattaaattaatattgatatattcagtattctcttcaactttgtcacgaggaagaatttcctgtagttaattttaactttccttcattacattgttgcataaaactagtcccttagtgccagtttggaagttacttgcaattgtttggaagatttgcaggtcgctgacctcatcatttcactctaagtatatgtggtaggctaagctcagaaaaaggtatgtatgctttacactgataggcaccaaatttagtattgtatcctaagtatttttcctcttctgtattttctgtgctctacccctgaaatatatttaggaataaagaagatataaataaagtgatattggggtatgttcagcttgtaagtgtcagaaatggaagttggacaaattggattaaacatatttaaagtagaatgttatnatngnataccccnaaaattgtgagtaataatntcttaatggagcttactggccagatctncagggctataggagagtagtgtaagtaaaaggagaagtccttctttacaaaggttttcacttttaaatagtgaagataagctataaagcacaattatttaagtaagct

SEQ ID NO: 608979 - DNA, 113 bp, Homo sapiens
agttcgacggagactctcatgtcccagcgagctcagcagcccgggcccgtgaggcctctctccccactgatgtcagccagtccaggatggagtcactctccctggcgccagca

SEQ ID NO: 608980 - DNA, 2905 bp, Homo sapiens
  misc_feature (6)..(6): n is a, c, g, or t
  misc_feature (8)..(8): n is a, c, g, or t
agcggngngggctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctgccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagctgctattaaattaatattgatatattcagtattctctt

SEQ ID NO: 608981 - DNA, 976 bp, Homo sapiens
accatagctgccaacagctaaagcccctggtccctctgcagtctctataccaataaagtgaccctgctctcaaaaaaaaaaaaaaaaaaaaaaaaaaaaaaaaaagcgaacaaaaaaaaaaaaaaaaaaaaaaaaaaagctgtgtcgtgggccgcgtccgcgcgcgccccggcaggaagctttttcacacacacccctggtggggcggccgccgcggcccacatatgagtgcaatcatcacacccggcgccacacggccgtgctacacagcagaaccccgtgtctcaacacacagggtcgtgggtcgctccccaccaccaaaaaagaaaagcgccgccgcgcgcacacgggcggcgctctttcgcgaaacaacacaccacgagaagaggcgatctccagaagcgcgagctcaacagcgaggcggcgctaatcatacacacggagagggggagcaccacgaagaagcgcaccactacaataaaataatatagaggccgccgcgcgaccgcgagaggcgacacgaccccacacaccgacgacagcacacagagacgaacacacacacacccacatcagaacaccacgacacgccgatgacgatcgaccgaccaacccacgcgaaccgatcaaccagccaccgtacagcgagaagaaaaacgaagcggacatcgaccagaccgacggaaacacacatgaaggccccgaaggaggaacgggaacgagagccggaggcgagagactacgacagcagcgagccagcagaagacagacacacacagaacaaaccggcgcgagacagaagcacgaccagcgaccacaccgcggacgcacacgcaagcgcagacggagcagagcaagacaacagcgacgacacatcgacgcatcgaccacagacccacgaacagccacgcgaggccaccacacaacacaacaccgctgccagacacacacgcagacaacgacaagagcggacaca

SEQ ID NO: 608982 - DNA, 3248 bp, Homo sapiens
  misc_feature (6)..(6): n is a, c, g, or t
  misc_feature (8)..(8): n is a, c, g, or t
agcggngngggctggcggagcccgggaggcggagaaggctgtcgttgccttggccgtcgcatccccgagggagtcgtgtcggcgccaccccggcccccgagcccgcagattgcccaccgaagctcgtgtgtgcacccccgatcccgccagccactcgcccctggcctcgcgggccgtgtctccggcatcatgtgtggtatatttgcttacttaaactaccatgttcctcgaacgagacgagaaatcctggagaccctaatcaaaggccttcagagactggagtacagaggatatgattctgctggtgtgggatttgatggaggcaatgataaagattgggaagccaatgcctgcaaaatccagcttattaagaagaaaggaaaagttaaggcactggatgaagaagttcacaagcaacaagatatggatttggatatagaatttgatgtacaccttggaatagctcatacccgttgggcaacacatggagaacccagtcctgtcaatagccacccccagcgctctgataaaaataatgaatttatcgttattcacaatggaatcatcaccaactacaaagacttgaaaaagtttttggaaagcaaaggctatgacttcgaatctgaaacagacacagagacaattgccaagctcgttaagtatatgtatgacaatcgggaaagtcaagataccagctttactaccttggtggagagagttatccaacaattggaaggtgcttttgcacttgtgtttaaaagtgttcattttcccgggcaagcagttggcacaaggcgaggtagccctctgttgattggtgtacggagtgaacataaactttctactgatcacattcctatactctacagaacaggcaaagacaagaaaggaagctgcaatctctctcgtgtggacagcacaacctgccttttcccggtggaagaaaaagcagtggagtattactttgcttctgatgcaagtgctgtcatagaacacaccaatcgcgtcatctttctggaagatgatgatgttgcagcagtagtggatggacgtctttctatccatcgaattaaacgaactgcaggagatcaccccggacgagctgtgcaaacactccagatggaactccagcagatcatgaagggcaacttcagttcatttatgcagaaggaaatatttgagcagccagagtctgtcgtgaacacaatgagaggaagagtcaactttgatgactatactgtgaatttgggtggtttgaaggatcacataaaggagatccagagatgccggcgtttgattcttattgcttgtggaacaagttaccatgctggtgtagcaacacgtcaagttcttgaggagctgactgagttgcctgtgatggtggaactagcaagtgacttcctggacagaaacacaccagtctttcgagatgatgtttgctttttccttagtcaatcaggtgagacagcagatactttgatgggtcttcgttactgtaaggagagaggagctttaactgtggggatcacaaacacagttggcagttccatatcacgggagacagattgtggagttcatattaatgctggtcctgagattggtgtggccagtacaaaggcttataccagccagtttgtatcccttgtgatgtttgcccttatgatgtgtgatgatcggatctccatgcaagaaagacgcaaagagatcatgcttggattgaaacggctgcctgatttgattaaggaagtactgagcatggatgacgaaattcagaaactagcaacagaactttatcatcagaagtcagttctgataatgggacgaggctatcattatgctacttgtcttgaaggggcactgaaaatcaaagaaattacttatatgcactctgaaggcatccttgctggtgaattgaaacatggccctctggctttggtggataaattgatgcctgtgatcatgatcatcatgagagatcacacttatgccaagtgtcagaatgctcttcagcaagtggttgctcggcaggggcggcctgtggtaatttgtgataaggaggatactgagaccattaagaacacaaaaagaacgatcaaggtgccccactcagtggactgcttgcagggcattctcagcgtgatccctttacagttgctggctttccaccttgctgtgctgagaggctatgatgttgatttcccacggaatcttgccaaatctgtgactgtagagtgaggaatatctatacaaaatgtacgaaactgtatgattaagcaacacaagacaccttttgtatttaaaaccttgatttaaaatatcaccccttgaagcctttttttagtaaatccttatttatatatcagttataattattccactcaatatgtgatttttgtgaagttacctcttacattttcccagtaatttgtggaggactttgaataatggaatctatattggaatctgtatcagaaagattctagctattattttctttaaagaatgctgggtgttgcatttctggaccctccacttcaatctgagaagacaatatgtttctaaaaattggtacttgtttcaccatacttcattcagaccagtgaaagagtagtgcatttaattggagtatctaaagccagtggcagtgtatgctcatacttggacagttagggaagggtttgccaagttttaagagaagatgtgatttattttgaaatttgtttctgttttgtttttaaatcaaactgtaaaacttaaaactgaaaaattttattggtaggatttatatctaagtttggttagccttagtttctcagacttgttgtctattatctgtaggtggaagaaatttaggaagcgaaatattacagtagtgcattggtgggtctcaatccttaacatatttgcacaattttatagcacaaactttaaattcaagctgctttggacaactgacaatatgattttaaatttgaagatgggatgtgtacatgttgggtatcctactactttgtgttttcatctcctaaaagtgttttttatttccttgtatctgtagtcttttattttttaaatgactgctgaatgacatattttatcttgttctttaaaatcacaacacagagctgctattaaattaatattgatatattcagtattctcttttttaaattttgttcaccgagtgataggaatatttcccttgttattttaaaattttcttataccttttctcccttttccaatat

SEQ ID NO: 608983 - DNA, 433 bp, Homo sapiens
gaacaacacatcccctctgaatgtatccattggttgttaagcctatgcatggctgttataaaaatggggttaaaccgtgaaagttggccttataataatttccagacacaacccaagtttttaaagcagtggatatgcccttagctatatcccttttgagaaatgtatataaagaattttacaggctggaggcagtggctcatgtctgtaatcccagcattttggaaggccaaggcgggcagatcacttgagcccaagagttccagagcagcctggccaatatggcaaaaccccatctctaataaaaattcacaaattagccaggcatggtggcacacacctgtaatcccagcttctcaggaggctgaggcatgagaatcgcttaaacccaggaggtggaggctgcagtgagccaagattaagctctgtctca

SEQ ID NO: 608984 - DNA, 298 bp, Homo sapiens
agagtatacccgtcgcacttctgaatcccatgtatttatcacatcctagtagagctatggagtgtaacaagtattgtgcattttaacagtaatatttgaagatttgtataatattcacctttaaaactagttagtatgcatttatacattttatcagaaatatactaactaacaattcaacagctgatgttctttgcatttgtggggagatgtgtgatgttcttggttttctggtttggaatggaacgtttatagccttgcctgtaaaaatgtgccccagcgacttaatgagtgaccg

SEQ ID NO: 608985 - DNA, 442 bp, Homo sapiens
tgtaagagattagaaaggtcaaatgttggccattagaggtctcaggtgcaaaagcgaacgctagtggacacgttcattgctttaaccaagatcctagacagaatacaggactttgtgcattggagctctggtgctcctggatacaaaaactagtcaaggctcataagattagaagcatcgcgtaagggaccagagctacattaagagggtagggctgggctcccctactgctacattgcttgggcatttaggatgcagccacggtctcgggatctttatgcactaattctggcggtcaatttgtttttaacacacacatcagttaaacatacccggcggtcttctttttgaaatatttacgcaggaaattgtgtcttgcactcaaggtggtataatactaaagtacttcctcttcaattatgatcttcagtgaaagccctca

SEQ ID NO: 608986 - DNA, 237 bp, Homo sapiens
tatatatactgaccatgagtgctatatcagagagcaagatagactagtacggacaataatattatgaaactcgctcctcgtgtatctttgtgatctgtgtcaccatatctcacgaagtccagccacttgactggcacacacccctccggacatccagcgtgacgaagcccacacagccacctaggggccgcctgagaccctcgcgccccccgcgccccccgcgccgtcgcctaagca

SEQ ID NO: 608987 - DNA, 118 bp, Homo sapiens
ttattgagatgtttctacaaactagggggagaaataagagaaaaatccttattttaaaacacaagtgaaaagcaccaagcaatcgcacataccttgatgactcagagtctgttcagtt

SEQ ID NO: 608988 - DNA, 487 bp, Homo sapiens
cctttgtacgcaaccggtgcagagtctgcttgtccagcagggtgtgcagaacccgtgaggtattctgcggaccagcagaatactaccggttcctgtgcgtgacgtacccgcgttaccgactccggtatcagaaattacgttgctgcatgcctgaccgcaactggtccagcccttgccggatcactgtatcgctcaggtgcaataactgatctccgacataccattcaaacatactgcgattgggcaggcttgcgtgcactgcctgattgaacaaccagataccttgttccgccgcaatctgattgcgcaaatggattgccgtatctttatccatcgggagatgcagatgaagcatgttcacctgtggtgtagccgggttggtttggagctctggatagttctgcaaaattctgaatacatccctggttctggcaaggtaggcgggcatttgtgccagttgctgatcaaactgcattgccgcagcgac

SEQ ID NO: 608989 - DNA, 445 bp, Homo sapiens
  misc_feature (33)..(33): n is a, c, g, or t
  misc_feature (302)..(302): n is a, c, g, or t
  misc_feature (307)..(307): n is a, c, g, or t
  misc_feature (372)..(372): n is a, c, g, or t
  misc_feature (396)..(396): n is a, c, g, or t
  misc_feature (408)..(408): n is a, c, g, or t
  misc_feature (427)..(427): n is a, c, g, or t
attgtgccaatgctggcgatgagtgatgcccgncgcgcgcgattatccgccgctggctggcagggcagaatgcaccgatgccttcccgcgacgcgttggtgaggatctggcaggaagtggcgctggcgcgggaagatgcctcaccctgtttacgtttgggcgcgtttgaaatccgacgctatcagtcgcaactgtggtggattaaatccgtcaccgggcaaagcgaaaacattgtgccgtggcagacgtggcttcaaccgctggaattaccggcggggctgggaagtgagcttaatgcgggnggcgntattcgccctccgcgtgcagacgaagcggtagcgtgcgtttcaaagcgccaggttctgcatattntcgggcgtaacggcggacgtaagntaaagaaatctngcaagagctgggcgtgccnccgtggctacgtgacacc

SEQ ID NO: 608990 - DNA, 343 bp, Homo sapiens
  misc_feature (41)..(41): n is a, c, g, or t
gagctcgcgcggcggaggtataaagtatgcgatgtgccctntggatcaactgccacggtcggaaagcttaagggatgttctggagagactccttccctattggaatgaaggattgctccgaggtattacgtggcaaaaccattctgatatctgctcatggaatagcagtagggcactcctaaacacctggaggtatctcagatgagacatcatcacattactcttctactggagtcccattcttctggaattggatgaaacctcgtctgttggcctatcagttctggtgacagagcgatcagcagcattaggaggtgagttcaggaaagtgacaagctaaaat

SEQ ID NO: 608991 - DNA, 137 bp, Homo sapiens
ggctctgggcatgggggagtggagagagaaggggtaggtggagttgagggaactgggcaggcacagtcacatcctggctgggatccgtgtagtgcttcaccgtggcatgtccacccggacttgccggctatggcact

SEQ ID NO: 608992 - DNA, 181 bp, Homo sapiens
tgggaaggagatgaacacatcaattgacatctttatggcatgatgaaactggagtcgactcacatccccaccggtgcagcttctccaagcatcaccttaccccccttgctgactcctaggtcctgaagcatgaaattcgggagggcacggctaaactcttagagaaacgggccctcctcca

SEQ ID NO: 608993 - DNA, 258 bp, Homo sapiens
tttccccccccaaactgtgtgtttgaaccccagccaaacaaatgtgttccattggtccaatatataagccttacccccccccccaaaaaatttaaaacaagtaaattaatgcattcccatgatccctttttgaaaatggttcaaagcatgttttcctgatggtgggattgtttaaatgccatgttttaaagtttttaatcctttattagttatgaagggcttcttttatatgttaagtttaggttgccaggactcata

SEQ ID NO: 608994 - DNA, 259 bp, Homo sapiens
  misc_feature (2)..(2): n is a, c, g, or t
  misc_feature (27)..(27): n is a, c, g, or t
  misc_feature (99)..(99): n is a, c, g, or t
  misc_feature (136)..(136): n is a, c, g, or t
  misc_feature (179)..(179): n is a, c, g, or t
  misc_feature (222)..(222): n is a, c, g, or t
tncccctcaaaaaatcctatcaatagnacctaattaaataaactctgtcccattatatagtcatagaaattaatgaagagcccaggcacagtgctgaancctgtaatccccagcactttgggaggatcacttgagncccggagttcaagaccagcatgggcaacatagggagaccccanttctacagggaaacccaaaaatgttagcaggatgcagtggggnaagcctgtggccctagctactagggagggtgatgtag

SEQ ID NO: 608995 - DNA, 211 bp, Homo sapiens
atctctttggtatttatatttttgacttattttttcacacctccattggtccctattcacgaactgctaaatttaaacagccccgtcctgttctgggaccagacacctagagttctcaagtgctaaaggcaacgacctccttcccatcctcactcaccagtaattccacagggccaggctcagtgagatctgtcaaggcaagaggggtgct

SEQ ID NO: 608996 - DNA, 107 bp, Homo sapiens
ccaaccccaccccatgagatgaagcatgagatatgcggtagcgcaacagagagctagaagcgggctccaggtggatctgcaggactgaaggctcacaccgcctgcct

SEQ ID NO: 608997 - DNA, 843 bp, Homo sapiens
tcctgcaggtacgctccggattaccgggtcgacccacgccgtcggtttctactatggggagctgaatggacaaaggggcctggttccatccaacttcctggaaggccctgggcctgagtcaggcagcctagagtctgggacatctcaagccgagagtcagagaacgaggaggagaagagtccagtgctagatggagctagtgtagagacatgaccccagaatcaccatacaagggcctccagtgcccccaggctggcactgtgccctcagctctggaagttcctccaggaccaaactgggggagtcacagagcatagctgagaagaagcagggtctcctcgccaaagcaaaggaacttctcaaaaggctgggctccaggaaagactgaggctgccgtccgtctgtcctgcagacagaagtggccctggatcaactcactggctggacagggaaacccaactcctgatctctgagcagactggcactcaaaggagcccaggggacctggtgagggtggggttacctgcacccttagtgaggagtcctctagatgggctcttccagagggaactgagccccagagtaagtaatcaagcaccaagcactgtcagatcaggactggacccacgcctctggattcccagtctgttctcatctactcctgctttgctaccacagctctgtaggtcccttcttggccttccctgctccaaggataggccctgggtgggagatagggaccactctaacgatggctctggctgtcctcccgatggatcgtttgcactggactgtccccctggggcgggggcagagccatgtacttactccagggtatatatg

SEQ ID NO: 608998 - DNA, 886 bp, Homo sapiens
catgttagcacgtgacaagaaagttaattattaatagtctgtaaacgtggatgctggctcttacgaagctcctacttcacagtgaaccctatggttgaattagaacagaacttgctagtcgtccacgaacagggaagtggacaatcatcacactatgctactctctcgttttcatgctaattgtggtcacagacagtaaggtattcaaggttaagtctaatccaagtcttagagatctttaagtatccgtaaaatagcagcctaagtagtcatcatgtaaagaagttgactttcaggaatgtcagcattgaccgtctgccttgccactgttactcagctaaagcataacttgccattcttaaaaataaaaaagctcccagccagaaactctagtgatactcagttttgacctcttactgcttccatgtgggacttcttttacagcttataagccattggaattttctacctgctatgttcctctctggaagaatatcaatttggaaactgcttgctttcaaatcaatgccatgatcatccatattgtgagttggtagtgggtgtcccagaagtgtccccatttgacaactttatgcacacacctggcaaatcattaacatgagcattcaacagtactgggatgggtggggtgggggtagggggctcaccaacatgaactggccagttgacattgcctgaagaaggcaccacctttacagggccagtagtggggttgggtaagcccagttttgaaaatttctatctagacctccgtattgaatggttcttaaagaaactgtcgtatattggagggatggaaatggcttaatcatattatcgaacaaatcctttttatgtgacacattataaattaattggtatatta

SEQ ID NO: 608999 - DNA, 177 bp, Homo sapiens
aagatggctgatattacgctgctactgatcatcctcccagcataaacagcacatgttatgcgtatctacacaaaacagcaccatcataagaaacaaaaatcaggtgagcaataatagtacctgatcttaacttcatatcactgaaagaggcacagaaggggaaagacaatcttgaat

SEQ ID NO: 609000 - DNA, 416 bp, Homo sapiens
  misc_feature (50)..(50): n is a, c, g, or t
  misc_feature (72)..(72): n is a, c, g, or t
  misc_feature (79)..(79): n is a, c, g, or t
  misc_feature (108)..(108): n is a, c, g, or t
  misc_feature (240)..(240): n is a, c, g, or t
  misc_feature (307)..(307): n is a, c, g, or t
  misc_feature (330)..(330): n is a, c, g, or t
  misc_feature (342)..(342): n is a, c, g, or t
  misc_feature (357)..(357): n is a, c, g, or t
  misc_feature (371)..(371): n is a, c, g, or t
  misc_feature (391)..(391): n is a, c, g, or t
  misc_feature (398)..(398): n is a, c, g, or t
tcgacccacgcgtccgcagattcatgggtgatttagcctatctgtcccangccagcgtggctgagtgtgctngctggangcttctctctctgctttcgaagggtaagntgagatccaaccccggaaaaccggcaggatgaaagggggcaagttaagagaagctggccatctgttgttccaaacctggtcactgtgttttgaagaaaaagcaaggaccccagaaagcaagcaccccagaangcccaagaaggctaagaaggacgtgcatcaaccgcccctgaatgcaagccttccccgaattccccangaccaacgggagaaaacgaattntcgggggaaagnccttggggtcttganccccaggacaattnagcaaggaggtacttgaacntccctgnaagaaaaaacttgttcca

SEQ ID NO: 609001 - DNA, 190 bp, Homo sapiens
aacccgacctgagcgggcgcacagagctggtggtgaccaatgtcacgctgcgcctgcaggaaatcacggtgaaagcctccaatgtgctgtcagaggggcgagcagcgcgcgttgggggatggctaatgttcctcggccggagctcgaaataccctagccacattactttcgacccgtttatttttcgacc

SEQ ID NO: 609002 - DNA, 166 bp, Homo sapiens
gctcacttcatttcccagagaactccagcctgggtcacacaccaacacacttgtctcaaaaacacacaaacaaaacacacagtagcatagaacagaccttcccctccctgactctggactttatacctttgttactacgatgctgtcacacacacacacactgatc

SEQ ID NO: 609003 - DNA, 388 bp, Homo sapiens
tctggatgcaagtgtctagcttatgtgacttttcctttctttatttttttttcttttgagatggagtcttgctgtgtcacccacaccggagtgcagtggcgtgatctttgcttactgcagcctctgcctcaaaggttcaggtgactctcctgcctcagcctcccaagtagctgggattacaggcgcccgccaccaccacgccaggctaattccaccacagtcattaccaacttgcactggaggttgtttattcatctaggacacgtccttaaagcttaaggcgctcctcccccagcagcctggcttgagggagaggcctgcctctgttgtgctcgctgtggtgggtggtaggcaccctaggtccttaagggacactttgcatccagag

SEQ ID NO: 609004 - DNA, 245 bp, Homo sapiens
gggggggggctttaaaaaaaccccccccccaaagggcccgggggcccaagggcccccaaaaggggtttggggggggttttaaggaccctggccgggccccccccccccttggccctttggggggacccgttttttttgtggggaaaaaacccttttaaaggcctttgggttttggggtcccccaaaatttgggccccagggggggggggggggtttttttccaaaaaaatttttttcccccccca

SEQ ID NO: 609005 - DNA, 424 bp, Homo sapiens
cagaagtctatttacactatactgtaatctaagtgtgcaatagcattctaaaccatgtacaaactttaattaataaacactttctagctaaaaaaataaaactgctattaatcatctgatggcttcatctgagttgcaatatttttgctggttggaaagtcttccttaatgtcaaaggttgctgactgatcagcggtggtggttctagaacataggggtggctattggtaatttcttaaaataacaataatgagcatcacttgctgcactgattgactctttcttttgtgaaagattcccctgtagcatgcaatgctctttgattgcattgtacccatagtagaacttctttcagaattggagtcaatcttcgcaaatagctggcactgctttatcaactaaaattatgtagtattttaaatcc

SEQ ID NO: 609006 - DNA, 432 bp, Homo sapiens
  misc_feature (240)..(240): n is a, c, g, or t
ttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttggacagtaagtctttctcagttcttaatgataatgcagggcacttactagcataagaattggtttgggatttaactgtttatgaagntaacttgatttccgtgttttgttaaaatttcattgttctagcacatctttaactgtgatagtttgtccgtttcattgcagttacttggtcttgggctatggattaaaaagtgttcttcatgagcctgtaagactactgtactgtgggctctaagaagagatagaatcctaataaaatctatccttggccttc

SEQ ID NO: 609007 - DNA, 415 bp, Homo sapiens
gggaaagacccgagccagcgggcgcgtggacgtgggtaacgcacggtccaataagggaggtctgtatggcccgttctggcagcgacgaggacgcgcctgagcagagcaggaatcacgaccgtcgtcgactccaggagcgcggagaggagagacatgaggctgagctgattacggattctgacagtactgtccatctgcctgagcgccgtgatcacggacacgtaggccgtgggccggaagctgcagatccatgtcaagatgcggatggaccactgtaccatcacatagcacatagtggatgttctgcacatgcactacacacagaagctggaatatgggacagactatgacgagatggctgactagccagccctatgacttcgagctagacgcatgccaggtgatccgggctggg

SEQ ID NO: 609008 - DNA, 179 bp, Homo sapiens
attgcagcctcaaacccctgggctcaggtgattctcccacctcagcccccctgtagttttggcactcaggaggctgaggtggaaggataacatgagcccaggagtttgaagttacagtaactatgatcatgctgctgtattccagcctgggtgacagaacaagacactgacttaaaaaa

SEQ ID NO: 609009 - DNA, 982 bp, Homo sapiens
taccgtcacatcgatgtgcccatgtgtgccacaatgagaatgaggtgccggtggccattgcaggagaaggtcagggcaccagtgtggtgaagcgtgaggagctcttcattcgttcaggcaaacgtccgtggtgcattgtaccatgagaatgatgcctgtgtgaagattgtagtgtgtgccaagacagtacactcagtgacctgaaagctggaactagctggcacctgctagcttatttcactgtgcgactttgtgtatagagccttgggaaggaattgcttccccattggtgtgactccgggtcgaattgtggtgtcccaagttgacactcaaacattctgtgaaaccgttgggctggccgatgcgaaagatgctgcatggatcgacaggggctggtggaagagctatttgtgatctcccataatttcacatcggatctcctcacgcgtgagatgatcttgtacaaacagaaccgtggtttggacgtataacgcgctgcagattaataccgcgtagttgatgtagccaacccataatctcactcagggagaagtttactcgcagtacttgcaggtcccaacatgtggatcggttgttgaccgttctagagccccctccgtgttgtacgtgagagggtctgggtcaaatggcgcgtagtgacctgtctctgcctgtaagggatcccaggatcagggggatcggcaggcaaggtccataggatgtacaggccatggtgctgatacggttaccgcattgcgcggaacttggtggtggtcccaagtttgtgaaacagacagctttggggggagcaaaaggtctctgagattgaggtgggaaccgggtttgccccttttccgtttactcggattgggagcgtggctgtggttggctccaggaatcctcagagagtgaggggtgggcctgcccagacatactgtgggcgcatcagcaatattatggacagagaaatagacgcgttata

SEQ ID NO: 609010 - DNA, 244 bp, Homo sapiens
tagtttaataatgggggaaaaaaaattagggtgctcctgaaactgactgtagagcatgtaaaatgattttactggattttgttccactgtaatcaatgaaaaaaatgtacgttgtagacaaagttgcagaattaaaaaaaaaaatttgcttttaatttattctttttgtattaaaaatttggataggatctttcccttttgcaaaacagggttgtccacccttattaaagccttttcaaaatga

SEQ ID NO: 609011 - DNA, 224 bp, Homo sapiens
  misc_feature (25)..(25): n is a, c, g, or t
gatcgagctcggtaccttccagccnacgccaaacactgtgtcccacgtctgactcagactgagcagctgtgaccaggacagctctccgagatgtgatgagccacaaccccaccatagcactaagaggaaacctaaatgtcctgaagacggaagcttcagagagaaaacatacctgacacacagtggacacagccgagaattcacgcaacgcatttccatatgca

SEQ ID NO: 609012 - DNA, 912 bp, Homo sapiens
  misc_feature (57)..(57): n is a, c, g, or t
  misc_feature (101)..(101): n is a, c, g, or t
  misc_feature (702)..(702): n is a, c, g, or t
gttttcatcctcctcatatacttcagcaggttctttgctttcaagattggaagcatngccaaagacagccatgaagaaggaagctgtagaggtgtttttgntgtgtttattttgctttgtggttgagggaaggacaagagataagaggtgttacctcagtaaaaaccttcaggccacaaagcaaaaagttgcatagccacaacgaagatctagtgggatatagttttgatttaagtggcagttatagccaatttaggctaatgcttggtttggagcttttatacacaacgttttgttaggcatcacagtttgcaacctctgctccaaagagaaaaatagaatgagttttctttctttttttttttttgggagttcagagtctcgctctctggtccaggctggagtgcaatagcgcgatctgggcctcactggaacctccgcctcccgggttcaagcaattctccggctggcctcctgagtagcggggataacaggcgtgtgtcaccacgctcggctaatttggtattttagtagagacagggtttcaccatgtcaagcgggtctgggactcctgacgtcgtgatccacccgcttggcctcccaaagtacgggattaccgggcgtgagccattgtgcctggccgagtttctaaaagtgagagtaatttctggactcttagtggatccatattgtgtccataantctggatccattgctatgtggccatcaggaccttatataatgggggttattcaatattaggggatcaggcggaagggataaaaataagggtagttgaaacattgatttttgcaggagaccaagaggaatggaagagagaacaaaatcctgaaatgggagaccgaaaagtgtttcaattttaaaagtgggtgagtgttttgataagtttct

SEQ ID NO: 609013 - DNA, 876 bp, Homo sapiens
tcgctgtctccatattggcccctgttctccgctcccgagcccaaattggggcagagtgttagatcggggtccccctgccagtttccccgttgcccaccgtgacacagtgttaggggcgtaacaccacacgttgtgcagcactgttgggcgtctatacccaacgtagctctcgaagtgtgcggcgcttgtcgcctccaagtcactttggggcgtcataaatatggtagcactcgggggtcactacaacacacaacacttgcgttttgcggcacaatgtgttgaccccaccgcttttgtgcaaacgccaatcacattattgcctcccggggccccacaaaaccccaaacctttacccactgggaccccaccaaatttcgcctaatatgtgagggacttcttcctcaaacccaataaccgtcgtcaacctgtcaaaacttcccctctcaccaacatgcgcaagcctatccatcatttgcacgcggaaaccctcttgtcctccaccaaacgggttttatcctcccccaacaacccctctctcatctcttaacccgtactgcttcttgatctcacaaaacctattttccccccgggccaaatttccacttcacaatatataatcccgcccccgaagccaatttgtctcaaccccgttactgcttagattagtctcacggccgcttattaatacctaaacgctgccccgccccaatatggagtcccctcccggagatctaatacccttacaccccttttgccttctatttaaaattaattccacgcttcctacacctatttattaaaggttatcgcccccccccccccccttaaatttttttccccccccccccaaccttcccccctctaccccccaaaaaa

SEQ ID NO: 609014 - DNA, 125 bp, Homo sapiens
taaaggtgtagcagtcatcgataccagacataatagagcagctatctatagagcacagcgtgcggagacgatagccagtgcccctgggtagcagggatagaggcgtaccagcacatgagccgcag

SEQ ID NO: 609015 - DNA, 306 bp, Homo sapiens
gtctctagcacggatcccctatcgtcgaagaacaacggcagataggcaaaggtgatagcataggcactgctctttacatatacagcagtgtaagatgaaaggaaacgttattggctattctcatttcaggagtcaagttgcctggttgcatgacatgtgtaatcacgctattcctaccagattcccagataccaaagttggccacactttgtgggctagaagtgtgtttttgtagtcttgtatatattatatcttagcagagtttctatcattggagagaatttgaatattctgtcaaatcgctta

SEQ ID NO: 609016 - DNA, 108 bp, Homo sapiens
gcggacataagcttaacacaagggtataatcttcattttgtaattaataccatgtggtttacagcgtactgaactaaatctgtggaatgcattgtgaactgaaatgag

SEQ ID NO: 609017 - DNA, 134 bp, Homo sapiens
gtgccgacctgctgcgtgccaccgcctacgcgggcaagcgtgctcatcaggctgtcggaggatgcgcatcagcgcgcaccacgtagcccaacatggtggccaccggaggtgtgggtgccggtgacggggatcct

SEQ ID NO: 609018 - DNA, 259 bp, Homo sapiens
ccggaatgtagatactgtgaagaatgtcattggtagtttgataggaatagcattgaagtttgtattttgctgtgggcagatatggccattgttaacaagtattgattcttctatatccataaaacatggagatgtttttccgtgtggtttgtgtcatctctcgatttcttacgtgcagtgattttactgattctcattagtagatggtttttcaccatccacagtttatctagcatttccgggtggtaccgaggctcga

SEQ ID NO: 609019 - DNA, 312 bp, Homo sapiens
gagctctgtttaaataaatattgtcctttcatgtaaattattctggatgtagattgagcttattaaatgttcacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcaga

SEQ ID NO: 609020 - DNA, 149 bp, Homo sapiens
tataccagcctataccactctgcataccaccttttaccacaccttaaaactcactaccagtctaagctacacaagttcaccattttacagtataatgaaaagcactacctccatgagaattcacgtgtggatggtatagacctcgtggt

SEQ ID NO: 609021 - DNA, 146 bp, Homo sapiens
agggctcatgtatctatgcagagtccaagtttcatcagcactgaaatcaaccatgccgtcgtaacggtctccaggtctccctcgtctgtcataagccatgaggtctccccctctaggtggtggtggtggagagagcctcatgtgta

SEQ ID NO: 609022 - DNA, 536 bp, Homo sapiens
  misc_feature (465)..(465): n is a, c, g, or t
  misc_feature (467)..(467): n is a, c, g, or t
gcgaattcactagtgattgtgagctgagatcgcacccggtccaagcactggctttgagataagcaatattaaaaacattttcagcttcatcagatgctgactaactgacctccaaccactgttccaccagccataactacagctttggttggacaagtgactgatttcagtaactttttcctgacaaggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttgtatgttgcatgcatgtttgttcaatatgcatgtgtcagaaccactttcatgaatattcatagctcctcatgtaacctgttgaatgtgtatgtttagtcaatccattgagcatgaagctcctaccctaancnctccttctttgaagtgcctgtctctggtcttggctggagacatgcttcccagcaggtctcactcccttt

SEQ ID NO: 609023 - DNA, 256 bp, Homo sapiens
  misc_feature (8)..(8): n is a, c, g, or t
tcctcgtngggtactaggctcgagtatggactctatggtgggggaaacagagaccccctgacagtctttaaagaggggagagatggatcaggcctgtaccgtaccctcagggaggttataaagcatatacagaggtacagacccatctcctgtgcttatatatgtcatggggcctttgcacatacttggacccttgaatttcattcctgtgcttccccacagcacttcccatggttcactgcacgcagctctattc

SEQ ID NO: 609024 - DNA, 261 bp, Homo sapiens
catgagctggaggacatgaagatgaagaactctgtccttaagagtgaaatccacaaggggaaagcccaccaagggcagagccgggccatcgagcgcctgaagaagaagaagtttgagaatgagttcctgctggtggtcaacttccccacaattccgttcaggatccacaatcggaatggaaagagttacctggtcctactggcctcggactaccaaagggcaaagtggagaaaaacaattcaaaaacttctctggaaagtg

SEQ ID NO: 609025 - DNA, 409 bp, Homo sapiens
  misc_feature (237)..(237): n is a, c, g, or t
  misc_feature (378)..(378): n is a, c, g, or t
aagtgctcatcgactcatgatgtgcgccctccttgcttgggcagaccgtgcagtatttaacacatagtagcagaatatttactgttgaagcttgaaaagatgtgagctctttgtgtgcaatttttcatttatgcatgtgagaaggtttttggtttttggttatttttaagtatttttacattgtagtactcgtttttgcttgttggtggtgtttgcttatttaatacattccgtcanggacagaaattacatgctttttctcttaggaagtgtgtattgggtttttccctccccctctccccttggtggtgatggtggtgatgtttaaatgaagttgcttttacagcaccaaagacttaatcatccatttccttatantaaaaaggtagctactttttgcatagacccc

SEQ ID NO: 609026 - DNA, 166 bp, Homo sapiens
cgttactacattttaaatggatggaagaggtagagtaggcggtataaagtgtaaggtctgaagtggagggtagtataatattacctccaaatagactctggtaagtaggtgatacatatcgttacagctctacacactgagctactacaacaacactacaaccgac

SEQ ID NO: 609027 - DNA, 1012 bp, Homo sapiens
ggcgaaacatgctttctagaaattgttttcagtggcagacatagtcatttgctcttatgttgtcttcgagcaacacaaatcacaatcttgtcattgatttgctcgctccatattcttcacgcacattgaccaatgcagtataacaaacatgtgagcttatgggagtgtattttatcgatctattgtaactggttcagacaacggggcataagcactttgtcgactacgaagacccaaaaacctaccatatttcgagaggtctccctcataaaccaggatctaatcttccaaattgtgtctataacttctagcaattatcatgaacgtagttataatggccatggggggcaacaacaggcgatgcgagacgagccaacaattttggaacaccagccaagaacggcacccccacaccccgattgacgcaccactcttggcattacaacgtcaccctacactttccttcacacatctacctctcccccgcaccaccgccgcattgattccctcgctgcacgacacgcaaattctacagtccttgctccgtcatcacctatgtacatttcaacttcttaaattcctaccaaaccaccgagcctcacctggcttcttccaaacgacgccgcaacaatacttccagcatattccaatacgacgctataattcacttattgcccccaatcagcatcatcacgcggcattcaatcccgcaacatatatttaaaaacattagaatttaacaacacatttctgcccgtcttcgggccccacttccacaacgtgggcgacaacctctagcccacacaacccaacccagggaggccaccaaatagcacgtgctgagccggcactaggatcggagggcacataaggcgctacagatgtcccccgatacgtgggcggcctaatatccgtcaaggaacccggggaacacaaggtacacaccgtaggcatactcgcggggggaaacgaggggaaaggcacaccacaccgaccgccccagtcaccccgg

SEQ ID NO: 609028 - DNA, 446 bp, Homo sapiens
  misc_feature (124)..(124): n is a, c, g, or t
  misc_feature (158)..(158): n is a, c, g, or t
taaacggagctggactttctcttttaataatcatatagttgtattgaatgtaaaacacgaacagctgtctggcgtacgacggtgtgagtgatctgcagagtcgcacagtcctcagtgtagctanagtcagtgcctgtgtggtgaacccggggactccnccagtgctccaggcccagtgtggctgacttcaagataaaggcagcggtttcttccactcctcctgctgccccttccagcagaggctctggggcacccaccagcagatgtgtccaaggtcctgcaatgcctaggaaccttgggagccatcttcctccctctgctcatcctcttcctcagaccgtgcgctggccctagatgaacttgacgcacttggtcttgtcatggggcaggcgtgtcttgaagagcacagaatccgccctgaaatgcgtgtacaggaggggcctgta

SEQ ID NO: 609029 - DNA, 384 bp, Homo sapiens
tgcaggggctctgtggctgtaatcatagcgcattaggaaaggccaagggtgggggtggatggctgtgagtcgtcaaaagttcaagaccagcctgggcaacagggcaaaactccattctctaaacaaccatataaaaatgagatgggcatggtggcacagaacctggtagtcccagctagcgtcacgaaggctgaggtcaggaggacccgcttgaggcccgggaggcagcagaatgtcgagtggagccgagatgagcgcccatagggaactctagacactgggagacacgagcggagacatccgtcttagaaaaaaaaaagagaaaacaaaacaaagaacaaacagagcgaaaggatacgcccaccccaaaagggttccaaaaca

SEQ ID NO: 609030 - DNA, 149 bp, Homo sapiens
ttccccccccccccccccctccccccctctcccccccccctgcccccccctcccctcccccccccctccccccccccccccccccccccctccccccccccccccccccctgaatagacttcactatagggcgctagcctctgtttgca

SEQ ID NO: 609031 - DNA, 303 bp, Homo sapiens
ctgaattgtctctagttacagccgggggtgcgtacggaatcatcctcacctatgatgtgaagttaccgctcagaagctggctaaagctgtcggaccggatctcgggcctgacagacacatacagcaaagactgcctcttcaccatcgtgaggaacaaagtggacctcactgaagagggggccttgcgcgggccaggagaaggaagagtgcagtcccaatatggacgctggggaccgtgtctccccaagggcacctaagcaggtgcagcctggaggatgcggtaggccctctataaaaatgatc

SEQ ID NO: 609032 - DNA, 734 bp, Homo sapiens
ttccacttgctttttaaacttagttcttcacctccattgacactcgttttttggttttctccctatagtgtgggttggtgctagacaccagtctgacccacagaatgggagttatttcatccatctttcctcctccttccaaaaaccacatatctacacaaggaataatttaataccatctaggacattctctctcttctttcacattacaagcctatttaaacgagatgcaatgtggccaaaggttttaccacaatgtgaaacatacaccgtaaaacagacggcatgtgtttaaacctgagtttatcaggcatggcaggacagttgcaggagagagaggcagtgacccaagccagtgcacttgatgtccatggacatatatttttctttacaataataaattacacaccattttaaactagaagcctacctggacgtcgtccgtcggcgctgagatactgcccacggtgaaccaacagcttggacatagtcaccggtccggtctactcttcttcagggcgggacggggggccacgtcggggctcgcgacagaaacgcttaccctgaacgtgacccctgagcgtgacacggtatatgaacaggccttgccaatggtccacaccacgaaaaaaccaacacaaatacacaaccacacacacctataagcacgttgaaaccaacaactgccgtcccggccgttatactattacagtgaacactggacaactaccggc

SEQ ID NO: 609033 - DNA, 392 bp, Homo sapiens
tgtcagcggacattcactgtactgggatacaggcatgagccactgtgacctgcatgtgtcccgtgtatttgatacaaataaatttgagtagccaaagcaaaaaaaaaaaaaaaatccctcaagttcccatctttatttctcctgtgaaaaaataaaaaacctattacctaaaacataaaaatataaaagattaataggacctcaagtaactttatgtgccaataattcaaatgaagatgatcccaattaaataataagggggcatagattggtaagtagaataacatcttctaacctggccattagtacacattatttcaatccaactggcaccacattcacagtaaatcatgcccccagggataaaggtttaaagaaaatgtgcatgtata

SEQ ID NO: 609034 - DNA, 182 bp, Homo sapiens
gagctgctatagcttaccatctatgcgtgggttcaacaggaactgataggtctgccaagcccgtgccagctcacgtccagcaatgtctgtgtgcagctcatctggacgctggtgtgacagaagccagactgcatatgcgatctgtgtgtggcgaatagatgtcacctacgagcttgctagga

SEQ ID NO: 609035 - DNA, 550 bp, Homo sapiens
gctgtgcggtttaatctgacgcagcttatgcggaggagaatgtatatatgtacttatactaacattatacttctatagggtgatagattggtccaattgggtgtgaggagttcagttaaatgtttgggattttataggtagtgggtgttgagcttgaacgctttcttaattggtggctgattttaggcctactatgggtgttcacatattttactctctctacaaggttttttcctagtgtccaagagctgttcctctttggactaacagttaactttacaaggggatttagagggttctgtgggcacatttaaagttgaactaagattctatcttggacaaacagctatcaccaggctcggtaggttagtcgcctctacctataaatcttcccactatattgctacatagacgggtgtgctcttttagctgttcttaggtagctcgtctggtttcgggggtcttaactttggctctccttgacaagttatttctagtaaattcattatgcagaaggtataggggttagtccttgctatattatgcttgg

SEQ ID NO: 609036 - DNA, 766 bp, Homo sapiens
gccagtcgttcgccggaaagcatttgtctcccacctcatcataacaacaattaatttcctctggggcctgaggagggcagaatttcaaccttcggtgtgcttgggagtggcgcatgtgatttacacgacaaaatgccgaggtgctcggtggagctcatggcagtgcccttgtgtggaagacttgggacttggtgcaacaccctgggagaaggtgcctatggagaacgttcaacttgctgtgacatacgagtaactgaacgaagcagtcgcagtgacagatcgtacgatatgaagcgtgccgtcagaccggtccagaacaactattacgaaagagatctggtatcaatacaactgctacaatcactgacacatgtagctacacattctatggtcacaggagcgaacggcaatatccacatatccatcttctgcgcagtactgtagccggaggagacgcttttggcacagaatagaagcagacataggcatgcctgaaccagaatgctcacgacgatcttccatcaactcattgcgcaggggtggtacatctgccatggtatggcactaactcacaggggattttacagccagaaaaatcttctggtggcatgcacgggctacacctccaaatctaagacttgggtgggcaaccaggattccggaatcataattggtgacgtatgtgcacccgactgtgtggacctaccctatgtgctccgaacctctgtgacgcaagacttctgcgaccaccgtcgtgtgccgtgaa

SEQ ID NO: 609037 - DNA, 909 bp, Homo sapiens
cagataggaggctactgcggtagtacagtgaagaaatggacatggatgtttgtaagcagaacatgaagatgaggaaaagtgagcagatccagacaggttggggagtgccgcggtcttgactagatgtattggaagtgcttcctaacgtttggatcttgatgcagccactggccccaccccagaccaatgcacgaagaacccagcggaagcagaaaccacaaaacggcaaaactctcctgctccttcaaatacgactagaagcacgaaaccgtcccctagatcgtccattagctccgttcgatagagaacccttcacactaggaaagaaacctacctatttggcatgagctagagccctcgtagttccacgcgggtaatggtctacgtcgcgggagcaatttacccaagattcagaagccgtcctctaccaccgagcacggaagagacatgaaaggagccggcccgctgtccgagggcaacgaagccaccgtgtgccacataggcatggagtggtggaccaggacagacgaagagaagttgatgaccgaatgatgtgcagtcatagatgacgcttgttgcccgcaagaacatgcatctatttgcctagtgaaggctccaaacaacttatcacgcgttcaaggagtcctaactaaagtgctacagatcaccatggaaccactcataccatacactcgtcgacaatgcctgtgagccatgcatccagactcgtacacaagcaagatttcccacacatgaaagtgcccttctcctggtccctcgcattgacttttctgcatcaagggtaccctattcaactaagatccaccctattacacgagacgcgcaatggcaaacatctaccctcattgcacactttacaaaatgaaaccatcggcaccacaaatcaca

SEQ ID NO: 609038 - DNA, 660 bp, Homo sapiens
  misc_feature (149)..(149): n is a, c, g, or t
  misc_feature (181)..(181): n is a, c, g, or t
  misc_feature (233)..(233): n is a, c, g, or t
  misc_feature (276)..(276): n is a, c, g, or t
  misc_feature (361)..(361): n is a, c, g, or t
  misc_feature (375)..(376): n is a, c, g, or t
  misc_feature (592)..(592): n is a, c, g, or t
gtagctgggcgtgaaaacagtacgaaaagcctgacgcagggtgagctggaagagattacagtgaaacagtgctactttacatagtgtggtcttaagaggggatagcgaggagtctagtgaacttagcgtgtgcatagaagctctgtagnctcaatattagagcattggcagcgcgaagagnagaattctgtagtttcaggttactgaaaagccagaatacgcagggtggacantaccatgagaggtactgttatgtgggactcagagtcaatggantggagttcaccaacgcctgatacgttcccactaagtcacatttgaggacggccggacgcgtggtgtgcgaaaatcactcccttgngtgtgcaactccannggagttcaacagaccccagccttgtggcaaacattggcaggaaacttccaatctttctacaaaaaacaattaacgaacaaattttagctgggcagtgtttggtggccctgtagtccacagcatactacagagcaggctagcaggatgagaagcgcggcaggcagggcttcgcagtggaggtccaggcatacaatgggccactggcacctcccaagnccctggtggcaaccaggaagtcaaagaccccctggtctacagaagaaacaacaaaaagagatatagaa

SEQ ID NO: 609039 - DNA, 759 bp, Homo sapiens
  misc_feature (53)..(53): n is a, c, g, or t
  misc_feature (61)..(61): n is a, c, g, or t
  misc_feature (66)..(66): n is a, c, g, or t
  misc_feature (81)..(81): n is a, c, g, or t
  misc_feature (127)..(127): n is a, c, g, or t
ggaggaggtggcggcgctggagctcctcccggggaccagcgacccggggagcnagcacgtngttcngcaccgctcttcctncagccgctgagccgtcccttctcgccatgtcccagagcaggcacgngccgaggccccgcccttggagccgaggacagtgggaccttcagtttggggaagatgataacagctaagccagggaaaacaccgattcaggtattacacgaatacggcatgaagacctaagaacatcccagtttatgaatgtgaacagcatctgactgtgcaaatacacgtgcccactttcaccgttcagcaggtaaccgcttggtgacataacctgcacagtgtgacacggtacaacgctacagaacgcctggccgacaacactagagctgcacgaggctgccataaacattctcgcaaacgccaatgcacagctatacgcttcgcagcttcctgaccccttaactgcctgacccttccaagcaaccaaagaaccagcttaatcctattggttcattacaggaacttggctattcatcatggctggagacttcctgaactataccctttcccaggagggagcgacctgctcactaagagcagaatatactacacatttgcacgggctagcagtcactttatgcgaacactggcaacgcgcggcccctcacaaacaagcaatgccacacagcgcatgctgctgccgaacctccctcgcccacatctagctcctatctctccagagtaaccacc

SEQ ID NO: 609040 - DNA, 829 bp, Homo sapiens
agcgggggtgcggcgcggcgcggggcggggccgggcgggacgctcggtcatccccgccggcctcgccccgggccatggccgccggccccgcgccgccccccggccggccccgggcgcagatgccgcatctgaggaagatggagcgggtggtcgtgagcatgcagggaccccgaccagggcgtgaagatgcggagccagggcctgctggttaccgtcattccccacgcggtgacaggcagcgacgtcgtgcagtggttggcccagaagttctgcgtcctcggaggaggaggccctggacctgggcgccgtcctggtgccaggcgtggttacatctacccgctgcgcgaccccgcgtagcctcatgctccgtgcagacgagacgccctacaggttccagggtcaggctcgggggttgcacggtgggagccggtggggacccggaagagaacgagagcgagccaaggctttacacaagtcgggggaacacagggagggggccggacacgaaggcttgacagcgaaatcgggcacggggggaataccgggccaacggatgggccagcacagacatcgactgagtgcacacaagacacaggcataagcgaaaaagaggtcccagggaaaccgcacaaggaacgggaataaagggatgaagaaacggggaacccccagtcatagcagggagacatacagacagcccacacaaaaaagtgtcaaccgagagcgaacacaaacgagacaagaggggccccaaacacaaggagggaccagaaaggctgccagaaggagaatgcctagaacaagtcattcccataaggaggggaacaca

SEQ ID NO: 609041 - DNA, 1092 bp, Homo sapiens
  misc_feature (308)..(308): n is a, c, g, or t
agagtgctttcttttctcctccacccatgtgggtgtgtcttctcttcttgtgttgccatcattttctggtggaatttgtggctgcctttcccgcatatatacctggtgatcttctaacgacgggggtgatgtaactacgacccacacaattgtgggccacatttggttgatacccgggggcacttccctgggggctttcaccggtttagtgacccgcggactccctccttgtgaagaatttctggtgttgttccactttgtgggtcccccttgtaacctgtcccccagggggatctctttctcccctnaaggcatacagtcttgacttccttaacctgatggaagtgttgtaaggaaaaaggatttttcccctgaagccattggaaatcgccaatgatcacctcttgagtacatggttttgaaagaaagtgcccgattgtaattgaaaattccacatctggaccaatgtcctaaatgtggggaacttgaaaagaagtcagctgttgccagataaacatgaattgctcaagccttgccagcagccaatcatttggggaagaatcacacgttgctgatggacacgagtggatgaaatgagccacagaaatagttaaaaaccacacatacactgaggaatactagtaaaccacagcagcaggaacactcagtatcagcagcgtcgccagcacggagaaaaatgcagcgccagagccgaggagaacccccggctccctgaggaggacctggccaaactctttcaaaccaccaccagccgcctgccacggatggactcgctgctcattgcaggccaagatataacaccttactgccagaacatcaaggaggttcacctgccccaaaacttaggcaagcttttcatggcccaggcttcttcaagaataccacacactaagaaaaggaagtttccagaaaagaagttaacactgaacttcttgaagtcacacccacgggcaaattcttggaagaaatatatttgcatattgaaaagcaccagaggatttctttagtgtcattgccgattttggctataacagtgtctttctagccataataaaataaaaccaaatctta

SEQ ID NO: 609042 - DNA, 1131 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcatagaagggtactccccatgcatccttggtggcaagggggtacgcaagaaaacaggcagcatgcaggtcggcaggctcaggaagcatgcagcagagcctagtccaatattacacaatagacccattagcagaggcatgaagagaggactatcaaggacgttccctccagcatactaccttaatctgggaattgacataagacgagggtgagccttctc

SEQ ID NO: 609043 - DNA, 1074 bp, Homo sapiens
  misc_feature (29)..(29): n is a, c, g, or t
aatctaggctaggtacgaggctgggtgtnggtgagagggtgacgcatgtgccctctggcagtctgctgctgtgtccagagtccgactccagctgggctgtaactgggcttggcccccgccttaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgcaaattctgctgattctggggtcagactgactccaaggtcagttggtgcttgagggttcctggtctgggggagtggacaagaccagagcacagagagacagagagaactctcatttcttaacccctgggggaaaagggctcagggagtcctcaatggcctcacgggagagcacaagtgagccccggcgggaagagagcaaggagagagagggccggaccgagggaaaacacccctggaaaaaaacagaaacgacgcgccgggaagaaaggcagacggaagagcaacaacagagacgg

SEQ ID NO: 609044 - DNA, 842 bp, Homo sapiens
tcagtctactagcatattcagatccctggaacagcccagttggaaatcagcttgacccgattcagagagaacctgtgtgctcagctcttaacagtgcaatattagaaacccacaatctgccaaagcaacctccacttgccctagcaatgggacaggccacacaatgtctaggactgatggctcgatcaggaattggatcctgcgcatttgccacagtggaagactacctacattagctatgcaatttcaagagctcacacttatattcgtggcatatagtccacatggaagtagaccagctctgctgatttcgaacatttcagatctttaaacttcatgtacctggggaccaggtttcatgtcgctttcacacttgcttccctagtttacacgcatgatgccacatgatttttctaacctagtggttaggagaaaccttatttctccatactttaaacctcttagattgtctaagagttcacatatttactgcatttccaggacgttcacaattgatccatcaccaaaatcctttacaacacattacttaaaagaaaccaaaaattcctggctttctctcgtgggggcaacggccgaccagaaggggaacggacactcggacccacgtcgcgtcgtgcagtcaagccatcgttgggtcaattgttacacgtttcccaaaatttggggagcactatgttccgaccacccccaatgccgcatattctaagacatttcaaatcacggggtacaccttgccaccaattgagtaaacatcccgcaccaggtgtgcacattactaccgtgtctgacgggcaaaagcaactcttaaacatgagtacccg

SEQ ID NO: 609045 - DNA, 138 bp, Homo sapiens
cgacacacttgattaactttatgttatatttacggactgttatcatcatcctttggataccatttgaatgtcgtggctaatggaaacatatcatattctcgaagttcactagttgtgctttctagttactttgagcaa

SEQ ID NO: 609046 - DNA, 1688 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 609047 - DNA, 692 bp, Homo sapiens
gataaaatgatgagatgaaatgagatgaacgatgagatgaaatgatgagatgaaactgagatgaaaaatgatgagactgaaaaatgacgatgaaactgacaataatgaaatgagatgaaactgaaatgaagtaatgaacaggaaattatgaaatgtaatgatgaacattgaaatgaaattgaaactgagatgatttgacatgactgagatgtaatgactgaaatgaaatgatgaaactgagatgagactaaaatgagactgaaataatgagactgaaatgacgactaatgagacttggatgagataaaactcatgagatgaaactgaaaatgacacactgactggcctgacacctcgactgacgactgacaactcggacgacttgacaaactgtaactgacgcactgcaacacctgacacactgaccattacatgcaaattgaaaactacctgacacactgccgactgacaccataactcacacactgaccaactcgaaatggaactgactgagactgacgcagaacctgactgacgactgaacacatgatgaaaactgactgaccaactgagactacaactgcggctgaccctgatgacaactggacatgagactgaccctcctgacgactgacactgatgagatgccacataccatactgactacgaatgccactgccttctgctgaccc

SEQ ID NO: 609048 - DNA, 1665 bp, Homo sapiens
ggagtatgggatatgtcgaccacgcgtcggcagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 609049 - DNA, 217 bp, Homo sapiens
gagaggatggcgcgcaggaccagagggaagacaggggcccctgttctcagcagcttgtagggacctttcctcatcacaggtgacgtgagagatgatgcaaaggccatggggtgcccacggggcacagaccccgaggctgggctacaaggcagggtgaggccagagatgaagcttggcgacctgtcccagggttctccctgatccaggggcacgcagc

SEQ ID NO: 609050 - DNA, 250 bp, Homo sapiens
aaccccgaagtggcccaaatgagtgcagtggcaccgtcatgcctcactgcagcctcaaacccctgggttcaagtaattcttctgtctcaccctcctgagtagctgggactcttggtgtgtgtcattatgcccagctatttttctagttatttgtagagattgagtccagcttacttgcccaggccagttgtgaactcctgggctcaagtgatccgcctgccttggctttcccaaatgctgggatccaggt

SEQ ID NO: 609051 - DNA, 1452 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaacaatttgagttatagtattgtgtatacagggtccaaatatcaatacaagacacataagcaagagagggcttaataaaggggttaaccaattccataaagaagactggaatttattaaagaggcattgtagccactcggggatcaataattttgatttgatttttaagtacttgtagattttcttttaactagaggcattaatccgaaagcagcatgtttcattgaaaactgcatcactaaacccaataaaaagtcctagca

SEQ ID NO: 609052 - DNA, 1939 bp, Homo sapiens
  misc_feature (16)..(16): n is a, c, g, or t
agccggcatgggagtnggaatggccacaagtggccaacggaaagcaggtggcaggacaggaggctgtggtggggcctgaccgagcagcctttccttccaaatctgactgtggcttgctcaggcccctatggtggctgtgaccctgttttgtccatctcctttcaccaggacccgccgggtgagggtgactggagcacattcctgggcttgggggtgggaagggagtctgatttgcctggggttgatgtgggggggtttgggcatgggccgtgactcacagagtagatccagatccgcctgctcccctcatatcctgttattcagaaggctgtatccgcttagaaagtgtcttttgtcctggggtgagagggtgacgcatgtgccctctggcagtctgctgctgtgtccagagtccgactccagctgggctgtaactgggcttggcccccgccttaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 609053 - DNA, 1607 bp, Homo sapiens
  misc_feature (29)..(29): n is a, c, g, or t
aatctaggctaggtacgaggctgggtgtnggtgagagggtgacgcatgtgccctctggcagtctgctgctgtgtccagagtccgactccagctgggctgtaactgggcttggcccccgccttaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 609054 - DNA, 1636 bp, Homo sapiens
aagctattagtgacactatagacccctgggtcaaaaagcaggctggtacggctccggaattccgggatatcggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 609055 - DNA, 441 bp, Homo sapiens
ctggaggctgcagtgcatattgctatcccagcagatctttttattccttattttttattttcgcgatgacaggatctagcatctgtcacccagtgctagagtgcagtggagtgatcatagtcttgctgcaaccttgaactcctggcctcaagagatcctcctgccttagcctccccagtggctgcgactataggcgcattgcaccgcacctggctcaaagatctttctgaagctcactctacttttcctgtggttctagccctttccttcctgtttgaggctcccttagggtataaaagtcactctgcagcgtctccactagagtaaataaacaattctcttgaggtccttttctgccccaaccatttcaccttctctgtgtctttatgagcttgacttaacaggaagttcaccttctggcttctgtttaatagtattgtc

SEQ ID NO: 609056 - DNA, 1664 bp, Homo sapiens
  misc_feature (16)..(16): n is a, c, g, or t
agccggcatgggagtnggaatggccacaagtggccaacggaaagcaggtggcaggacaggaggctgtggtggggcctgaccgagcagcctttccttccaaatctgactgtggcttgctcaggcccctatggtggctgtgaccctgttttgtccatctcctttcaccaggacccgccgggaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcattaaaaccttcccactccttggaaaaaaaaaaaaacaaaaaaaaaaaaaaaaaaaagaaaaaaaaaaaaaaaaaaaaaaaaaaaaaaaaaaaaaaaaaaggaagagaaaaaaaaaaaaaaaaaaaaaaagagaggagggggggcgagccaccgacaaaaaatgtcaccaacgcgaagcagcggccggcacaactcaaggcaaggccacacacatccttaaaagaacaccacggcgcggcgcgccgacgcacaacaagcagaccaatcctctaaacaacaggacgcacacgcgccggctgcactcatacacccgggggcagcgaaaggcccaccaaccccgcaacaccgcaggagcccaactgtcgcggagagccaccaccccgacgatgagggggaaagccccaacaaggccaaaaaccacaacagacagccgaccacgggcgcggccaacacagacacaccacgccagggcgaacgacgcaccaccgcagaaatagcagaggaacaaccaccgcgcaacaa

SEQ ID NO: 609057 - DNA, 148 bp, Homo sapiens
atgaattcatacttggtaccagttgatggaatcactttccaacaatatataatatatttggggttgttaggtagttgtgttggcttatagttcattgtgagatttctaagtagatcagattgcttcctagttagtatctcgaattaag

SEQ ID NO: 609058 - DNA, 1299 bp, Homo sapiens
gccaaccccaggccaagtcaagaaggagctcagccactatctccccaccgagccagctcagcgggcagggctgggagggagtgggacagattctgggagtgcagcggggaggagtcccggctgggctgagcgcagggagctgcttggcagtgccagagcccaggccccagagccctgctggagaggaggcagactgaggcagcaggccccgccagcaggcgaagcagggagatgtcagactgctacacggagctggagaaggcagtcattgtcctggtggaaaacttctacaaatatgtgtctaagtacagcctggtcaagaacaagatcagcaagagcagcttccgcgagatgctccagaaagagctgaaccacatgctgtcggacacagggaaccggaaggctgcggataagctcatccagaacctggatgccaatcatgatgggcgcatcagcttcgatgagtactggaccttgataggcggcatcaccggccccatcgccaaactcatccatgagcaggagcagcagagcagcagctagagacccctttggccacaccttccaggcactggcctgatgccccgccctggtgctctccccaggctccctcctcagcctcctgcccacccagggccctttactctcttctccctccagaccttcctctgacccttgctgaactggggtccctttgtgagtgtctcagtctagaggtacctccctccctggggggtctcagctcctggagtcgcaggcccttggggcccctctgtgagatctcaatgctgtctggggaccctaagagttttctcacctgttcagtctcatctaaccttccaatgtctgatgttcctgccaaattcctgcctgattctgggtccgtcctgacctccaaaggtcagcttggtgcttgaggtctccctgctcttggtggcagtggtagcagcaacagcagcagcagcagcagcagcagcagcagagacctctccactttcccttagcccctctgctgggtagagaggcactttcagggacttccctccagctgcctcttcatctgggaatgagctaagcaaggctgagcctcctcctgttgcttgaaataatgatgatataaaggctggatttggagtttgtatcccctggtccctctgggatgctcccatcattgatgtggtgcgatcgggctactacaaagtgtctgggcaagcgaaagctcaaaaagcacactgtcatcgtgaaggccaaattcttcagaagaagagctgaagagaagattaagagtgtttagggggc

SEQ ID NO: 609059 - DNA, 857 bp, Homo sapiens
  misc_feature (16)..(16): n is a, c, g, or t
  misc_feature (33)..(33): n is a, c, g, or t
  misc_feature (37)..(37): n is a, c, g, or t
  misc_feature (39)..(39): n is a, c, g, or t
  misc_feature (42)..(42): n is a, c, g, or t
  misc_feature (54)..(54): n is a, c, g, or t
  misc_feature (76)..(76): n is a, c, g, or t
  misc_feature (84)..(84): n is a, c, g, or t
  misc_feature (86)..(86): n is a, c, g, or t
  misc_feature (90)..(90): n is a, c, g, or t
  misc_feature (93)..(94): n is a, c, g, or t
  misc_feature (101)..(101): n is a, c, g, or t
  misc_feature (106)..(107): n is a, c, g, or t
  misc_feature (111)..(111): n is a, c, g, or t
  misc_feature (126)..(126): n is a, c, g, or t
  misc_feature (137)..(137): n is a, c, g, or t
  misc_feature (164)..(164): n is a, c, g, or t
  misc_feature (172)..(173): n is a, c, g, or t
  misc_feature (176)..(176): n is a, c, g, or t
  misc_feature (181)..(181): n is a, c, g, or t
  misc_feature (186)..(186): n is a, c, g, or t
  misc_feature (188)..(188): n is a, c, g, or t
  misc_feature (207)..(207): n is a, c, g, or t
  misc_feature (211)..(211): n is a, c, g, or t
  misc_feature (218)..(218): n is a, c, g, or t
  misc_feature (238)..(238): n is a, c, g, or t
  misc_feature (246)..(246): n is a, c, g, or t
  misc_feature (258)..(259): n is a, c, g, or t
  misc_feature (267)..(267): n is a, c, g, or t
  misc_feature (281)..(281): n is a, c, g, or t
  misc_feature (303)..(303): n is a, c, g, or t
  misc_feature (305)..(305): n is a, c, g, or t
  misc_feature (322)..(322): n is a, c, g, or t
  misc_feature (329)..(329): n is a, c, g, or t
  misc_feature (337)..(337): n is a, c, g, or t
  misc_feature (362)..(363): n is a, c, g, or t
  misc_feature (365)..(365): n is a, c, g, or t
  misc_feature (367)..(367): n is a, c, g, or t
  misc_feature (388)..(388): n is a, c, g, or t
  misc_feature (395)..(395): n is a, c, g, or t
  misc_feature (401)..(401): n is a, c, g, or t
  misc_feature (412)..(412): n is a, c, g, or t
  misc_feature (419)..(419): n is a, c, g, or t
  misc_feature (422)..(422): n is a, c, g, or t
  misc_feature (426)..(427): n is a, c, g, or t
  misc_feature (433)..(433): n is a, c, g, or t
  misc_feature (440)..(440): n is a, c, g, or t
  misc_feature (445)..(445): n is a, c, g, or t
  misc_feature (447)..(447): n is a, c, g, or t
  misc_feature (456)..(456): n is a, c, g, or t
  misc_feature (458)..(458): n is a, c, g, or t
  misc_feature (488)..(488): n is a, c, g, or t
  misc_feature (502)..(502): n is a, c, g, or t
  misc_feature (526)..(526): n is a, c, g, or t
  misc_feature (533)..(533): n is a, c, g, or t
  misc_feature (538)..(539): n is a, c, g, or t
  misc_feature (548)..(548): n is a, c, g, or t
  misc_feature (555)..(555): n is a, c, g, or t
  misc_feature (610)..(610): n is a, c, g, or t
  misc_feature (706)..(706): n is a, c, g, or t
  misc_feature (731)..(731): n is a, c, g, or t
  misc_feature (810)..(810): n is a, c, g, or t
caaccataatagaaanaatggagaactattaancacnantcntcagtaggagcngagaattacaaaaagggaaaanaaaaaaanangtanaannaaaaaanaaaannaaangaaaaaaaaaaaaanagaaaaaaaantatagaaaaaaaaaaaaaaaaaaaggnaagtaaannagnaattnaaaanancaaaaaaaaaaagaaaaanaaantaacaangtaaagcagcaaaaaccttnctaagcanaataataataannttaaacanacagaggaaaaaantggaaatggtgggaaaaaaaananaaaagaaaagaaaaaanaaaaaanaaaaaaanaaaaaaaaaaaagaaaaaaaagaannananaataaaaaaaaaaggaaggtngagaaanagaaanaagaaggaaangaagagnaanaaannaagagnagaaaanaatananggagaaaananaataagagggaaggaaaaaaagaagggaangaagaaaaaagaanaaaaaaagtaaaagaatatgaaantggaaanaaaannaagatatanttaaaanatggagaattaaaagaaaaagaaatggagagagaatgaagagtatgaagaattgnggttatcgatattaaaaattgaagtgaagggttatgaggatggagggataaatataggagtgaaggtaaaatggatggtaaaaaaaaaaaaaatanagtggagagaaaaaaagggagaganaataaaggatgtggaagaaaatgtggttgaagatggagtgggaatgtatgaagtagaagaatatgtgataatgagaggnagatattggtggggggtgtataatgaataataagaaattaaataata

SEQ ID NO: 609060 - DNA, 206 bp, Homo sapiens
agcccatggcacggcctccaggtgcactgtttgggagaccggacacgccgggctcagaccggtggaaaccattgggtgactggtttgtaaccccaactcaggagcatcttaaaatagttagagaatcacaagtcgaggaacacgtggacacacagaagggagaccccgcgtagcatagattcgcagtgtacggctctggatgccag

SEQ ID NO: 609061 - DNA, 974 bp, Homo sapiens
caggcctgtggcgtgcgcgggaagagcactgcagatctcaggatgatggggcgcagccctgggtttgccatgcagcacatcgtgggtgtgccctacgtacttggttcggagtgggcctccttggaagggacctcttcatgaccaggactctctgcagcccaggcccaagccatgccctggagagaaaagacctgagtgagtgtggccctgtgtgtgctgcaccacctgctcccagcacttgggaagagccctggtgggcacaatgcattcatgcaactgatgcgaactccacatgccaagacttggtgtgtgacagatatgaacgagtttgtttggactcacctggaggttcgagaggcccatgtggaaatggtgacagagtgctgagaaagtgttcattggtgtgctctgaggtgcttgtcccgagaggctcgggagcgacttgtgaagttcaccaggccaagctgaacggatggtgatgtggacctgttggaccgtgtctccagggaggacagtcagtacttggaactggctacatctcgagcacaggatgctgcggacggaggcagaggcttcgcgaccagcctatctgcgtgcagacgactctgagcgagagaaagttctccctcttactctgcaagcctgtgcgtgaaagtcatgagaaaggagcgcacaaggggcttgacgagggacgcaagcaactggtccctcgattgggtcagcactggggggccctgatttgggtgtggatggatcaacactatggtgaaccggtggtgcgagtaacagggggctgaagggatctacatcatagggaggacggcagaaaggggcatgtgagtaaccaaggaggcaggtaagcgagacaagcagatacaaaatccacagcacagacaggagtgcgtacccaataaattggtgactaaagaggcaggcaatgcatgcagaacgaatagcaatggagagcaaagaag

SEQ ID NO: 609062 - DNA, 147 bp, Homo sapiens
gtgctccactctccctgtcacctatccaaaactgtatctacgctaattggagccagatgtggtagctcacacctgtatcccagcactttgagaggctgagggggaatggatcacatgaggccacgagtttgcgaccagcttggccgc

SEQ ID NO: 609063 - DNA, 314 bp, Homo sapiens
tgtgctgcctgttttagtataacctggatgcttaaaaggggttttaagtccggccggggtgactcatgcctgtaatcccagcactttgggaggctgaggcgggtggatcatctgaggtcaagagttcaagaccagcctggccaacatggtgaaaccccgtctctattgaaaatacaaaaatggtgcacacctgtaatcccagctactcgggaggctgaggcaggagagttgcttgaacctgggaggcagaggttgcagttagctgagattgtgccactgcactccagcctgagcaacagagcgagactccgtcc

SEQ ID NO: 609064 - DNA, 291 bp, Homo sapiens
gtgccattccccttaatgaaatagatttgagtctttttttcatgtaacccccaaatgagaatcatctacctgattcttgtaccaaaaaaatttttttcagtcttttttttttttagagagggtctcggtcaacgcagacgggagtgcaggggcacgatcttagctcactacaacttctgcctcccaggctcaagcaattctcctgcctcagcctcctgagtagctgggattacaggcatgcaccaccacgcccagctaattttggtattttcagtagagacagggtttcac

SEQ ID NO: 609065 - DNA, 165 bp, Homo sapiens
agctgatcataacagctgtgtataagggaaagtggctggttacgagtgatcatacttgtgagcatacaagccagactccacatctccaaactatattcgtacatttgatggtctacaggtagcttacgagctgcgaaggatcgttgaagaattgggacattatat

SEQ ID NO: 609066 - DNA, 1168 bp, Homo sapiens
atcgacggcagcgcgctcggggtcccggtcgcgaggagtgaggatggatgtcggacgcgacggtaggggacatgtggctgcctgaaatactaagtccggacagatgatcatgggaacagtcaattagctagtcatgtaaataatctttgttatcccgacaaatagcatgcttgagatgtctgccgtaaatgttcaagtttaccagaagagaggcaccgctggaacactaatgagagcatcatgatgcagccgtccttatgtggatttcttctttaactaatgtgtgacccttcacctttgatcccctgacctgcgattaccttgagtaaccactgttcattgtgttgtaattctagagtttgcattttgtataatattcggtgtacaagctgtaacatgtcatctttcaccagtgtaacacgctgatttcctcaaatgagagataccccgtttgagtgataaattgtggcaaaatgctgtcttcatgttctgtattaaaattcatttcagttcttaagaaagagaataaaacagaaagaaaaaaaatatacagaacgacgataacaagactacaacaaaccaaggtgaggcgtggggacatcgacaaatcactctcactggggctcctcatacccaattggaccaattctatgaccctagtggaaggcaacttaacctggtgacgccttcactgtacaccactcgaatgacaccattgctgccgtctgtattacagccctggcggcccagctgtggaaaacccgttggccctccggcgggaatgacactagcggcgaaagaaggccaccaatcccaccgcgaggcagggccaccatacagcggccaccaaactggtccacccccaggagcatttgaacaggctccaataagggggaacggttccaaaccaccggcgcagaagcgatcaatccgggggacaccaatcccggcacctgtttatccgagcgtatacaacgccttggcaaccagcaggcattatcgcgacaggatttaagggggttcctcatccactgcaccagaccaccgccgcccagcagcagccgacatcgaacccaaagcacctcacctcgaccgacgttacggatccaccccggccccgttacctagccctcgcacggctccacatctcccagaatcgtcgatacag

SEQ ID NO: 609067 - DNA, 515 bp, Homo sapiens
tgtggtttttttggaaacagtctcgctctgtcgcccaggccggagtgcaggggtgtgatctcagtctcatcggcaaccttccaccttccggggtttcaaggcaatttcgtggtttcaaccttcccaagttagcgtgggatttataggcacatgtgccaccacacccagcataatttgggaatttttaagtaaagacagggttcacacccagtgttgtggccaggtgtggggtcttcaaaattcgcgtgacctcaggtgtgatcacacccggccttcagcccttcttaaaaagtggcggggaatttacgggcattgagagccaccagtgccgcgggccttcccccagatttacacaggatagtggaggaaagtgtggagttgtctactcttataaaaatgtgtgacccccagaaaatttaaatctttgtagagagtgagatatttgtgcgctcttctcaaagaggggcaatacaaaaaacagcattttctcttaaggggcctttctctcacacccc

SEQ ID NO: 609068 - DNA, 191 bp, Homo sapiens
  misc_feature (150)..(150): n is a, c, g, or t
gtatctctaaagcgtcacgtcacacccactacctaaacatccatacatatcactgaactcctcacacccatttgtaccaatctatcaccctatagaagactaatgttagtataagtacatgaaaacattctcctccgcataagcctgctncatgattaaaacacttgaactgaacatgagccggctcattt

SEQ ID NO: 609069 - DNA, 834 bp, Homo sapiens
cggtattgatgagagcattcacctccagctgccgggagaaatatggggacgagatgttcgggcagtgcagaaaggtgacccacgaagtctatgagagaactttctcagttactcctgccccaagttcctgtacgccattgtgtgtgcccaactatgataatgtgcaccccaactaccacaaagagcccttcctgtcagcatgctgagggtgttgtgcctgatgaatgtacgagcaatgtcggagagcccgagcatttcaaacccatccgcaagaccttccatgcaagcttcttatcgaccatcgcgatgcctgttgtgctcaagcttggctggcttccatgagacctccaccagatcaggagttccggatcccagccttgcttgtcttccaaacacacagcatggaacgaagctcggtgctggaccaagtggtcatcttcagtccactggtagtggcttcgacatttcacgtcacgcactacgaagcaggttcgactatcatacattcgataaggacatgatccacatcgcggacaaccgaaggtcgccaggcgtaatgggcgatttcttcatccgtctagatccacaaatttgaggtgagcttaagtcgaaccctgaagaagatgggacagagaccttgatgatattcacgcacattcaggaacctgtatcgatgtattatacggcaggaaagtgtcttggctaccgtgaagagctttaccttagatcagtccatcaggcgtgtcgagactcagtgaagcaaggttaaggaccgaagtgtttcagagtggatctcagtaaaggatctgtggagccagagaacaaaggcgcttg

SEQ ID NO: 609070 - DNA, 649 bp, Homo sapiens
  misc_feature (82)..(82): n is a, c, g, or t
  misc_feature (142)..(142): n is a, c, g, or t
  misc_feature (153)..(153): n is a, c, g, or t
  misc_feature (164)..(164): n is a, c, g, or t
  misc_feature (170)..(170): n is a, c, g, or t
  misc_feature (213)..(213): n is a, c, g, or t
gcccggataggctaatcaatacccttggcactgatgggcactggaaaacatagagtagacctgagatgctggtcaagccccntttgattgagttcatcatgagccgttgctaatgccaggccagtaaaagtataacagcaantaaccatggtnaatctggactnattttnggacttagtgcacaggttgaggctaaaacaaatctcagacagnctgaaatacccttggcccttgggataccctctgggctccctttcagcaagctagaggctcagtatactaccgcctatctataagattcatagctattagagatattccattaagaaaacccgacaaattctgcagtgtaggaggcacatgatatatcaaaaatcctaagatctagctctgggatgcaggctcagcccgctggagcatgagctcgtgtgtaccgagaaggggtgatgtttacttttcacagaggctacacagcagctgtcacagataatatgcacaacgaaccgctaaggaatatccggaaatacgacatatatgaagtctggatgaatcatgtggatgtgcctgagcacccttagagtaggaccatttggatcttttaattagtatagatgaatatgttcatgagaatcctgctacgaacagttgt

SEQ ID NO: 609071 - DNA, 262 bp, Homo sapiens
ctgagatggtgccactgcactccagcctgggcaacaaagcgagactctgtctcaaaaaaaaaaattggtgaaggcttctctgatttttttttcccaccagtggtcctgaatctttagcatgtccagtaatttttcaaaaactttttatacttgtggtacaaccttcaaattactgatcttacccatatataggtgtacaatagggtcaatattcaaccatattattcaaaaagtaatcagaatataagagcatttaagtgcg

SEQ ID NO: 609072 - DNA, 341 bp, Homo sapiens
  misc_feature (82)..(82): n is a, c, g, or t
  misc_feature (142)..(142): n is a, c, g, or t
  misc_feature (153)..(153): n is a, c, g, or t
  misc_feature (164)..(164): n is a, c, g, or t
  misc_feature (170)..(170): n is a, c, g, or t
  misc_feature (213)..(213): n is a, c, g, or t
gcccggataggctaatcaatacccttggcactgatgggcactggaaaacatagagtagacctgagatgctggtcaagccccntttgattgagttcatcatgagccgttgctaatgccaggccagtaaaagtataacagcaantaaccatggtnaatctggactnattttnggacttagtgcacaggttgaggctaaaacaaatctcagacagnctgaaataccctgcctggtaccctggtcctcagcagtagggtcagtatactatgcccctctcggggggttcatggtcttggggtatttccccttaggaccccccaccattttccgggtcttagggccc

SEQ ID NO: 609073 - DNA, 153 bp, Homo sapiens
cggtattaatatataatagatctggtgagcttgaactagagaaagctgcaaataagtgtgtttggagatgcattggcagtggccttggatgaagggctaattagaatgcaggtccctttgccccaagaccctactagagaagccctatttagg

SEQ ID NO: 609074 - DNA, 427 bp, Homo sapiens
  misc_feature (424)..(424): n is a, c, g, or t
acaagtggctgtaagtatttatacatttccactaagcaacagtatgagagattctaattttctccacatctcttggggcacgtttttattttgccccttaagaaaatatccaagccacctttgatgggtgatgaaagtggatatcttcactggatactttggtgttgtgctttgatagacggagtgatgtcgatcaccacctttttatgtgcgttgtaaagccatcttgtatatcttcttttggggagaagtgtcctatttaaagtttcttgcccactttttaattggcgttggtgtgtcttgttttttgtttttttttcttctctgagacagagttctcactcatgtcatcctgagagttgtgccacatgtactccacgcctggcgcaacaagagcgagactaaccgtttgccaataaaaaanaaa

SEQ ID NO: 609075 - DNA, 488 bp, Homo sapiens
  misc_feature (290)..(290): n is a, c, g, or t
  misc_feature (373)..(373): n is a, c, g, or t
  misc_feature (438)..(438): n is a, c, g, or t
  misc_feature (475)..(475): n is a, c, g, or t
  misc_feature (487)..(487): n is a, c, g, or t
cactcccctagttcaagttctcatcagctcttgcctgggtttaccacagtattctctcaacaattctttggccccaccacaatgtaaccaggagaatccatcttaaatacaaacccagggaaatcactggcttgtttgaaacactttggtggccccccagtactcttaggataatgtctttaaatggcttaggggaacttgcgtcatctgagttgtttaccctgttagtctcacttggagggttttctgacgattagcatgggtatgtgtcaatgcatggtatgcatggngcacaaaataaatgaggattcctgcacctgttacctggaaccccatttttacagataagggaaaatgaggactcactgagggntaaggcaacatggccctaatttcacacagctagtttaattaacagctattgttgaggggatattntgaggcacgttttttccacagggcagtttaaaatttncaggggaaaacnt

SEQ ID NO: 609076 - DNA, 447 bp, Homo sapiens
caagcccaagggggtgagaaaatttccaaaaaatcccccctggggggcgttttttgtttgtgaaaataaacaaacaaatcgggggggggtcctcaaaacagggggcaaaaagggggggtgggggggcaagggcccccagtttgccccaaaaagccaaaagggtaaaaaaaaattatccccaaaacccccccccccccttttaaaaagggggggaaaaaggggttcaaaaaggtttgtttcaaatggccccttaaatttaggaggaaaaaaaggggtaaaaaaaacaaagccttggtaaaccccccaaaagaaaaaaaaaagtttttggggcccccttgggtttttttttttggggggggccggtttaaagtaataggttttaaaaacaggactttttaaagggaaaaaattggcccaaaaattgttccaaaatttttagacccccta

SEQ ID NO: 609077 - DNA, 184 bp, Homo sapiens
cccacctcggcctcccaaagtgtgggattacagacatgagccaccgcgcccagccacacactgtcttgattactgcaattttatagtaagtcctccaactttgtttttctccttcaatattgtgttgactatttggggatttttttgcctctccatttaaacttcagaattagtttgttgatgt

SEQ ID NO: 609078 - DNA, 152 bp, Homo sapiens
gatccactaaaatcaagagcgtattatcacgaactaatttgcatggcgcgtgcctcatgcaacaatggagtcattgatatttgaaccctggcgccatggatttcgggtggatttttaacgaatttctgccagtagcaacgtaatgtcactgt

SEQ ID NO: 609079 - DNA, 774 bp, Homo sapiens
  misc_feature (256)..(256): n is a, c, g, or t
  misc_feature (323)..(323): n is a, c, g, or t
ggcaccatgtatcgagcacttcggatcctcgcgcgctacgcgtcccctcgtgcgggctccagccggcaggcttagtttcggttcccggcttgtggtggagcgggcgtgccctcggttaatgtgctctccgagacagcggttcgacatggaaagccaatagattcctaccgggatagaaacttcaatgattagccgtctttgggtggagactcagacagcgatggcgcaccaagttgtgatgagagtatgtatgagncgtcccagcacccgtggacgactcctcacggatgcaaactgtgtgaagagttggcagtgatgtgcanatgaagcgcgagtgccaacccccaggttattgaaatgcttttggcatctatggagaggcgaggcggaccgctggaaggtaaaccagggattatggtcttgatccaaagtattgctaatgcaatatatgaaggcagcagatgaggtagcttgaaggtaaattaaattgatcattttcctctcgatggatatggcagactggatcaggagactcagactgagatatgaagtgtaaaatgagagtcattagccaatagagcaatttgagaatgttaggaggtgaactgtggcagcaagataccgtgtgcattccaatcgatccattgttcacataagacggcagagctcaaatgatacttttcccaccagcaatggcacatttgctgcttgcgacttaagaacgttcactgaaagtactgttaccacggaactaccaggcccgttacatgattg

SEQ ID NO: 609080 - DNA, 147 bp, Homo sapiens
gcaaccgcacggagaggggtacctctggcgcgggcggtgaggagggcgcccaagcccctcagccgcagggacgcccccggcgcctgccccgacgcggccccggccccggccccgcccctctccggccccgcccccgcccggcggccg

SEQ ID NO: 609081 - DNA, 1404 bp, Homo sapiens
  misc_feature (780)..(780): n is a, c, g, or t
  misc_feature (824)..(824): n is a, c, g, or t
atctgcacactatattgatgcaaccgaggtgtgccttgtgtgtacaacatacttatgtcccacacgaagtgttgtgtcttgcttttgtggactgctctcccctaaggttggttggaaaataaattggtggcgtctctctcagcaggagacgaccatgttttgctttccgttggggggggaggaaacaataaaaaatgttcgttggttacccgcacccgtctttttgtttaagcaacaatctcgctaagaaagggggggtattaaaccatacacaatgtccccaccggagcaaattaaagcaggtgtttttgcctcgcagaggaggcgccttgctcgcacggctaagggaagtagttaaattggcttgcctgtgtacgacgtgccacaaacgcgccgtcgggttttaaaatagtgttgtgtggagccttttagattaattgccaactaaatataagcggagacactttgtttgtttagggcccaaactctccccttcggggcggaaaaaggagtagccgtgggccctcccccccgcgccccttcccaacagtggaagtaattgtttgtctctctttggagagagaacccacacttctttcttgtgtataggaagcctctgtggtgcgtgttttctctatgagagagaaacaacactcgttcttaaggtgacacacacactcggttatagggttgggagcaccggagaggttataggtcacacagctgttatattggggctcgtgggctaaaggccttatcccaacacacgacccacagggnggtttagagatgcccacatgttgtagaaaaagactcttttttgngcactattttgtgtccttccacattggggcgcacatagagaatacccacgagaccctctttgttatatatgtttagagtgtataagatgttgtgtgttacgcacagataaggagagggcacacaatggcacacacagtggctccacactggtgaaccacaacccctcttaagcacgctatgggaatgtgatattagataccgagccacgtgtatacttaaatttttctatagagagttacacggcgccttcttgggagtcacaccccccacgaactgggaccacgaaatgttaagtgaaaggttttatattgtgacccgcgttggagggaataaacgctttctttgggtaactctatttgttgggttgcacacaatgagaactcacaattgccaccacagttcttaaaactggtgtaaatcaaagcttgagacttaaatgtgagttgttaactgttaatatccacgcctatatctggctagcacgctgctcaatactgcacgtcacaattatctggagaagcggaatatattttcctactgccaaaactgttttaacaattaaatgagctatgctacaga

SEQ ID NO: 609082 - DNA, 117 bp, Homo sapiens
ctgctggaaacgaacccttgataagtggtcagagtcttctggttcttattttttgtcttattcttagttgtgcttgatgacatcattccctctgcctggaatttcctccctatcttc

SEQ ID NO: 609083 - DNA, 142 bp, Homo sapiens
tgccgatcttgacgattcttgatgaactcctgggtctccaatatcgcaatatcacctggtggctctcctggtcatatgtcacaccagagacatgtagcattatcccaagcttcagcacggatccatccagtctctgacatta

SEQ ID NO: 609084 - DNA, 116 bp, Homo sapiens
aggccacttttgtgtcatggcaaccttccctggcagattcctgcctgtctcccagcagcctaacaggcccaggtcttgcctcacacatggtcctctctacatgcagctgtacctca

SEQ ID NO: 609085 - DNA, 886 bp, Homo sapiens
  misc_feature (130)..(130): n is a, c, g, or t
aggtcgcggagatggaatggagcagagagaagggaccatggcagcgtgggcttgaggagttctcagcgccgccaggcctcagagttgggtgcctcccctatttgtgtggccacatcctgagagcgagctngagacggaagtgcagttgtgtcaggtggtctggcggctcagggctccgggagcgagatgaagaggaagaggcagcccgggtcggcggcggcgccaagggggaataaatcgcagaaagtaccaggcactaggtcggcgctgcggaagatcgagcaggtgaacgaggggtcctgaacgggctccatcaggggccagaggatacctcggaggctgcagccgggaacggagggtcctcatgagagtgctggactccataacgggatgactacgggccagccaagttccaccatggtggcctggaaggatgagggcagccaggcacccggtttggccccaacccaggaaatggggaaatgggctcccagagaaagagaattggcccggccaagaaggactctgacccacaagaaacggggagcacaaggccccgggggagggggcccagtggcggaagaggcgcggagtgccacgggatgggacgcccgagaggaaatggcgggactccaagaggtggcccggtcgcgatcaagggtcgcggacactgggttgaagaaagagccggatcccggggctcccgggcagacaatggggctaccgactggaaagcgacctgatgagatgcaaaaatggccattcataaaaaaaaaaaaaaaagtggggcggcgcccagaaattcaacacgtgggcgcgccaggagaaagtaacgcgcgagcggagagggtccaaacgggcgggcaaaggggatagcgaacagaga

SEQ ID NO: 609086 - DNA, 928 bp, Homo sapiens
ggagagggtcgttgtgcgcctgcgccaggtgggggttgccgtcgcgcctaggcctttccctcaggttttcctcttccccatctgcgggtccccagtcggggcttggcggtagaactcatgcgctgaagattgtctaaagtccccaggtaaataatggtggaacatagtttcaccgtcgccattgccagaataggagcgatcttatggcttcgttcttttcttaagctcccaattgggcttcatactttacctcgtgtgtgggcctgttattcctgaatcttggctaagatctctttaggtgttatacctattggtcctcagtaacatattgggcagttgctttacctgtctacctccttattgctataggtaagttggctacgtgcgttcttggttagggatgtaacatgagtgaggtaccgtctcctactcgaactccactccaatactatgcactagataaagtatgcaataaagattcaacagcagaggaaataccaagaggaggccatttccagccttaagagatatttctagttagtgaaagtaaaccaaatgtcctttcttgcaagccaaagaatttatgacaaaaattgaactgtgttgtaagcatagtaacaccaagcacgtatgtgttataacgtttggcattactagtttggaccctaattaatttggccctctctcttattactggagaagtgccaatgtacttgacctctctaagcttgtccatgaattgcctgtgccggctcgtacgcatgattgttccattgcttcgcgccaaaacagaacaaaaaaacatggggccgcccaaactaacctctgtggggggccaaacgaaggcagcccaacagggcgcgggggcccaaaccggcggcgacacgcgtgtgctcaccgtccccccccgggcgaacccaaccatctt

SEQ ID NO: 609087 - DNA, 125 bp, Homo sapiens
ggaggcagtcatagctgggagttagctgatgcattctgatgaatactcatggagataagtatatagaaaggaaaggaggacagccagcctgtaaaaggatggagtggaagcagggccccgatcca

SEQ ID NO: 609088 - DNA, 380 bp, Homo sapiens
  misc_feature (379)..(379): n is a, c, g, or t
cgggggtctcaggcatcatagaaaagtcacattgggatgggaccttgaaatttttttttcctaattctaagaagtaatacaaggggcggggcatgggggctcatattggtcatctcaacacttggggatgcccaggcaggcagatcacttaagcccaagaatttgagacaacatggcaaacccccgtctctacaaaaaacaaacaacaacaaaaaaacaaaacaacaacaaaaaatcaaaacaaaacattcgcggggggtgtagcacgtgccggtggtcccagctacccaggaggccgcgggggcaggctcatctgagctcagggaggcggaggctgcagcgagctgggatggtaccaccgcactccagcctgagcaana

SEQ ID NO: 609089 - DNA, 244 bp, Homo sapiens
ctcttagaggcacaaggaggaaatgaacaaactgttggcaagaggagaaaagcagcctcccagatagacaagccagccgagaaagaaggaagggggaagaagggagggaaggaagaaaggaaaagacggagagagggaaaaaaagagagatgggggaagaataaattggggctttcttctcaaagtacgaggcagtatgcgttagtggttggacggtgcaacagttggcattgacgtggacaca

SEQ ID NO: 609090 - DNA, 385 bp, Homo sapiens
  misc_feature (35)..(35): n is a, c, g, or t
  misc_feature (242)..(242): n is a, c, g, or t
gaccccctttttcccccttttttttgttttgtccngcagctcctggaatgaggccgcccatgggaggccaaatgccaataatgcttgggcccccaataataaaacctcctgcccgtcccataatggggccccctgggcccggaatgattcgcccaaacaaataaggataaagggggggccttattgtatcggttttaaattccctgttttgcttcaccaggagatcaagcggctgggaaacngagttttttaaacagcaaaaggaaaacttgctcccctgtcctataaaaaaaaaaagttttggaggggaaaagtgggccaaaaaaaaaccagttttcctttgtattgggaaatgtgaaaaaaaaattgtcaactttttcagtta

SEQ ID NO: 609091 - DNA, 353 bp, Homo sapiens
ggcatgggaaacactgcagtatactgcaagtgtctatctctttacgtaaattgaatttgtattttattgtgtcttttttcaggtctagccttaggaattttataatatggccaggcgcggtgtctcacgcctgtaatcccagcactttggcaggtcgaggcaggtggatcaccaggtcaggagatcgagactatcctggccaacatggtgaaaccccatctctataaaaacacaaaaaattagccaggcgttggtagcacatgcctgcaatcgcagccactcggggactgaggcaggagaatcgcttgaacctgggaggcggaggttccagtgagctgagattgcgccattgc

SEQ ID NO: 609092 - DNA, 100 bp, Homo sapiens
ggaagcgctgatcctgttatttggcaggaaacgagcaatccagcagccagaggacaggtgattaatctcctctcgtgtctccagcccagcccaccggccc

SEQ ID NO: 609093 - DNA, 604 bp, Homo sapiens
  misc_feature (9)..(9): n is a, c, g, or t
  misc_feature (116)..(116): n is a, c, g, or t
  misc_feature (127)..(127): n is a, c, g, or t
  misc_feature (132)..(132): n is a, c, g, or t
  misc_feature (600)..(600): n is a, c, g, or t
ccgcggcanccggcagagaggggggagcgcaggggcccgcgggggcgccgccggcggcccggccggcgggagagggcggcgccccaaagcaggaaaaggcgggccagggggggggngacagcaacgnggcancggccggggaaaggaggggggggcacaggagcgaagacagggagcgggaaggagacagccaaagagcgggcgcagagaggagcgcgaggagagggagcgggccgggagggggaaaagggggaagggggggccaaagagagccagaccacgacagggaaccagcaggggggggggcggaaacgggaccgggcggagacgaaggcgaggcgagcgggggcgaagggcggcggagcggaggaaaagcaccgccacggggggagcaacaaggcaggagggaggagggggccggacgcgaagacaacagagggcggggagaggcacagaggaggcaaccacgggggcgcgggcgggacgacggaggcgggacacccgggcacaggccaagcggaacgggggcggcacgcagcgggcaggagagggaggggggggcgcggcgcgccgggggcagcaagacgccgcagcatgganccca

SEQ ID NO: 609094 - DNA, 461 bp, Homo sapiens
tggaacaactttattgagatataattcacatagcatacaattcactcatttaaaaggtccaattaaagggttttcagtatatgcagagttttaaatacaaccatcagcccaatcaattttggaacatttcatcaacccaaaatgaaacctgtccccattagctaacctactttatgcccttagatttagctattctgtccatttcatgtaaggggaatcgggaaaggtagggtctttgggtctggcttctttcacttagcataagggctttaacgcccatccccattatagcacatgtccatacttaattccttttcacaggtgaacaagattcccttttggggatatatcacattttgtttatccattcatcagaagagggggggtttaattttataagggaagaaactaaggtaaataagggcctgggttgggaccattcaaagccaggtcccctggct

SEQ ID NO: 609095 - DNA, 317 bp, Homo sapiens
gagtgactcaccgatctatatacacgggatgtctgctcaacattaggtcgtaaacctattgttgatatggactctagaataggattgcgctgttatccctagggtagcttgttccgattggtcaagataaaatggatcaatggagtaatagtagttcgcttagactggtgaagtcctagcatgtactgctacggaggttgggttatgctcacgaggtcgccccaaccgaaatttttaatgcaggtatggtagctataggacctgtgggtttgttgaggtactgtttgcattaataaaataaagatcatagggtctag

SEQ ID NO: 609096 - DNA, 118 bp, Homo sapiens
acccatcgctacaatgttatgagacctgagcaagccaggcctggcttgctcaggtcttgctgattcttttttttttcctttgtagcgtgggagtccggcgggaatcgatctagatgat

SEQ ID NO: 609097 - DNA, 939 bp, Homo sapiens
caaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataacctttcttaggcctatgcatagttaataaggttgtaatctactcgaacatgtaaattggagctgattacgtatgtgcgagtacggttataaggtgatactctatgcatatgattctatataatgtgattcgaatgctaattgaacagactcagaggtgctgccatatgactattttctactgttagagcgtgctattgagaaaataattcccatagtccttgctttcgtaaagttggtaatatcactatgcatttctacacatttcataacattctgatttatgcagattttgataccactggactgtttctgtagaaattgtatagtattcaacacattttcttaggcatacaatttgacgaaacttacgtatatcttcattctgggatgcttgttgtaattaggttgacaaactagttaaactacttggtatttctaacaaacagaaagaacaagaggaaacgctcccagagtattcggcgaaggggccccagacttaccgggtacccaagcttttgttaacagtggtcctcataaaaaggtgaatataagctaggacatgccgagtcgttgaaaacgcgggactgcgaacacgatgctggacattgttaaggaacaaaatttggtaggaaacatgtacaacaacacaaaattaagcaagacttaacgtaaggttaataaacaaacattattcacaattgagtgattaata

SEQ ID NO: 609098 - DNA, 1286 bp, Homo sapiens
  misc_feature (696)..(696): n is a, c, g, or t
ctcgctgtgggtatgtggtgcgcgcccttttgatgtgtgggctctctttgttgcggcgtttttgtcacggtcgtgctctgctttggccactgatctgttccaaagcctggtggcccggtggtttccggggtttgttcaccccgccttctgtgtttctggtctctcccgctctgatttttccgccctccaaattccggcgttcgccaggcgtcttctgtttcgcgccaccagaggggggttataggatagcccgggttcattttgccgccctctgtgtgggccgccgcttgtcggcgctcctgccccctccccaccgggggtgtttctcgtcgtaatccgtcggatccaacacggggttggttgaccgggtcctcgcctctgttcgactccggctatttgtttctcttttgtgggcctctctggggtgtttctctagtagcacgccctttcgttgttcccagaacgatcatgttctgtttgagcccgctcttcgcccggcggtgggggggttttctctccccctcgggcggcggctttttaatcccagtggtgtttgtgggctctcttctgctctctcccgcggggggttctcccctcctcgccctctggtgcctctctctctgtctttcccctcggggggagtgttttggctcccacaaaagcacaccccgctctttctcacgcgggccctcccanatgcccgtgtctccccactggtgcccaccgctcccgctcgtgtgtaacactcttccccacacgagggggtctttttcttcttggtgatttttccctcctgagtttgtcccccccgcgaaagtcttgtctttttcctcctcaagagaagacaccactcttggccctctcgggtgaacctcctctctattttttttcgccccgcccaaagataaagacgcgagaaatcaccccccctctccctctagagggggacttttttccaccccacgccctataaaagtgcgccctctcttgttttctctttcctatgttctcccacaaagaatttctcttttctcacacgttaatttctttttctccctgtggccacactctcctttttcttttaaaaatcactttttcttgtgttctctcccacacaaagattgttttcaacacttcccctgatcctctttttttccctctgtggaaaaagtaatataaagattgttgtgaccccacccggggggggtgggggaaataatttgtgtgtgtcctctcccccccgttcgccccttataataaaattggatagacccttttttttttta

SEQ ID NO: 609099 - DNA, 100 bp, Homo sapiens
acactattctacatttaagtgtctcataatgagactgacacatgaagagatctgagcgcaatctcatgtagtctaccatgaacctgcaattgatatggta

SEQ ID NO: 609100 - DNA, 451 bp, Homo sapiens
cacacaaggcgactaaaatgtctcaccttctaaatatggatggcttggcaggtattgagtcagctctgtgacgccagtgcaataatcccgatcagcatcagattattcaccattaaacatgttctaacttgattggcaacaagccttatattatttagagggatccacggagctggcagagggggcagaggtgtccgcaggcctcctgcccttccaggcttaatggatgatcatcttccctgctaaaaaggcccattcactaggtgagtgatgtggaactgtttaatgaaagcaggaagatgatgtgaatgccagttcacttgagtgttacaaacggtttgggcactatagccttaaagtttctcctgctctttgcagatgaatgaaggggcgctttctggaatctttgtggctggggctgctgctctgcactgctatggctctttttcaa

SEQ ID NO: 609101 - DNA, 129 bp, Homo sapiens
cacacacaatggggccgctggagctggcggatttcatcgtggctggacacctgcctcgccatcatgaacgtgctgcacgaagggctggcggatacgaagtatcggccctgccgctgctgacgaaatatg

SEQ ID NO: 609102 - DNA, 439 bp, Homo sapiens
ccaccaacctgacttgttcggacaccccccgggacggccgctgtctgtccccttctccattgccctctcccagatatagctccggtgcttggaccagctagagtctgagaaaggggagaggcgcgaacgccattccataaagagaagggttatccgagggctaccctccacgatacgcttgactttctagtggctggggtgagtgagcggggccgggaggacgaccccggacttggtgggagctgcataaacgtgctgaaaactctcagaatccatttcccccacgtaaacttggtaccgcagcagcagcatttgatagagtggcactaggctgctggcgtgcaactcggctcacggaaaagagcaagagatgcgaaactgaggcttaggacaaagtgtgcctgatattggtgggtcagaacataaggcgtaccgagct

SEQ ID NO: 609103 - DNA, 218 bp, Homo sapiens
caaccagcttaatgaatgttgtcaactcagcaatattgatttaaggttcatcattgacaggtaagcttgaaatgccctgaaatcttgcagctcagatatgaaagaaacttgatagagctttccccaaatttgacaacaaccttaaggatttatctactgtcatttgtaatgagtcccccagctgaaaataataaagacaaaatttaatcaatcacaaa

SEQ ID NO: 609104 - DNA, 1003 bp, Homo sapiens
gtgagtttctggagggctgaacacatggtagtgcaatactggaaggtgacgaagaatttatcctatcaccgatggatggtcctgttgctcaggcgatcgtgtccgatggacgtccccgaatccgaactgtacgagatcccttcctctcaactctcatccggtggtgtgaagatgacggacatatttcttcacagaatgacaggcgggccattgtgtgatatgggcacttacaagcattgtggaaaggcgctccgctgaacttctcaaacgccatggggccaaccgtgcttgatgtctcagggacctgcgtgataacagcgttaactatagtgagaacttgggattattatcaagactagactcatggattcttgtctgcgcattgatagcttggggtcctgcatgggacagtcatccacttcgcaggcaggttaagggtcttccctggatctgtacaggtcagaatgggtgtctggattccctagttactggataagagatgtgtacatctatctagtagatgttcttccccacttcaactacagagccattgttggatgttcttatatatctgggtcccctcctcatggaaggtacactggaaacaccaaggagggttgaggcataatggtctgaacccagataccaattaatccccatacgatccaagcattcggcgccttgtacatgtccaatgggcctgttttgatcgagcaatggtccttgttcctggcattcgctccaccttgggacctttcttatctcctctgggatgtaggaaacttaataagacgggtgccccatttgctacataataacacatgtgttccctggacttactagatagtagaggaaatctggatcaccctttcatctaacgccatacgggagattccatgtaggaattgggggatcagggcaagttgcgctggcaaattaattacaaacccgggatggtgttggacgaaatttcatggcaagtcgttggaatctcggggaaaag

SEQ ID NO: 609105 - DNA, 1240 bp, Homo sapiens
ggccctgtgttcgtcagacggcttgtagattaactagtagagcaggcagacacacgcttagtccacaagctatgaggccaaggcttaccacctagtccctcccactcggtctggctagctatgtgcacatggcctgttcacgagaccagtgcactatcaccccaatgctcgggctactagacgctgagccccaagagcaccgagccttacggacccttagaccaacactcccaccttagcgccgtctcgtgcgtggcccttttccttgtccatgacgcacttgcgtcgtcatccccttgcgagaaccggcggctacaccttagacgactatgtctgcacccgctctcctctctctcaccccctcggctcacatgaattcgttccaagcctccctgtctcgctcaacactcgtaccacctcacacttccgcacaccttctgactcgccccgcaacacccagctttctcctcctggaacatccaaaacgttcctctacgctcctttgttttccaacgtcacaccacgccccgccgcaccccggcaccctgcgccccacgcctcccctctacccccccgcctctccccaccccccccccgccctacacacaccccatccaccatcgactccaccaataccaactcccaccacacacacaacacacccacccccacaccgccccccctcccactctacccctctcctgccccgcgcttttacgtctgcctcacacccacaccccccccacctcccatatattctccttattccccccttcccccgctcctataccactcacaaaaatacctcttactctacttacttgcctccactcctctccctccacctaccacatctatcgagtcctcctcgtgcttcccctcttcacacaatagctctcctgccgataccaataactactatccccgttatcccgcccaccatcccaacctcaccaatcccccttctccatgacccacactcggacgcatcacttccacccccatcctccatcacaccccctcgcctcccacacatatcacttactctcctccactcacctccgtcgctccccctcatcctctcccccccccctcctccactctactcatgttcaccctccctccctcccgtatccctctcctcttcatgccttaccaaacccacatactcaataccatccaccagttcctcacttcccgtcgcctcaccccttctcctttcctcctactccatttcctt

SEQ ID NO: 609106 - DNA, 810 bp, Homo sapiens
  misc_feature (36)..(36): n is a, c, g, or t
  misc_feature (207)..(207): n is a, c, g, or t
  misc_feature (240)..(240): n is a, c, g, or t
  misc_feature (245)..(245): n is a, c, g, or t
  misc_feature (259)..(259): n is a, c, g, or t
  misc_feature (264)..(264): n is a, c, g, or t
  misc_feature (269)..(269): n is a, c, g, or t
  misc_feature (359)..(359): n is a, c, g, or t
  misc_feature (435)..(435): n is a, c, g, or t
ggtattgtagtattgaatttccagtcattctttctnccctggctataaccttagtcactgaagaaaataactatccttttattcaaacaacttccttggtacaatcccagcaatatgttttttttcttgcaatattaaaaacctccgatgtaagtggaaaaagagttatttccaagcagaatgagaataatcatagcgctgggcacngtggctcacacctgtaatcccagcactctgggnggccnaggtaggtggatcncctgnggtcnggagttcgagaccagcctggccaatatgatgaaaccccatctctagtaaaaatacaaaaaattagctgggtgtggtggtgggcgcgtgtnatcttagctacttgggagactgaggcaggggaatcgcttgaacctgggaggtggaggtctcagtgagctgagatcncaccgctgcattccatccagcctgggcaacaagagggaaacttccaacctcaaaaaaaaaaaaaacaaaaaaaaaaaaaaacatgtgtgggtggcgcgcgcgccctgcgccccagcggaaaagtttctaaagcacacatctcggttgggggcgcggcgggcccccagttgggtaagcggtgcacactgtggccaataggtggttccagaagaaaaatcggggccaggacattaggggctgggttttcccccacatgtaaaaaagggccgtgggaccccggcgcgggttttgtgaacaatcccaagggatacagagcgcaaacgggggccttaccaggggtccacagaaccggaatataaatacggcggggtgagg

SEQ ID NO: 609107 - DNA, 190 bp, Homo sapiens
ccgatctagagtatccccctcgataatagcacgctggttgacgcgataccgtgtagtgtgcgccagatgtcctaattgcaggaaggtgggtagagagtacatgtgatgatcctgtactatccttttacaactgcatgtgaatttacacttctttgcatacaatccatgtgttagtacaacctgccggtag

SEQ ID NO: 609108 - DNA, 1372 bp, Homo sapiens
  misc_feature (448)..(448): n is a, c, g, or t
ctaaaaatacaaaaaaaaaaaaaaaaaaaaatttagcccagcgttggtggttgtcccagcctgaaagtcccagctactcaggaggctgaggcaggacgaatgttgtgtgaatctccgggaggcggagctttgctgttgagccaagaatcgcaccacttacacttccagcctgtgggcaacagagcatttctggaattttatcagatatagcaggtgggccgtggtcagcatttcgaggccgttggaccaggggacctcatagccttcgggaattgaattgacaaacgggggacgcgtgatatgtggattcagaaaaaacttaaccccaagaagtgtgtgttatttcagaagaaacacagtttcgaaggaaaaagcggcgtattacataccgtataccttcgtgtcaaagacgctgtatatattaaggcaccgttgtgcacaccgtggnaagggcggaaataccatatgtgtctggcattttacacattaacacgcatgtgcgagcaccccggagaagcacagggcgcacatagggcacatacaacgggggcacccagggaaaattctccagccagcattcttctatcaaccgctttagagaccccaggtgtgggaacccccgcggacacacaagtttcacctgtgaacaccgtgggtatataaaggggcaatattctccataaagggccccaaaaagttttgtcaccaaacgagacacaaactttcttttatcacgatttgaggcccctttttaacaaaaaggtgttaacccgagtatatattcacacagcggcgtataaacacaacgcacaaggagggggaggggattctcaatcaaacttaggagagctttcacccgcaataggttgtctcaattaccagactatcaaaggctctcccaactttagttttttgaccaacaacgtttttctgttcccggcaatttgctcatttaaacggtcgctaattcagatattcaggaccgagcgtttaggagcatcggcggcaacaaatttgccagagaaatttataggacgatccatgagcaccctcatcaacaaggcgcggggataccatcacccattccacgtaggagaaggggggagtctgcccacgaaagggcgagcccaactgagcgcatggaactataacccactgcgagaagaaaagacggggcaatcaccagacagcgcaaaactctaggggacgccaacagaacagactggtcagacaatagcacaagagacgaagtaccagaacaggcatgcaaacgaagccacatagatccaattgagctagcacacgaagacaaccagatgggggcgtcgaccccaaaaccacacagacacatgagcaggcacaaacatagcgg

SEQ ID NO: 609109 - DNA, 130 bp, Homo sapiens
atccttagcctttccggcgggtgttcaaaaaataccaggagtctccctcacctgctccctgccaaggggaagggagacgccccgacagtgacagacacacacacacacacagacacacacagtaaatgca

SEQ ID NO: 609110 - DNA, 157 bp, Homo sapiens
tctagaggatcccatcccaggtctagactgctggcatcactatactactacagaccgcaactcaagcaccatcttctacgacccggccggaggaggagaccccattctataccaacacctattcatgattattcggtcaccactgaagtgtcaaggt

SEQ ID NO: 609111 - DNA, 103 bp, Homo sapiens
ggctggtctctcgatagacgtcctggaggcgtgcgcgctgggtatcggtcgtcatatacacagttcatctatatatttttgacatgtagcaacacctctccat

SEQ ID NO: 609112 - DNA, 938 bp, Homo sapiens
  misc_feature (543)..(543): n is a, c, g, or t
agtggtcagtgggaaggggagtgtaatggcaaacgaggtcacttcccattcacacatgtccgtctgctggatcaacagaatcccgatgaggacttcagctgagtatagttcaacagttttgctgacagatgggaacaatctttttttttttttcccaatggccatctatacaattcttcttacaagattgtcacaaggcacgtctagttatatataagctttctggtgcacctggtgatattttccaaggactggaactggctccatcgcctagtcttaattaccatattcaggggtacgacaactgggaggcgctggtggtgtaacgcttctgaatgggcaatgggaggcggaagtgggtcgtgcctgtgtgtatcaagaagggataggtatcgtggcctcctgtttctcgtcaggcagtgcaaattcaccccgtggtggaagaaccgattggacaggaaggatgtgttacacactggctatacccgtgagtttaatgcaggggtttggtttccattcgtggaacccatactatcaatgggncgacagactgttccgtccacccccccgtgaagttatcagtgccccgggtgtgaaatagtatcaaggcagagattggctttccttggttgtggggcttgacccggcgtggtggacctcagttcctgacattgcgaggaatcctagaattttttggaacccttccgtagaagcgttgttcccctcctagatcaagggctcaacagcttcctgggaggctgttttagcccttagattgttggtccccccaactgtgtagtgtgggggagactcctcacgagaagaggtgggttcctccccgcggagagacgggtggtgcgcgcgttttagggtgtggcttcccagggtgtctataggagggaacgcgccgcgtgttccccaaggggaggggcgctctg

SEQ ID NO: 609113 - DNA, 102 bp, Homo sapiens
  misc_feature (12)..(12): n is a, c, g, or t
ctggcataatanttgagtagaactcactcattgccacatgtgagggcaccaccattcatatgggatccaccctcatgacccaaacaccacgacacatgtgct

SEQ ID NO: 609114 - DNA, 545 bp, Homo sapiens
ctggcacgaggagatgatgccattcatgaacgacaacctgtaactatccgtcactataaaggttcatgaccaaccgactacttcagtaggaaacaaatggtcattgatgtccttcaccccggcgcaaggcgacaggtgccttaccgaacacgcataattcgggaaaaactagcctaaatgtacaagaccacaccggatgtcatctttgtatttggattcagaactcattttggtggtggcaaactacaactggctttggccatgatttagtgattccctgcgatttatgctagagaagaaaaattgaagcccacagacatatgacttgcatagatcgactggcgctgtatgatcaatgaaaaagacctcaagaagagcgacgaacaggaacgcaagaacagaagtgaagaaagtcagggggactgcaaaggccaatgttggtgctggcaaaaagccgaaggagtaaaggtgctgcaatgatgttagctgtggccactgtggatttttcgcaagaacattaattataactaaaaaacttcaaaaaa

SEQ ID NO: 609115 - DNA, 426 bp, Homo sapiens
tcagcaaactcagcacggggctctgcctccttgagatgtatcagtaagaatcttagatttcttcctcatatttatcttctttttgagagtacttctccgcctgagcctcaagagacttgaggttagtaggtgacatacttcagctcctcctccagctcagaagagttgagactctgccagctcatctcgtacctctgtgcgttccaagtctccttcaatgatcagcaacttacgagccacctcttcatacttcctatctgcctcttctgcaatgtgcttaggttctttgagttggatttcctggagtgccagctgtggttcatcttgtaaggcccggtgtgcaataaccttcatacctctctcagtctcatcagcagcttcggcagcttcttccagcttttgcagggcagtggcagataggaagta

SEQ ID NO: 609116 - DNA, 215 bp, Homo sapiens
gactctacaggatcttatcccggctctgggtattcgtatttgttctaataaagagaagtacaggccacagtggctcatgcactttgggaggccgaggcaggtggatcacttgtggtcaggagttcaagaccaacctggccaacatggtgaaaccccgtgtctactaaaaatacaaaaatcagcagcatgtagtggcacgtgcctgtagtcccagc

SEQ ID NO: 609117 - DNA, 477 bp, Homo sapiens
  misc_feature (50)..(50): n is a, c, g, or t
  misc_feature (117)..(117): n is a, c, g, or t
  misc_feature (426)..(426): n is a, c, g, or t
  misc_feature (446)..(446): n is a, c, g, or t
aattttatttgtacccacatctgctccagtggtctgtttgacgaattggntctaaaaagagcgattacattaagctctatgtgcgccgtgttttcatcacagacgactttcatgatntgatgcctaatttcctcaattttgtcaagggtgtggtggtctcagatgatctccccttgtttgtttcccgcgagactcttcagcttcataaactgcttaaggtgattaggaagaagcttgttcgtgaaacgcattgacatgatcaagaagattgctgttgatcaatacaatgatcctttttggaaagaatttggttccaacatcaagcttggtgtgattgaagaccactcgtatcgaacacgtcttgctgaacttcttaggtttcccggcttctcattatgcaactgacatttctagccttgaccagtntgtggaaagcgtgaaggcgnaacatgacctcttctacttaatggcttggtc

SEQ ID NO: 609118 - DNA, 175 bp, Homo sapiens
accaccagagtctagctgagattccctgcttgccaatattctattgtcacacattgttgcgtgggagaatttagcactgttgatgactccactggaagaggacagctggaagctctgtacttggaacttcctgaactttgtcctatagtgtctcttcccctgggctaatccgagg

SEQ ID NO: 609119 - DNA, 131 bp, Homo sapiens
ttcaacatttttttgaaaaatttccccagactatttaagccaattatactacactgattacgttatactaactctacgtaatcaaatactactaacccacttaactgacgtacatactacctacaatacaa

SEQ ID NO: 609120 - DNA, 834 bp, Homo sapiens
agcgggccgccggcccggggagccacacgccgctgccgccgtttgggccgggaagcgatgtagtagctgccaggactgtccccacgccctgagccggacagagacccacgaagggccgaacgacgcacagcgaacgacacatgaagaagcagattcaaaccgacatgaaagcacgcatgggtaaaccagaacacgatgagagacagagactgacgaaaaccagacaagtccgttcagcatgacagcatcgtacattacacggaatcgcacgacagaccgaccgtgaaagcaacagagagacggccacaagactggcccaccacaaatacacccactaaggcagccatcatgggcagaagcaaatggataatagcccagcggggaccacaacgagcaatgcgtaaaccccgcaaacaggacacgcagcacagggcaggacacaaacacactgaggcaaaccccacacaccatccaccaaaagaatacaccatacaagtgaaaaccaccaaccataagccccaacgcgggcagacccactgtcccccaaacaccgaacacgcaaaccagatacgcaaacgctgaacacaccctaccacacggggcgcaccacgccaggaccatctgccggccaactgccacaacggacagccggaggcgacaccagctcaccagtcacgcacccacggcaacaccccacgcgaggcccaccaaagcggggacgtacccgacagcactcgatcggcccgcgacacaggccacacccacactccgcataccacccgacaccccctcatccacaacctaccgagggaccccccacacaaacacacacac

SEQ ID NO: 609121 - DNA, 331 bp, Homo sapiens
caagaatatcagaaataagtaagcaataaaactaattctggcaggaatcagggtggcaataggactagcagcaccctggggtggctttgctaccatgagttaacgctaaagaacttggctcagatcctagaatccttagccaccaacggagatcaggcattaaagagaattcaagagttccccagactctgggaaaatgtagttgttgataacagactaggcattgggattatttactaggctgaacaaggtgggggtcttgtgcagttattaattaaaacctgcttgcacatatttttaactctgggacaggttgaggtttaacattcca

SEQ ID NO: 609122 - DNA, 347 bp, Homo sapiens
  misc_feature (20)..(20): n is a, c, g, or t
  misc_feature (48)..(48): n is a, c, g, or t
ttttttgaggtggagtttcnctgttgttgcccaggctgtagtgcagtngtgcaatcttggctcactgcaacctcggcctcccaggttcaagctatcctcctgcctcagccttccaagtagatgggattacaggcacccgccaccatgcccagctaatttttgtatttttattcaccatattggccaggctggtcttgaactcctgactgaggtgatccacccaccttcccgccttggcctcgcaaagtgctgagattacaggcatgtgacaccgtgcccggccagtgccaacgtgtttaaacaaagaagttgctttgaaagaaatgtgtctttacagccacaaggac

SEQ ID NO: 609123 - DNA, 407 bp, Homo sapiens
caagagcaaaactctgtctccaaaaaaaaaagtggattttggatcttgaagaggtacttatacacttatgttcattacagcattattagcaatagccaagaggtggacgcaagctaaatgtccattgagggatacatcgaggaagaaaatgtggtctctacacataacgcaatattattcaatcttaaaaaagaaagaaatcctgtcctatgctacaatatcgatgagccctgaagatgttatgctaagtgaaataagccagtcgcaaaaagacagtattgtatgatccgctgataagtatctaaaatagttaaaccttgcttgagcccaggagttccaggctgcagtgaactgtgatcacaccactgtactccagcctgggtgacagagcaagactccatctcaaa

SEQ ID NO: 609124 - DNA, 907 bp, Homo sapiens
  misc_feature (693)..(693): n is a, c, g, or t
ggagctccaatcttcttgttctcttgctttgttcctatcttaacattttctggctgactctgaacttgaggcgccagagtacacatttttcttactagtctgatccattcacaacttctagttcacctatcatgtctacatccgcccgccgccgtctcatgcgggacttcaaggtacggattcatatcacaacgttgccatacgggctttcatcgaaccttggaagttatatttgaatatcttctctctgaatccgatatccgttcattgcttgataatctacccctctttcaaccccatttccaaagcatttttttgaggactatcgcccccgctaaccttctcatgtctgcagcgcatgcaaacagatccacctgctggtgtctctgcctctccagtagcagacaatgttatgacttggaatgccgtcatcattggccccgccgatacaccttttgaggatggcacattccgcctggtgatgaactttgaggagcaataccctaacaagcctcctggtgtgacatttatcagccaaatgtccaccctaatgtatacggaactggtgagctgtgtctcgacctttgcagaaccgttggagtcccacatatgaccgtgggcagtatcttcacgagtattccaaagtctactgaattgagccccaataattgattcgccaggcaacgtcgaggnctccaacctttacaaagacaatcgcgagaatatatccaacgtgtcgtgcacccggcacaaacctggcacactcacgcggccacgtcggggggggctccttatggccacgggacatgacggacaggggggggccggcaataacggagattggagcggctcaagggacggaaaaaggcgaatggtgtctaaagaaacaagcggcccgcgcgcttga

SEQ ID NO: 609125 - DNA, 331 bp, Homo sapiens
  misc_feature (32)..(32): n is a, c, g, or t
  misc_feature (153)..(153): n is a, c, g, or t
cgtctctagaggttcccccctcgtacacgtcngggaagctgtcgggttcgtcgccgggcaagggttgggcgccgatataggcggtgatcagttcgcgggcgcaggcggcctggtcgttgtcgacctccagccccagcaagccgaatatcggcnactcgcccgtgccgccgagcaaatggcgccccaccaggtgcgcctcgataccttcactggcaagcatctgctgcaacaactcgccctccatcagattttccggttcgtagattcgctgcatgggcgtacctttttattcgttctcgctgcgcattattcattttcgctgcgggtttca

SEQ ID NO: 609126 - DNA, 532 bp, Homo sapiens
agaccttctctcctcccacctctctaaaaatacaaaaaaaaatagctggggatgatggcgcgtgcctgtagtcccagctactcaagaggctgaggcaggagaatcacttgaacccgggatgtggtggttgcagtgagctgagatcacgccactgccctccagcctgggtgacagagcgaagctccatctcaaaaaaaaaaaaaaatttaacgattacccaggtatgataacggcagctatttggggagccccaggtgggtgggaagatcacttaaaccctgggaggtcaaggctgcagtgataagcccgtgatggtgctgctgcactccagcccgggtgacagaacaaaactctgtctgaaaaatagaaataggacggatttgacaaggctgccataaaattgaattgccctgttactccttggctccactgaaactgacacttgcatatctgagcgcgctgttggcaaggcgcccccatgaatcttctcgcccttctttcccttttccccgccaaaaacattcctgaggtg

SEQ ID NO: 609127 - DNA, 191 bp, Homo sapiens
ccgggggcccggctctgccccggctgcccgccctgcgcgcggctctccggctcccgctcctcggggccggggcctgggtggggcgcgcctttttccctttccccctggcgggccccggtgcccggcgcccgcccgcgtttcccgccgcggcgcggctgtggttccccgcgtgccgtcgggggccctggtgg

SEQ ID NO: 609128 - DNA, 752 bp, Homo sapiens
  misc_feature (707)..(707): n is a, c, g, or t
  misc_feature (715)..(715): n is a, c, g, or t
ggaatacggggtgacagcttgtgggtgtggagctctgtggtgataaatatgtctggaatgagatagtggtgatggttgcacaattctgaatgtgtagtactaatagccagtgactgtgtattttaaacacgtgaattttacggtatgtgagttatctgccaatttttcatagatggagcgctttgtcaacatggcataatagaagcattagaagctgtgtgtgctggtggtgccagtggtcccagctactcatgaggtggaggtaggaggattgcttgagctcatgagttcgaggctatagtgaactatgatcacgccactgcactccagtctgggtgacagagtgagaccctatctctcacatatatgtagtcggggcctgttggctgacatctgtaataccagcactttgagagtccaaggtggacgaattgcttgagctcatgagttcgagaccagcctgtgtgacatggtgcccactctctaccacttgggaggctgtgctaggaggattgatcgagcctgagagatagatgctgcactgagccatgactgtgcctctacaccccaacctgggcaagagtgtgagactccgtctcataatatgaatgaatgaatgaatgaatgaacgactgagtgattaatattatgatagtagcattagagagtatgatcacagtggacgctaggcgggcgcggaggctacncctgtatnccacactttgtgaggcgggatagaggtgcactgaggt

SEQ ID NO: 609129 - DNA, 942 bp, Homo sapiens
  misc_feature (45)..(47): n is a, c, g, or t
  misc_feature (806)..(806): n is a, c, g, or t
  misc_feature (918)..(918): n is a, c, g, or t
aagagtggtatcaacgcagagtgcccattacggccggggacagcnnncctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttaccgctaatataagtaaagtttgtaaaattcatacttaataaacaatttaggacagtcaaaaaaaaaaaaaaaagctgcccgcgaatttgggctcatttgccaattcccctatagngggccgattacaaataatgcccgcgtttaacacgtgagactggaaaccctctgtgtccacaatataaacgtgtggagcaaatcctctgtcgcaggtgcgtaatccgagcccnccccgaccgctttccggtgtgcgg

SEQ ID NO: 609130 - DNA, 1046 bp, Homo sapiens
  misc_feature (45)..(47): n is a, c, g, or t
  misc_feature (883)..(883): n is a, c, g, or t
  misc_feature (951)..(951): n is a, c, g, or t
aagagtggtatcaacgcagagtgcccattacggccggggacagcnnncctttccgtctggcggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcaccaaaccagtccacaagcacagggagatgcgtgggctgacatctgcaggccgaaagagccgtggccttggaaagggccacaagttccaccacactattggtggctctcgccgggcagcttggagaaggcgcaatactctccagctccaccgttacttcagcatggctggggaggccttggaaaacttataatcatggtggaagaggaagcaaacatgtccttcttcacatgacggcaggaaggagaagtgctgagcaaagggaggaaagccccttataaaaccattagatcttgtgagaactcactatcatgagaacagcatgaaggtaaccgccccatgattaanttacctcccatgggctccctcccgcaagacgtggagattatggaaactacaactcaagatgagatttnggtggggacataggcaaaccatatcaatgtacatgtgtctttatggtagaatgatttatattactttaggtatatagccagtattgggaattgct

SEQ ID NO: 609131 - DNA, 387 bp, Homo sapiens
cctctttgttacttttttttgagacggagtctcacctctgttactcgggctggtgcagtggcatgatttcagctgcactgcaacctccacctcctgagttcaagcgattctcctgcctcagcctcccaagtagctgggattacaggtgcccaccaccacgcctgactaattttggtaatcttagacagggtttcatcatgttggccaggctggtctcgatctcctgacctcaagtgagctgtccaccttagcctcccaaagtgctgggattacacgcgtgagccaccgcacccagccacagctgacatttctgacggcttggctagatacagtccttgcctggaggttcactttcccttggtagcacttcaccaactatgctgtacg

SEQ ID NO: 609132 - DNA, 185 bp, Homo sapiens
gtgagtgcagaacatgatgtctgcttctaccccttgtgtctggtgagatggtgcagcagggctgaagagggatgagtggggtcatgtccactgaagaactgtactatggggacagaaaaccaagaaatgtggagactgaacgggtatcccagagagtgaacgaccctgggcatcggcgcacaggg

SEQ ID NO: 609133 - DNA, 344 bp, Homo sapiens
  misc_feature (59)..(59): n is a, c, g, or t
gtcactctaaggatctctacaggagagagaactggagctctcccaatgctagcacgcantgaacagcaatacaacaaccaggttcttcacgaaacttaattttcacaagacttaaaccagtcatacaacaatctggttggataggtggtgcacccatcattcaaaagggccatcaagaacatggataactttcttttctccaccagagtagtgtccataagttgcttcacattactctttactattgtggtaactccatactatcttaagtttcctctataaattttgtttaaggtccgcattggttggactgtgtttaataaaggaaactctcatgttcctgt

SEQ ID NO: 609134 - DNA, 122 bp, Homo sapiens
catcttcctaaatccattattttcagtttttcagttacgtcatatgggggctgactgtgtgtcatgcagtgtcccagttctctctcttcctatctctttcctatattctttctcttttttct

SEQ ID NO: 609135 - DNA, 1736 bp, Homo sapiens
  misc_feature (1)..(2): n is a, c, g, or t
  misc_feature (77)..(77): n is a, c, g, or t
  misc_feature (79)..(79): n is a, c, g, or t
nntctctgcttgctgtgtctgatgttctgcctgctcgtccgtttgtctggtctttcgccgacgcgatcatcgccgantnttcttgttgttgtgcttgctctactagtcttactcaggatgggctgtccctgctctgctttgtgctgtgtgtattatcttcctcgccgtgctgtcgtgtcttttttgcatctggcttggtttgagttagctgtcgctcgtcggtctcttttctttcatctcgttcgtgcggatctgttgttgttgtctcaccctccctctgctctgcgtctgtggtttgacttgaatctcactatcggtggggtgttggtgtggtgagcctctcctctccctgcctgttgtcggttcgcttctttctatttttcttctctctgtgtggtggatgtttctttcctgcctccctcgtgtctgttctttcctccttcttctggtgttttacaatgcagggtggttgtgcttacatttcttgccttctatcggtcgttctcccccttcgtgtggtcggtcgactaagatttttttttttttttcttcctccactgtgggtgggtgggtctccttcttgccatgcttctctggctgtttttttctatcttcttttggctggcttctcttctctgttgggtccctcctcccttctttcttgtggcgggagtttgttctttgtttctggctccttcgtgtcttttcatttctctctgtctgtgttgatgggagaagaggcttttcttccttcccttcttctctctctgctccttcccccgcctgagtgggtgtttttttttttttttgtgtctcgccacagttgttttttttcttctctctcccacgttctttgtgtgggttgtctccccctctttcgcgattgttgtcttctttcctttttttgtcctcccgtgttctcttctctccaaggatgtgtttgttgttcacggttcgttcttattttttcttgcggtgttctctccttttccacatgccttttggtgtgtgtgtcctcctcctctctttgtttcctgtctgtgtgtttctgctcccccccgctcttcccgccctgcggtgtgttttttcccgcttctctctcgtagagggttgtgcatggggccgcgcccctctctttttcttttcttgtggattcttcttcgggtggggtgtttctacatacctctcttgtggcgccttctttttttttttctcccatgatgttttcccgctcgcggggcctccgctcgggtgctcccccctctctcgttgggctgttcatcgctctctgttggtggcctcttcctcctcctttggtgcttcttatttatgtttctctccctcccccctcttgtgtggcgcgccccctgtgcgcgcccccgcgcggcggttggtggagtgtgctccctccccgcacactgatacactttctttctttgtgtgtgcgtgcgcgcatgtataattaatttttcgcgcggctcctcttcactatatctcctcgcccacactatccggggcgtcttctgggcggcgtttttatattgtggttctttttcttctctctctctctcccccgggccccctccttctttttctttcccccccccccctcttttttttttttgttgtttttttaattaattgtggtggggcggggggggtacagggggcggctgcgtggccgctgtttctttttttttatatatataaaattgtgtgtgatgaaccaccacata

SEQ ID NO: 609136 - DNA, 718 bp, Homo sapiens
  misc_feature (28)..(28): n is a, c, g, or t
  misc_feature (92)..(92): n is a, c, g, or t
  misc_feature (102)..(103): n is a, c, g, or t
  misc_feature (108)..(108): n is a, c, g, or t
  misc_feature (116)..(116): n is a, c, g, or t
  misc_feature (118)..(123): n is a, c, g, or t
  misc_feature (161)..(161): n is a, c, g, or t
  misc_feature (188)..(188): n is a, c, g, or t
  misc_feature (202)..(202): n is a, c, g, or t
  misc_feature (206)..(206): n is a, c, g, or t
  misc_feature (210)..(210): n is a, c, g, or t
  misc_feature (215)..(215): n is a, c, g, or t
  misc_feature (246)..(246): n is a, c, g, or t
  misc_feature (258)..(258): n is a, c, g, or t
  misc_feature (260)..(260): n is a, c, g, or t
  misc_feature (262)..(262): n is a, c, g, or t
  misc_feature (268)..(268): n is a, c, g, or t
  misc_feature (270)..(270): n is a, c, g, or t
  misc_feature (296)..(296): n is a, c, g, or t
  misc_feature (298)..(298): n is a, c, g, or t
  misc_feature (301)..(301): n is a, c, g, or t
  misc_feature (318)..(318): n is a, c, g, or t
  misc_feature (353)..(353): n is a, c, g, or t
  misc_feature (384)..(384): n is a, c, g, or t
  misc_feature (388)..(388): n is a, c, g, or t
  misc_feature (395)..(395): n is a, c, g, or t
  misc_feature (440)..(440): n is a, c, g, or t
  misc_feature (452)..(452): n is a, c, g, or t
  misc_feature (462)..(462): n is a, c, g, or t
  misc_feature (518)..(518): n is a, c, g, or t
  misc_feature (562)..(562): n is a, c, g, or t
  misc_feature (575)..(575): n is a, c, g, or t
  misc_feature (622)..(622): n is a, c, g, or t
  misc_feature (635)..(635): n is a, c, g, or t
  misc_feature (657)..(657): n is a, c, g, or t
  misc_feature (702)..(702): n is a, c, g, or t
gcggggagaagaaacggaacagcaaganccccaatcggggcaggaaagaagtttctgaggactagacatctcttcatttaatgacaattttntggcgcaagnntcggngcccagancnnnnnnggggctcaggaggtggcgggccggggcccagggctgangcagtgggcggcagttcatgggcagtnatgtactttttgtnagcntcangaatnatcttgaaggctcgagcagtggcatagggtntgtttgttacangntnccggtntngggctggacgatgggtcactggacananctnacgaacagggacttttnggggccgcccttgggggaaccatttctcgaaagtngcttcatcactaaaagtgatgaaggtacgtnagcngcgagcnggggggttgacgggtccagttccagcatgaggagttaatgcaganaccgagggagcnggatcaagtncttctatgttaacgttctcttccttggggcctgggtccccaacaagtggcactgtnactgaatgaaaggtgattatgggcccggggcacttccgcttctnatgaacctgcttntttttatcagcctcgagccgctcatatgtttccagtgaccgtaaatnaagcccttctgtnatcttggcctcccggagcagtncctcctgggttagtggccgctcacagtggggcccctttcgccgtnttgactggccctgcct

SEQ ID NO: 609137 - DNA, 424 bp, Homo sapiens
  misc_feature (220)..(220): n is a, c, g, or t
  misc_feature (322)..(322): n is a, c, g, or t
  misc_feature (394)..(394): n is a, c, g, or t
  misc_feature (415)..(415): n is a, c, g, or t
attcggcacagttgtactcagcaggtctgcaatgttcaaaccctatgctttccaaaaaaaggtcttttgcaaagaatgctttggctcttgaccagctcttgggagataatctgtaagcccttggaagtatcctgcctgatcagagtgtctttgtttactgtggccttggccacactggatagtttgtgctaacagtgtgatttgtggtgtgagccttggntgagagatactagtttaacctctgcatggactagagactgaataactaaggtcaaccacacaggtgctccatgcctatctgactgaaccccaaaaacaactntggggcaccaagggcttgggtgaacttccctggttgacagtatttcatacatgttttcacacatcattgttnggggggaatttatggcacttngcccataac

SEQ ID NO: 609138 - DNA, 899 bp, Homo sapiens
aaatatgtacttatgggaagtaatatcaaactgtatggttgataaagtatggttgaatcttatggtttaaaggggaaaatagagcctgtgccttatatattacaaacacaggccattgggtgtgtgcacaaagggcaaacctaagggtattctagaacctatacttagaagacaggccatccagtatttgtgcttttctaagataatatgccccaaataaacaatgacctagagggggccttctggtgctggtgtaggggaatttaaaccccaaacttttccagggtggttccaaggggaggctcaaaactattattgttaaacacacacccaaaggtttgacgcacagcgggttattggcttattcctagccccgggtaaattctcctggaatccctatctcctaaaaaaacccattttggaaaataaggcttcaattgtggattccaaccatttccaattaaaattggcaattctggtgggtaggagggtagaaaaagcaaggcacccttttcctaaattgggcaacaatgggatccggacctaaatgttgtgcctaaagtggttgtacctttcccataggctttacaaggtcaaggattcaagctaatttttatcctcccaacagctgggcttaacctctgggtgtctgccagcgacgggtttaacgccattacaggataagcgaaagcgcagggaccatttgtgattgtgcctctaacattttcagacaaattattattcccttaaaaatttaacccatgcaataccgcggtggtaactgattaactttggacgccacactgtcatctacttgtggtggacattttcgcgtattatgaagattttccgaaataggaccttcaagaaccagggggagacgggggctccaattcggc

SEQ ID NO: 609139 - DNA, 663 bp, Homo sapiens
ttgatataatcccccagtaaacagatgctgtaggagcagacatgtatataggaatctacagaaattgctttgctataacaacagccgccatatcatgaagggcttaagaagtggcaatgagcaaagttttgtcttcagtgactccagagaaacggtatgagaccatggatactcactgtcagaatgagatgagcactggaactggacagagtaatacagtacagaacatccttgaacctttctacgtgttagatgtgtccgaaggcttctctgttctgcctgttattgctggcacacttgggcaggttaaaccatacagttctgtggagaaagaccagcatcgtattgctctggacctcatatctgaagccaatcactttcctaaagaaacacttgagtttgggctgagacatgtggaggatgaatctgctatgttacaaaggccaaaatcagacaagttatggagcataattatattggatgtcattgagccatctgggctcattcagcaggaaataatggaaaaagctgcaatatccaggtgtttactacaatctggaggcaagatctttcctcagtatgtgctgatgttggggtcgcttgtggaatcacagacactcctagaggagaatgctgtccacggaaagaacgtactctggatta

SEQ ID NO: 609140 - DNA, 248 bp, Homo sapiens
ttcgattggcgggaacttagtgagagcctgtcaacaaacatagaaaaattagttgggcttggtgatacacatctgtagtcccagctatttgggaggctgcctttatatcaggcagtcgaggctgcagtgagctgactgccctactggtatacaagcctgggtgaccccatctcaaagaagataagttaccagatgtcatgggtaaaggttggtcttcaaggggcctcataagttgcccggcaatcgaa

SEQ ID NO: 609141 - DNA, 1299 bp, Homo sapiens
  misc_feature (719)..(719): n is a, c, g, or t
  misc_feature (738)..(738): n is a, c, g, or t
  misc_feature (758)..(758): n is a, c, g, or t
  misc_feature (1160)..(1160): n is a, c, g, or t
  misc_feature (1166)..(1166): n is a, c, g, or t
  misc_feature (1191)..(1191): n is a, c, g, or t
ggccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgctttgttgaatttgaagatccccgagatgcagctgatgcagtccgagagctagatggaagaacactatgtggctgccgtgtacagagtggaactgtcgaatggtgacaaaaacgacgtagcaaatcgtggcccacctccctctgtgggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttcttctaggtctcgtagtcgatctaggtcaaatgaaaggaaatagaagaccagtttgcaaaagtggtgtacaggattacttcatttgacaggagtatgtacagaaaattcaagttttgtttgagacttcataagcttgngcattttaagatgtttagntgttcaatctgttgtctctngaacagtgacacaaagtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgttttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaaatgctgcactattaaattagaggttttttgaaaaaatcccaactctcatcctgggcagaggttgcctagttggtatagantgttangtttcaagaaagtttacctttgctntagttcataagttccttatttgattgctgtatatggaaacatggctgttcgtgacattctttatgtgcaaatttgtgatttcaaaaatgtcctgccagtttaaggtac

SEQ ID NO: 609142 - DNA, 124 bp, Homo sapiens
cgcagagtgactgcatacgttttcctgacactgtggcatcgtctttgctctttcctcttccttcttccgggcagcctcctcccgctgtttccggatgatggccagccgggccaggtcagccttg

SEQ ID NO: 609143 - DNA, 886 bp, Homo sapiens
  misc_feature (881)..(881): n is a, c, g, or t
ggccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgctttgttgaatttgaagatccccgagatgcagctgatgcagtccgagagctagatggaagaacactatgtggctgccgtgtacagagtggaactgtcgaatggtgacaaaaacgacgtagcaaatcgtggcccacctccctctgtgggggtcgtcgccctcgagatgattatcgtaggaggagtcctccacctcgtcgcagatctccatcatgtctcttctcagcaccctctgaatctgcattagccagtcaactagccctttcagcgtcacttgtgaccagcggcggcccattcagcttggctggtgtcgtttcacatgacccagtgctgggcaagtcgtcacggtagcacagaccttaggttcccgagcatgctgtaactctcagccttctctacaacttaaccaaatcggcagcacagcacctcgaccgacacacaaattctggcaaacagctcacctgatcatctaccacatcgtctcacacaacaatcacagcacgcgccttccgcgtaacaacaaacacgaacaatcaccaaaacccccttcgcatcacaacttaatccacgcacattctcgtacaaacttgacaccaaatctccagggccgaccnccgga

SEQ ID NO: 609144 - DNA, 204 bp, Homo sapiens
tgaacatcggtcttcgtgtctgaacattcgtgtccacattcgtgtctgaacattcgtgtcccgccagctttgttaaaagccaccatgtggagggtagcctagtgaagggatgtaagagtgctgactttggcctggcccgggtcattgaggacacgaatgttcagggtcaccgcagctcgcaattcgtcacatccatggtccatc

SEQ ID NO: 609145 - DNA, 131 bp, Homo sapiens
gcctgcgcgcccgcatcgatatgcaggccgaaaatatgtggctgcgcgacccagtcatgtaccggatccgacaccaagcccaacaatccaccggtaccgagtggtgcatctaccccaagtatgactgggca

SEQ ID NO: 609146 - DNA, 187 bp, Homo sapiens
attctccgagatacgtatggcaataccacctgcacacgctatctataatgccgatgaattaatgggcgaaagactgctctaatatagtgcgatatcgaatcaaaaaacaagcatggcctcacaccactgttacttggagtacataagcaaaaacagcaagtcgtgacactcttcattacgacaacag

SEQ ID NO: 609147 - DNA, 1408 bp, Homo sapiens
  misc_feature (1010)..(1010): n is a, c, g, or t
  misc_feature (1013)..(1013): n is a, c, g, or t
  misc_feature (1046)..(1046): n is a, c, g, or t
  misc_feature (1089)..(1089): n is a, c, g, or t
  misc_feature (1100)..(1100): n is a, c, g, or t
  misc_feature (1107)..(1107): n is a, c, g, or t
  misc_feature (1115)..(1115): n is a, c, g, or t
  misc_feature (1120)..(1120): n is a, c, g, or t
  misc_feature (1122)..(1122): n is a, c, g, or t
  misc_feature (1126)..(1126): n is a, c, g, or t
  misc_feature (1135)..(1136): n is a, c, g, or t
  misc_feature (1141)..(1141): n is a, c, g, or t
  misc_feature (1143)..(1143): n is a, c, g, or t
  misc_feature (1153)..(1153): n is a, c, g, or t
  misc_feature (1171)..(1171): n is a, c, g, or t
  misc_feature (1176)..(1178): n is a, c, g, or t
  misc_feature (1185)..(1185): n is a, c, g, or t
  misc_feature (1187)..(1187): n is a, c, g, or t
  misc_feature (1189)..(1189): n is a, c, g, or t
  misc_feature (1207)..(1207): n is a, c, g, or t
gagtcctttacttattttaaaataacgcatttgaattttattatagatactcccttaacaatgtgaaactagtacacaaactttctggcgtttctgattgatagaccccaggaattttgaagacgacgtaaattacttggaaatcctaatttaaacaacctgcgttttggtattatatacttaacagacaaatagcttaaaattaaaaaatccctaaagtagaatgtcgttcctttatctgtatattaactttaacttcttttaacatagggtgtttaatgactgtgatgattttcacctagtatggagtacataaatatatagttgtgacattctgtgttgaaatattggcatgttaacccatttgtcctgtttaattaggaaataaagacggtagagctagtcggaaaatgaatagttaatcgtggaggaggagaaaacatagctcagtactttgactagaggcagctgggaaagtgacgtcctgtagcatttgctgttctagaaagtacagagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaagggaggtactgatggacaaggaggtaccttncgntacacctttcatggcgatcctcatgctacattngctgcatttttcggagggtccaacccctttgaaagtttctttngaagacgaagnggggggnggagagantcctnanaaantggaaaaanntggtnancctttatgtncctttggtttacgcactnagtgnnnatccaananancggaattctgtggggacnctcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaag

SEQ ID NO: 609148 - DNA, 1207 bp, Homo sapiens
  misc_feature (1010)..(1010): n is a, c, g, or t
  misc_feature (1021)..(1021): n is a, c, g, or t
  misc_feature (1026)..(1026): n is a, c, g, or t
  misc_feature (1028)..(1028): n is a, c, g, or t
  misc_feature (1056)..(1056): n is a, c, g, or t
gagtcctttacttattttaaaataacgcatttgaattttattatagatactcccttaacaatgtgaaactagtacacaaactttctggcgtttctgattgatagaccccaggaattttgaagacgacgtaaattacttggaaatcctaatttaaacaacctgcgttttggtattatatacttaacagacaaatagcttaaaattaaaaaatccctaaagtagaatgtcgttcctttatctgtatattaactttaacttcttttaacatagggtgtttaatgactgtgatgattttcacctagtatggagtacataaatatatagttgtgacattctgtgttgaaatattggcatgttaacccatttgtcctgtttaattaggaaataaagacggtagagctagtcggaaaatgaatagttaatcgtggaggaggagaaaacatagctcagtactttgactagaggcagctgggaaagtgacgtcctgtagcatttgctgttctagaaagtacagagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaaggtaagtattctctggatatctttctgtctnttcagctctgnctctntntttttttctctctctctgccagcctttntcccctctctctcagcttgttaaggttatccttaaattggattctcagtcatatcgagtattgcagagccatgaatgaaatgtccttggttgcctttttattttagcattttggattatacatattttatcattggactaccaatgttaca

SEQ ID NO: 609149 - DNA, 691 bp, Homo sapiens
atagctactctcataaccctcaacagcccactccctcttagccaatattgtgcctattgccatactagtctttgccgcctagcgaaggcagcggtgggcctagccctaactagtctcaatcgtccaacacatatggcctagactacgtacataacctaaacctactccaatgctaaaactaatcggtcccaacaattatattgactaccactgacatagacttgtccaaagaaaccacataatttgaatcaacacaacaaacccgacagcctaattattagcatcatcgcctcttactattttttaaccaaatcaacaaggaaccatatttagctgttccccaacctttttcctccgaacccctaataagctcccttcctaatactaactagctgactccgtacccttccttgtagctatccgctatggaaggcattactgtataacaagctcgcagtctgaccttacggacaaaatgagagcataaaaatcggctgcaattggataactacttcgaggtacggtgcatataggcccagcgttagataatcatgccattgctcgatccaagagactccactggaaggcttacacccggcgacaagtgcattcatcataaagtcgtgccacggaacatttacgatcctacaatgtagctaaatctggtctagcgaaaattccaaagtaggaa

SEQ ID NO: 609150 - DNA, 991 bp, Homo sapiens
  misc_feature (552)..(552): n is a, c, g, or t
gtatttccagaggtggcttggaggccctggggtggtggggccctgcctgaggcgagagctgaagctgtcgagtccatcttccaccggggcacgagcgcttccgcattgctagcgcctgcctggacgagctgagctgcgagttcctgctggtggggccggagtggtgccgtggcggggtcccggcctggaccgcatctccccccacgggggtcggtgcctggggatcctgtccgcatccactgcaacatcagggagtaataccctgttgtgcccccccaatctgatcggtggaggtcatgatgaacccttaacttgggctgctgtcttggagaggctggtggcccatagaagcagggggaatactcttggttatttgcagcatctgaagaggactcactcctccgatccggggggtaaccttcctataacctcctctcagcatcccagaatgttggagagtgctggaatcaaccttttgccagcaagacgcggggccacacgcgcggagggaacggtgtcttccagacagactgagagattgaggagaatgcnctgaagggagcccaggaaaagaagtttagattcacttatgaccttgcaagggagggaagagcccaggctgagcggcaaaagaaaatcgtgaaggattgatgggcttgggacaaaagaaaatcgttgggcattcctaaggaagaacacattaaaaggcacccagaggcacgaatttacttacacttgcgggcacgtgtccggatcgtgacggcccatgtacgggcggattaagagaccacgggattatggcggtcccgagttccacgggggaactatgcgccaactcgtgacataacggctggttatagtgggatgcaccccaaagtgacccgacaaggttggcaagatatcaaacccaagaagagacgggtatcactaagggcttaaggaatccctgcccccgtagggggttcgcactccgcatatgtggggcacatta

SEQ ID NO: 609151 - DNA, 1125 bp, Homo sapiens
gagtcctttacttattttaaaataacgcatttgaattttattatagatactcccttaacaatgtgaaactagtacacaaactttctggcgtttctgattgatagaccccaggaattttgaagacgacgtaaattacttggaaatcctaatttaaacaacctgcgttttggtattatatacttaacagacaaatagcttaaaattaaaaaatccctaaagtagaatgtcgttcctttatctgtatattaactttaacttcttttaacatagggtgtttaatgactgtgatgattttcacctagtatggagtacataaatatatagttgtgacattctgtgttgaaatattggcatgttaacccatttgtcctgtttaattaggaaataaagacggtagagctagtcggaaaatgaatagttaatcgtggaggaggagaaaacatagctcagtactttgactagaggcagctgggaaagtgacgtcctgtagcatttgctgttctagaaagtacagagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctaaaaagagagaaatatatgatcagtttggggaggaaggattcagaggagaacaatgcaagttctagatggaacactaggttattttcagggtcaccttttatggtccatttccattgacatgattgtttgactttttttgtatggtttcaacccaaatcgctatatagtttataaaagaact

SEQ ID NO: 609152 - DNA, 209 bp, Homo sapiens
atctacagagcttatttgcggtgccttccttctggtgtacgtatggcagtgcggcagcccttccccattgcggttccattgcgagcaagttggcccagaatttcatcaccatctgctacagtctgatctcctcttctgaggcaccctcttttaaaaatggggccccaaagacggagaagagctcatccccgcggatctcctactcaccg

SEQ ID NO: 609153 - DNA, 277 bp, Homo sapiens
ctctaatggctgtagtccagctgtacaaaataataaatttctagcagcattatcataatactaaagaatggaacaaccaaatgttgtcactgaagaagagacaataaaagtggtaatccatacagtaaaacactattcagctttaaaaaggatcgtagtgctgacatatgctaaaacatggatgaaccctgaaaacatgctaagtgaaagaagccagacaccaaagaacacaaactgtataattccttttatgtgaaatttctagaacagccattta

SEQ ID NO: 609154 - DNA, 1371 bp, Homo sapiens
  misc_feature (973)..(973): n is a, c, g, or t
  misc_feature (976)..(976): n is a, c, g, or t
  misc_feature (1009)..(1009): n is a, c, g, or t
  misc_feature (1052)..(1052): n is a, c, g, or t
  misc_feature (1063)..(1063): n is a, c, g, or t
  misc_feature (1070)..(1070): n is a, c, g, or t
  misc_feature (1078)..(1078): n is a, c, g, or t
  misc_feature (1083)..(1083): n is a, c, g, or t
  misc_feature (1085)..(1085): n is a, c, g, or t
  misc_feature (1089)..(1089): n is a, c, g, or t
  misc_feature (1098)..(1099): n is a, c, g, or t
  misc_feature (1104)..(1104): n is a, c, g, or t
  misc_feature (1106)..(1106): n is a, c, g, or t
  misc_feature (1116)..(1116): n is a, c, g, or t
  misc_feature (1134)..(1134): n is a, c, g, or t
  misc_feature (1139)..(1141): n is a, c, g, or t
  misc_feature (1148)..(1148): n is a, c, g, or t
  misc_feature (1150)..(1150): n is a, c, g, or t
  misc_feature (1152)..(1152): n is a, c, g, or t
  misc_feature (1170)..(1170): n is a, c, g, or t
gagtcctttacttattttaaaataacgcatttgaattttattatagatactcccttaacaatgtgaaactagtacacaaactttctggcgtttctgattgatagaccccaggaattttgaagacgacgtaaattacttggaaatcctaatttaaacaacctgcgttttggtattatatacttaacagacaaatagcttaaaattaaaaaatccctaaagtagaatgtcgttcctttatctgtatattaactttaacttcttttaacatagggtgtttaatgactgtgatgattttcacctagtatggagtacataaatatatagttgtgacattctgtgttgaaatattggcatgttaacccatttgtcctgtttaattaggaaataaagacggtagagctagtcggaaaatgaatagttaatcgtggaggaggagaaaacatagctcagtactttgactagaggcagctgggaaagtgacgtcctgtagcatttgctgttctagaaagtacagagacacgtagtgaaaatgggaggatctagaaggaggctgtctcctgtgtagtgtatatttatctgtaagtgagccgttggggaaggattgaatacagagacgctgtctgcttgctgccttaagacagctagctgaattgctgattaacttttaaaatacccagcttggtttatttttcttagaatctgttgctaagactggggacgctgttttcttttacaaagggaaatctaagttaatttcaaggcattcgaaatggggaaagactattattgcattttgggaattgagaaaggagcttcagatgaagatattaaaaaggcttaccgaaaacaagccctcaaatttcatccggacaagaacaaatctcctcaggcagaggaaaaatttaaagaggtcgcagaagcttatgaagtattgagtgatcctagaggtactgatggacaaggaggtaccttncgntacacctttcatggcgatcctcatgctacattngctgcatttttcggagggtccaacccctttgaaagtttctttngaagacgaagnggggggnggagagantcctnanaaantggaaaaanntggtnancctttatgtncctttggtttacgcactnagtgnnnatccaananancggaattctgtggggacnctcccgcctcaaacaagatcctccagttattcatgaacttagagtatcacttgaagagatatatagtggttgtaccaaacggatgaagatttctcgaaaaaggctaaacgctgatggaaggagttacagatctgaggacaaaattcttaccattgagattaaaaaagggtggaaagaaggcaccaaaattacttttccaag

SEQ ID NO: 609155 - DNA, 1205 bp, Homo sapiens
  misc_feature (269)..(269): n is a, c, g, or t
  misc_feature (455)..(455): n is a, c, g, or t
  misc_feature (904)..(904): n is a, c, g, or t
  misc_feature (929)..(929): n is a, c, g, or t
agcggaagacaaggcgggtatcggacacacgcagcgacgaggagggcactggggtattgtccggctccgcgcggcggcagtgctggagctagcgaagaagctgcgccggtgggagcgccgctgagcgatccggccatgctgcggaggtggctgcgctgagaccgagacaggaatggcaggtatgttcaggtctgccagatgaacagtggtctgaggaatgaacagaggttagtgacacggaccaagtggcgaaggaagcctccaatggnctttataggctagtcatcctcgacatcaacgaggtatgtacgcttgggtcgttacaagtttattcgcctagttagagaggcgcgtctaggtccgacttcgcatcattcgttggaaggacttcagcacctgcctaagagccatcgggcacagggggatggggattgctctaacataggcgtcgactncggtggttacaagctcgctagcttgtatatcctaggcaggttaacacttcaaagctttgactacgtacgtgtcgtccttgtggagactcgcgtcaagtggtaaaattgcctctactaaatggcattctcaagcacttataaagcggtattcatcttcgcggactggctcagcctttgacgatgacttgtgccatattgccagtgtgggtcgactggacaaggaaggtacgcggtactttcatcattgagtacaatggcccttactcaataaggtcgtggagaggagactagaggtcgtgtgaatccctccttcaacaaatctctatcaatagaatcttcgtgaatttggggaaacacgaaatgggtggaccacgcccaggaaacacatcgtagcgttttaagaagcgggaatgcttttataagaaacgaaaacactcgtcgtatacctntcgctctccagtacgaatatagttnacgttggtataaagcttggtgaaacaaatgaaaggacaaaatcagatggagaggaatgatttgttggccaaaattatttccaaaggcggaaaacaatggaatagagaattgggtatcatacttcgaattaggaatccaagtggtaagcatggttaagaacgagttgaattagaaataagcaaggaagaatcttggttactggtttcggttacgaacttttcagaaaagtttgtggaatcaatagaatgtagccctttttccatggttggaaaggaa

SEQ ID NO: 609156 - DNA, 777 bp, Homo sapiens
tctacgaatggcggctacttcaatgaatggagatgtatgcatttgcgattcttcatccgcctgtagatgacccacagagtggagaactgccttctagaacaggtggataatcctagctcacaatgtgaggactatcctattaagtgtaatctcactgcttaattgatgcccaccatccttctccccatgccaattgtcgacttgctgtcagattgtgatgttcacggaacatggatagacagctacaaggaaaagacaataggaatatgtctgaagagttacttaggaacattgacgtttcagccacttaaggccggtaagtcagaaaaggatggagtgaatggtccccagcttacctcctggcggaatactgcattcaaaatctaaagttgccttccagatgtacatacgagcttcacgatttgctttatcgacagacgttgttatgagtgtacgatctacttgtacctgatgataggatgcaggaggtaggaagagtgccgactgtatatgaatgatgatgattctggcgttaatgaggacgtcgtgactgtagctccttgccagtgcccctgtactgccctgccatctcaggccaaaggagaggggagcaagtggggacctggccatggcccctcagaaaaagctattcacagcgggtggggaaacactacacagctcctgctgactccccttatggtctcagtttgtccttttttggactttatggagaagagtacctccgaaagtctggaacttgttttaactttctcattt

SEQ ID NO: 609157 - DNA, 343 bp, Homo sapiens
ggaatccagcagtggggaggcagcaggcagtcacttggctgcaggagtttgaggccaggagttgagaccagcctggccaacatggtgaaaccccatctctactaaaagtacaaaactgagctgggcattacagcagacacctgtaatcccagctacctgagagctgagaggctgaggcaggagaataactggaatccgggagatggatgttgcagtgagctgagattgcaccactacactccagcctgggagacaaagcaagattctgtctcaaaacaaaacaaaacaaaacaaacaaacaaacagaaaaagagggactcagagagccagggaccagggaagg

SEQ ID NO: 609158 - DNA, 1037 bp, Homo sapiens
atctgctttactgtctttagggtgtgtatgaaataaacatgacaggctttctggagccctcaaggtgcctacttgccggttccctttccagcagctcccccactcgccttagacacgctcctctgggagctctctgctctagatgagtccgctccacgggtaccagcacccatttaacaccagacctgatagaaaaacatgacaaacaggacgagaatataacatcggaagaggaatctaaaacaccagaacaatggactagtgccagggagggaagagaacataaaggcgggtagggtgcaacacgcatcaagaaacaggccagggagcatcatcgaataaaggccatccaaattcagaaacgatcagcatcgcaggagaggacgcaacaaaggaaaccacacacatgacataactcgggggagctaggcatagagggaaaacctcacccttacggaatcagcaactcccatgggaaagaagtataaggattagaccagaacaaagctgcaacaatgaacaccagctgaagcatacagagaatcctcccataaaaagagaacgaagcccaaacagacacacaggatggcagggacccacgaaaacggaaaaggaatacatactaggacgtcaagcgaagagaaaccaaaaagaggagagcgatggatcggaaacgaacaaggcacgacagcgagtacaccaacacaggcaatcgggcacgacacgaccacccgggaaccaagagaaagacaacaacatagaacaataagccataataccacgaagaactacagcgtccagagacatgcagacaaaaaacaaggagaggaaaaagaaacgaagaaacccaaacggcgactactgttcacggctaaagacaaggacgatagaaggagaaaaaacaatacgaggcgacagaaacacaaacacaacaacaaccagcaccacaacgagacacagacaataagcacaagatcaacaccctagaacaaaaacacatgacaaccaacaaaaacagaagacagatgccgacaacc

SEQ ID NO: 609159 - DNA, 122 bp, Homo sapiens
cagctaggaaggtatggtgacacatcgtaggaaccagaacgggatttcactgagtttaccaaatcaactgtgtgacgtttctgcacgctgctactggtttcatctaataaatgtttacttat

SEQ ID NO: 609160 - DNA, 1291 bp, Homo sapiens
ccaactaagcaggatcctccccaaacgccatgagagtgcggccgagatcacagatctagcctggcggcttgcatcttcatctacagactcagcaggaatctggtacacttcaggccacctgcgccaccagacgtgttgtaggggactctatgaatggactggcactgtgtctgtccatactcatgctccgagaatccaagaaaggttgaacgctgagcgcgccctcaccgtcattcacgtccatcattggccgcgtgctgacctttcaccatcctccatgctgtgctaagagcggtagcgggcatacgatgtgtagtgaggtgcgcgagaaagctgccgctttccgtgggggtgtgggctgcagccggtctggctgggcgatcgacagcgcggtgggctgggtaaagtgctgggccacgaacgcccagtccctgacgtgagccgaggacctaatggataaatctctaaatgctacatattagctgtgtgtggcggcttttgtcgccagaatagaaggggcgaagcgtctcccagtgagggtactctcagcgttagtggccacactaaatgtgagcgtccgaggcgttgtgggcagaataaaattggcctgagaacaaagcacacacaatcccaacatccgagcgtggtgttccagggttcgccctagagacgactgcgggcgcactcggtagggcgcacacaaattgagcgccaactctatagagaccccttccccaggggacacgttcggcgtgggcgtgataaaggcgagaaagaacgccctggggcacaaaggggcccctttctggcgcccttttatgaacgcctgggtgggtttcgcaacaatctccccaactatttagggcgcttgcgctatatgcggtgctgtgggtagacccccccaaagaacccttccaacgtttgccaccttcttgtcttggaggacaaacttacccggttatgaaaacgaacgttcccaagaggcggtccggagagaacacgaccggctcgacaaccgaccagcgccggacacgcggggaggacacccacggggccctaaagccacgcaacgacactttcggccaagattaacacgaggccggggcacttgggccaaagactcgccccaagtcgccccaaagcgcagggaaccccccgcgttcggcgggaaacccactcggacgacggcacgggtatgagctcggcgcagcaacggcgataaccactcgcggacaacccacagacccccctgcccttgggggcaacacaggggcacaaaacaatttccacg

SEQ ID NO: 609161 - DNA, 459 bp, Homo sapiens
  misc_feature (204)..(204): n is a, c, g, or t
atgcaccattctacagactggacgactggacattctgaagactcatgaataccaggcttcaggatcgctgacccaggaggagccacggtggctctaagtgtactgcttcgtgttcctgcgtcaccagcccactaaggtcctctgacttttgtgtagtagcatttttctaaggacaatctgcagagcagctgcttcagaactatntgtgttgccgcgccatcccaaaaaaacctggatgaggacccttgcattctgggcctggaaatcttcattctagaaagctccttttactagacagaataatggtccccaaagatgtccacatcctaatccctggaacctgtggctatgttaccatagttggcaaaagggcccttcagatggagagatgatcctggattatccgggtgggcccagactaatcacacaagttctcagcagcagaagagaacctttcct

SEQ ID NO: 609162 - DNA, 121 bp, Homo sapiens
cgagctggccaccaagctgagccggcggcttgcagatggagggcgagggctggtcggcgatgaccccggagcagcccgggtctgaacggggcagcggcggcggcggcgggggcacccgacg

SEQ ID NO: 609163 - DNA, 151 bp, Homo sapiens
ctgtgcaagaagttgcggaaagacctggaagaccaggtgcagctcatgcgccgcttcggaccccctggacctgaggtctgctgaccttgcaagcatcccatggggctggggcgggaccagggcgaattcataaagttttggacttttgcta

SEQ ID NO: 609164 - DNA, 183 bp, Homo sapiens
gtaggaggagtcctccacctcgtgcaggtacttgagagaaagcttgtaagaggtatgggtgtaatggagtagctagtaggagcaggtatttctcttaagttggtgggtgggttttaaagtttggaagaatcggaggtttctgtgaaacattggtggggtgtaatttggggtatgtgagtggtg

SEQ ID NO: 609165 - DNA, 521 bp, Homo sapiens
  misc_feature (11)..(11): n is a, c, g, or t
  misc_feature (18)..(18): n is a, c, g, or t
  misc_feature (23)..(23): n is a, c, g, or t
  misc_feature (28)..(28): n is a, c, g, or t
  misc_feature (34)..(34): n is a, c, g, or t
  misc_feature (41)..(41): n is a, c, g, or t
  misc_feature (45)..(45): n is a, c, g, or t
  misc_feature (48)..(48): n is a, c, g, or t
  misc_feature (50)..(50): n is a, c, g, or t
  misc_feature (53)..(53): n is a, c, g, or t
  misc_feature (99)..(99): n is a, c, g, or t
  misc_feature (108)..(108): n is a, c, g, or t
  misc_feature (118)..(118): n is a, c, g, or t
  misc_feature (129)..(129): n is a, c, g, or t
  misc_feature (132)..(132): n is a, c, g, or t
  misc_feature (135)..(135): n is a, c, g, or t
  misc_feature (139)..(139): n is a, c, g, or t
  misc_feature (142)..(142): n is a, c, g, or t
  misc_feature (148)..(148): n is a, c, g, or t
  misc_feature (154)..(154): n is a, c, g, or t
  misc_feature (156)..(156): n is a, c, g, or t
  misc_feature (161)..(161): n is a, c, g, or t
  misc_feature (175)..(175): n is a, c, g, or t
  misc_feature (198)..(198): n is a, c, g, or t
  misc_feature (205)..(205): n is a, c, g, or t
  misc_feature (208)..(209): n is a, c, g, or t
  misc_feature (220)..(220): n is a, c, g, or t
  misc_feature (236)..(236): n is a, c, g, or t
  misc_feature (240)..(241): n is a, c, g, or t
  misc_feature (247)..(247): n is a, c, g, or t
  misc_feature (252)..(252): n is a, c, g, or t
  misc_feature (259)..(259): n is a, c, g, or t
  misc_feature (262)..(262): n is a, c, g, or t
  misc_feature (265)..(265): n is a, c, g, or t
  misc_feature (270)..(270): n is a, c, g, or t
  misc_feature (277)..(277): n is a, c, g, or t
  misc_feature (295)..(295): n is a, c, g, or t
  misc_feature (297)..(297): n is a, c, g, or t
  misc_feature (305)..(305): n is a, c, g, or t
  misc_feature (317)..(317): n is a, c, g, or t
  misc_feature (330)..(330): n is a, c, g, or t
  misc_feature (339)..(339): n is a, c, g, or t
  misc_feature (350)..(350): n is a, c, g, or t
  misc_feature (367)..(367): n is a, c, g, or t
  misc_feature (383)..(383): n is a, c, g, or t
  misc_feature (387)..(387): n is a, c, g, or t
  misc_feature (389)..(390): n is a, c, g, or t
  misc_feature (393)..(393): n is a, c, g, or t
  misc_feature (396)..(396): n is a, c, g, or t
  misc_feature (425)..(425): n is a, c, g, or t
  misc_feature (428)..(428): n is a, c, g, or t
  misc_feature (439)..(439): n is a, c, g, or t
  misc_feature (455)..(455): n is a, c, g, or t
  misc_feature (459)..(459): n is a, c, g, or t
  misc_feature (510)..(510): n is a, c, g, or t
taaataaatanttagaanacganttggntcctanaagcatntggnctntnggnctcagttctggggtgtctcacccatgggccccacgcaggggcgccngggttcccncccaccccgngatcaagaaanggnatngggngcngggggntgggtngnaatgngccccttttctagngccttccccggccatctacaggnagggtgnggnngggaaaaaganaactgggatttctcgnaggnngggggnccgcncggttgnggnttntacgnggttttnttggttccccgggggggngngtgtgtgnggggggggccgnggcccttagatcnccttcttgngcccgtggtanaggaccagcccgaaggngccccccatgccccgnaggngnnggnccncgcccccctgaagaaggccttcccccccncanctctgaggatnttcctccaacagtggngggngcccgtgttcatgatgttagcccctttgcgcccgggctgcatcatcatgcnccgccgccccg

SEQ ID NO: 609166 - DNA, 303 bp, Homo sapiens
  misc_feature (45)..(45): n is a, c, g, or t
gacttagaggatcccccaacaagagcagcttattttattgcaggnaagctaggaaggaataggacaactgagggtctcgcaggtacaccatcacccggcatgactgccaagtcccagggtctgtctggaggcagcgggaggatcagcatcctgccccctttggtccatcctgtgtgctgtggggaccaggcccatgctactcaaggccaaggtaggaaacagtctttcctgttttcttcagggttgcaagcagagtgtcccatgctgtgctcagattcaatgcagaccttcttgttgggagct

SEQ ID NO: 609167 - DNA, 1039 bp, Homo sapiens
  misc_feature (410)..(410): n is a, c, g, or t
ttgaaactatactgctgtgtctgcgtggtattctcgcgcggcttcggacgggccgcctaagttaacgtatgacgcaagaggtgagaggacgccggtggaggggctctgcgacacagaacatacgcatgagatagcaccacgagtgtagtgattctcgggggtccaagggcaagacacgaggacgtggtccgaatgcgcaagagcgtgccgtgacgagctcgactatctttagctctttgtctagactcacacgacttagcgtgatgaatgaagatatcgtgtatacgggaccgttttcccaagctaatcaatcctgtattgagcccttacgcgtgtgcgtctcctgaggacgactgaacgcactctcagagagctcacactgtgctcaggggcgagttccctttcccggnagtcctcgctgtttggtacatggatctggatgagcaccgtggtctattaacagtcctggaagtgggtcatatggtagaattgtaacaaccgcgataacattgccatgggggctggaggaattggactcacttgggcgtggcgtgtggtggaccgtatgtggcagtggagagttggggtttccagaacgcaaggatggtataattctgggcacattccattctcccaacgtgtcttgtttcattgcttcggatcatacccttcagagtatggcattgggtgggggggcgcgcctcctgaaagaggggggttactggcctggtaggagggcgacccgcacaatgcgttccgggggtttttccccggcacctgtgatgggctagttgtgacaacacgaagggtatcaccccagtacttaggggggcgagctcgggggactaataagacatgacagtggaagcgacccctgagccggccgccgtgtttttgaccgactgcactgggcgggcaacagtgcgagacatgggacggaacaaccggctggggaggacttcaatcgttgcagatagccagcggtgagggtccagggcgtgagcaggacctatattaagggtcaaaggaacaaacgaag

SEQ ID NO: 609168 - DNA, 206 bp, Homo sapiens
tacttttcacagggcacacaaatggaatccgtgaaggtatggtccatcctaaagagaatattacaagagtcctaacagaaactgaccctgtataaagggtagatggcagatccactagaagcagactttaaaacagccatcttaataggtatgctctaaataactatccggtaatatgtgggaaacacgtcaatgatccaggatat

SEQ ID NO: 609169 - DNA, 141 bp, Homo sapiens
atagaaaaagaaaaatggtactctttggctataggggaatcatcagcaaggcagtggttgggatggtatgtggcgtatctaatttagtaaatcaatacatactggtaaaactggaagtttggagcctttggcgagcgatag

SEQ ID NO: 609170 - DNA, 1167 bp, Homo sapiens
cgtgggttattaaccaacatcaacaacaacctattttagctgtttccgccaaacctatttccgtccgacccccataacaacccccctccctaactactagactacctgcactccgtaccccgtcacaaatcatggacaagccacacgccactgtatccagctgaagccacatatcaacgaagaaaacacgtctaccctcctcgtactaactaatcatccctacaacactctcccttacactgtactaaccacttcacacgccacagacaccctaactcactacttctctactactcttctctcgaacacccaccatctctattccaccacccattgagcctactcactcaaccacgaactgcagcgcacaccagaccaagaacaccgccctgcaaccgccaagggcccaccactaactatccctagttcctaacaccccatacgctagcgccatcccacttctccccacctacctcactccgccacttaacatctctaccaccttcacaaaacaccccaatagcgcttcaccttacaaacactacctacaataacctcaactcctcaccttgccccaaaggcacacctactccaacaccctcccgtgcagcaccaaacccaacccctctacactactgcaccttacgcctttaacaaccaacctacgcccttacccacctacgctacaaccgaactaccgcatcatatcaaccgggcacctcaccaccgtctactgacactcctcttacaagcccccaattgctccgacaagcccacccccaatctcgccctgcagggctcaaactaagacttaacttctgacccggcaagacaaccatcctgagcacacacctacgcgccgagcctactgcgctacttcacctaacagaccctcaacatcttcagtttacttcaaacaccacctccttgaccctcacccacgaataagacccacttaaccccccatttacacatagatcaacttaatatcacctaattgcaaggccatttacactcactaaaccaaagccctcccactcttgcccttacgaaccacaaacagataccttacacacatccccctccactctggcactacctctccttcacacatcatgccacacataagacctatcgactacacaaacgcgaccaattcttcaactc

SEQ ID NO: 609171 - DNA, 281 bp, Homo sapiens
aaatctgccgtggaattaactaataagtagtaacaataaacttcatatttagaatgcaaagtctataaagaataattttacatgatcctcaatatcaactccagtttaaaaagtgttatttttaaacatttgaacccaggtctgttaatttccatcaggaggtgccaataccatccttggtctatggttggatttgcctatcatatatggagggggttgccctcccaggcacaacacttagcttgagatctcacgggtgctcccacgggcattgggcacat

SEQ ID NO: 609172 - DNA, 321 bp, Homo sapiens
tccaccggggggcaaacccctgactcggggacttgggatgttcctcttggtgtcatattccaactcagattgagccctacattgtgctgcccctggtcaaacgaagtttaatcagactttggttcccgcctcccccaagggtcatggtccttggaggacccgttgcagggtgaggtcaaaaaagttttgacctggatggcccataaacctgacgtcccagaatccatgcttttcatttgcaaaatgaaaatgtcaaaacttactttttagccctgttgaaagggttacttacaaaaaggaattttggtgaaactgcctcca

SEQ ID NO: 609173 - DNA, 338 bp, Homo sapiens
  misc_feature (312)..(312): n is a, c, g, or t
agaggactccgtacgtatgtagacaaactacgctaaatcatttcactaatcataattcatccggcggtaaaatctaaactttcttcccaacaaaaatttctcgggctaattcggaaaggcccggacgtactcggactacccgatgcatacaccaaatggaacatcctatcatctggagggctcattcatttctctaacagcagtaatattaataaattttcatgatttgagaagccttcggttcgaagcgaaaagtcctaatagtagaagaaccctccataaacctggagtgactatatggatgccccccancctaacacacattcgaagaacccgta

SEQ ID NO: 609174 - DNA, 1066 bp, Homo sapiens
ggcaaaggcacgggcggcgtggagtggcggcgcggagtggcgcagggcccgggagccagtgaagcgacgcggtggcgccctggacagcgacaggagatcatgctgccgctggtgggccgacacccgactcgcgcctggacactcgctggggcgccgaccatggcagggtgtgccaaaccagtgctcctgcacacctcgtctgtgctgccccctagagccatgcccatcccagccatgaccaagtgtccacagccagggagcagccaatcattcaagcaacacagggcgcacgtgttccaaaattgacccagacacaccaagcagaaactggatacccagcagggcaagcacgcactacactgatctcctattaactacgatgaccacccgcaatgtgtaccgagatcatacagacatcggaggcgcacaaggccatcatcaacagaacatgtcacacccaacatgagctataaccaaaacatatcccagaagtacgggcagatgggccgacaagtcgcgccaaacacagtctacagagccattggaggcttatgccatctgaacagaaatatctgcacacgagattgccgagaaagatccaggaagtgcaggcaagcaaccaaggctggccagggcagacatctcaagggatggcgagggagctacaaaacagatacacagaccatgggagacacgacacatccaaggcaaggatgcccaccgagaagcacctactcgacaggaagccacacgggcaccggaagaggaaacacggaccagcgacagagcgatgatgccccaggccacagagcgcgagcggataagaacactgcggacaggggacacagagaacacggacagagagaaacagaaacacagaactgaagagacagcacaacaaaggtggaagagcccatgcaaaggccaacgcgacggagccaatagaggacagagaaggacaggagaaaagcgaggaggaacaggaggagcagagagaccggacaaacgggccgcacgagaagccggacacgagacacaagcaaagaaagacagagaccagcgcaac

SEQ ID NO: 609175 - DNA, 552 bp, Homo sapiens
gctctaaggatccccattggatagcggagagggtcgaaataagatgtcttgaagcaagggaacaagacacaacataccagaatgtctggacgcattcaagcagtgtgtggagggaaatttatagcactaatggccacaagaggaaagcagggaagattccaaaatggacaccctaacatcacaattaaaagaactagaaaagccagagcaaacacattcaaaagctagcagaagggaagaaataactaaaatcagagcagaactgaaggaaatagagacacaaaaaacccttcaaaaaaattaatgaatccaggagctggtttttttggaaggatcaacaaaattgatagactggtagccagactaataaaaaagaaaagagagaagaggaaaatagacaccattaaaaaatgataaaagggatatcaccactgatcccacagaaatacaaactaccatcagagaatactataaacacctctatgcaaataaactagaaaatctcgaagaaatgggtaaattcctggacacatacaccccctggccccccca

SEQ ID NO: 609176 - DNA, 1067 bp, Homo sapiens
  misc_feature (4)..(4): n is a, c, g, or t
tctnccccctacagatgcaggaatgacaggccacagaccgagaggtacgaaaaaaaataagacagggtgttgttcaccgcctcattatatgatgccctctctttgggtgtcgattcttcctgaatagtgcttcacacgaagaaactcgggtcttcccccttagagtagttccccctcccccctggctcgctccggagacccgcgtgtgttccccctttcggttttttacttcccggagtatctccggggggccccacagcttctggtggggacaagtccaccgacctgacccttctagtgccacaactcttggggccttgtcctctgaccccccagggttgactcccccttgagctgggctcggttcctggcccccccgcggtgcaccttcaagccctctgggcacccaccatgatcggtcactgttagcgtcacacattgcctggggtcccgaccagaccagcctgaggtccagctgtcccgcatgactatgggcgcccgtttcagcccccagatggcttctcccggggaaggccctgcgcacgcagctggacctgccccggttccgaatctattcccacccttctgccctggagtccctggctctgatccccattacaggcccctctgaagaccctgctgccagattggggtgatagccccatagctccaatgagcggacctggcctggggtcccagatccccactacctgagggcatcaacatttgtgcatcgaggtggtgacgaaccctgcgggattcctcaccatcggggctgatctcccctttgcccaagggcttcgagaggtgatttgagaagaaccggcctgctgatgtcacgggcggtcccctgcccccacaccgtccacagcagctgtctgagccctccatcccccagctggcagctgtcattcaggagcccccacccctctcagcccctcttttcccacattcatagcctgtagtgccccctttaaccccccgtgcccccgagaagacgggatttgaagctgtaccccattttattccataaatccatctatccattcccgtccgtccacccccca

SEQ ID NO: 609177 - DNA, 137 bp, Homo sapiens
tctagaggatcccgggaggtgagtagaaaactcagggatgctttctggtatggacagcattgaaccctgggaacagtgatatttaaggatggggttttatacataggaggattctagggaggaagctaagcctagaa

SEQ ID NO: 609178 - DNA, 947 bp, Homo sapiens
  misc_feature (819)..(819): n is a, c, g, or t
agctgggttgctaggtacttgtccgtcatatacatcattgaaactagcgcgtgatcatgagtataagtattgactctcatattcaatgactcaagcccctctgtacatacaatcacatatgtcactatgcccttctcttgtatgtattgcctcatgtaggctataatttataacaaagatcctatcattgacatactgaacaatactacgagcatgaatacatcgcatctttggcaatcagtcttgcaaatcatagctgccatgagccactcagtcattaatccagccatatgctcctatccataacctcactgatacgcttcaccatgaagcagaatcgatgcttcaataatctgcctccactgactttatcatcacttcaattgagtcatctcctagtgttagactagaacatcctaaagtagactgaaacggcactcaacgaggcggactatcaataatcacatcttcctcaaagtgacactttcccaccacatcttaacttcctcaacataacatagctgtatttgcatgaactcttcctgagacgatgtgcatcgactttgaagcttcgtcacttaccgcactccgaattatctcacaccttcagtggtgaagtaaactcatcatgctggcatgaaataatccatggatttctcctttgaatcgatactatcacatcatcgctatttacaggaactcaaacattacctagatcagtaggacctaatactcacctctaacactgatttaccaaaaaggaggagatgtgggcatcggagtccaacggcaccagcaatgtatacgaaggataaaaanccctcagttcacatcgagaaaatagatccttcatgtttcattaccaccttatcccccctatggatcctatgcgtatcggcttaaaccccgatagtcatttaccgggtattttcctcctaagaccaaag

SEQ ID NO: 609179 - DNA, 182 bp, Homo sapiens
gcggccgcctactactactactactgctcgaattcaagcttctaacgatgtacggggacatgtgtgagcctcagtttcctcatctgtaaggggggcaatgatacctacctcacaggggtgttgcgaggattaaatgtgaggaggattgtgcctaaaattaaaaaaaaaagttgtgctgcacc

SEQ ID NO: 609180 - DNA, 770 bp, Homo sapiens
  misc_feature (518)..(518): n is a, c, g, or t
  misc_feature (521)..(522): n is a, c, g, or t
  misc_feature (563)..(563): n is a, c, g, or t
  misc_feature (569)..(569): n is a, c, g, or t
  misc_feature (601)..(601): n is a, c, g, or t
  misc_feature (660)..(660): n is a, c, g, or t
  misc_feature (714)..(714): n is a, c, g, or t
  misc_feature (763)..(763): n is a, c, g, or t
  misc_feature (769)..(769): n is a, c, g, or t
tcctttaaaacagtagcatcttaacttgtggcacaaaaggcaccaacattccctttccaaaccatccatcaccatgggtggaaggcagcgccacctgctggccatcatattatggctcacatacccataatttccttgcggtgctgaattccaagtggggattattagagacccctcagagccaaaaggggaccttagaggtcttctagatgagtcccctcatttgtaggtggtggtttctggataactcagagtggcagggacacagacgagcctgtggaaaggtatactgctttaagattgagaagaaaaccatttggcgctctaattttgcctggatggtgctctgtcagtcaaagaaagggaacaggctggggagggggtaagggcaccctgattcctgttccatcacttcccaggcagtagaaggctgtccaaggaacagtcccatccgcagctgggcatgtgttggtcttacacaagagacttaatttacttgaagaactaagagtaattgntanntttaaatacggggttcaaggggtgaaggactatcaaagaancccaantacagcataaaattatcccaaagtaaaggcantaatctcccaatggcctttctccctcatgccccacagagacttcgaaaaggcctaattngccagcacacaacctgcgtgttccctaagtactgtgccgtccaaggggtgacantgcctggcatggaagggacccaacccaactcccaacctttcaagacaancaaaanc

SEQ ID NO: 609181 - DNA, 1175 bp, Homo sapiens
  misc_feature (430)..(430): n is a, c, g, or t
  misc_feature (597)..(597): n is a, c, g, or t
gtgcccaccagccttgtcctaataaaattaagttgtatcatttaaaaaaaaaaaaaaaaaaaaaaaaaaaaatttaaaaaaaaaaaaaaaaaaaaaaaaaaaaaaacgaagaaaaaaaaaaaaaaaatataaaaaaaacaaaaaaaaaaaaaaaaaaacaactagtgccggcggccgcgcccgcacccagaagagaatatttcaaaacaaacatcgtgggggcggagcgcggcggcgcacagtagaagaagcaagcagggcactaccagtcgttccagaagaacgatcgtcgtccggccaacatacatcggacgggtgagcgatccacacccaacaaaagaagaaaacggcgcgcgggggagaaaacaacgcgattgatctatcggaaaaacaaccccacaagaaggaggttgcaagcaggggactactnctagagcggacactaataatcaacaagagagcagcgcacaacagccgacgcagaccaaagtaaaataaactatcagcccgccccccgcgcgggtggaataacacagaaaaagacagcagagaagaacagaacgagaagcagacaacaagcacacagcagacaacagnaacgagaggacgcagcagtcaagacagcatgacagcgagcggagagacacgaagagagaagagcaaagaacaacgcggagcgaagactaaagcgcggagccggaggaggacacggaggagaagaagcacggacgaggcgcgcagagaagagaagtgagcgagagaagaaaggcgaaaacaagagacgggggcgccaagcagcaaacgactaagagacgatgtatcacacaacggcaaggcgacaagagcagaagagatcagacgccgagacaaggacgcaagctgccaaaggaaaagaagacaagagagcgaaggcagaggacagagaccagagagcgaacagcagggagacaaaggcagtagaagcgagacgaggaggagacgaaagagacgaacaataaaacgacatagacgagaaaagcaagtaacgcaaacaagaagaaggaacaaggaaacacagagaacaaacaaggacagagagaacatagagaaaagaaagaaacaacagagagacagaaacagcacaaacagcacgaagacacaaacaaagagaaatagaagaacaacacaacgaaaag

SEQ ID NO: 609182 - DNA, 160 bp, Homo sapiens
  misc_feature (114)..(114): n is a, c, g, or t
tattgaggatgctaaggcgggtacagtgcagacgaatggcgtagtggtctggtacggttcttcctggttggtgatgaccgtgtcgacagatgaccacgtgccccccattggggngtccgccgaatggcggagaaggctggcctcggttggtccttgatgt

SEQ ID NO: 609183 - DNA, 334 bp, Homo sapiens
ttattttaattgggaggaacagggtaagggtgggggacccaggattccccctccccttcccaaataaaaaagaggggacaaaaggggtcgggggttttattttaaaaaatttttttccttttccaggaaaacgggctgttctttaaaaaaaggggattttaaaaaaaaaaaaagccaaaagggtttttaaaaaaaagcaacccccccccctgggtttggaaaaagtcagcttatttcgggttcaattgtttgatttttacaaaaaaaagtggaaaaagctgtatcaaggggggggttagctgggcctttccaaaaaaaatgtgagaagcttcca

SEQ ID NO: 609184 - DNA, 369 bp, Homo sapiens
gcctgcccgcccccccctggccccccggcccccccccttggggacaaggtccccccccctcatccttccccccacagttcgggtcccccagccccagtccctgtaacagactgccccaaaccccctgggtttcccccccccccggggggtttgggtccgttccatttgggttttttactttccaggggcagttccgcttcccccccctttggatggggttccctcccgggggtttccccccccgcccccgtcctggggccccccgcccccgccgttgtgaaacccccccccaagatttatgtttttttttttattttttttgataaaaatttttataaaatttttatggaataaatttttaagaaatga

SEQ ID NO: 609185 - DNA, 315 bp, Homo sapiens
tgccgtgtgactgtgtactcaactgataggacaaatttcagctgatcctcactattgtgggcaccatcgctggcgttgtcatactcagcatgataattgcattgattgtcacagcaagatcaaattacataacgaagcatattgaagaaaagaacttgattgacgaagacattcaaaatctaaaactgcggtcgcacaggcttcaccaatctatggagcataacggagcgtcttccctcaggtcaggattacggcctccaagagaccgcctagatgcaaatatccctattcccgacgacagtcggcactgcaccc

SEQ ID NO: 609186 - DNA, 99 bp, Homo sapiens
gtgagagaaggagtgggttgtgatagggaagcatcaaggaaagcttgtggaatgtcagtaaggtcatagtgcttgaacaatataatgataatacaagtg

SEQ ID NO: 609187 - DNA, 290 bp, Homo sapiens
  misc_feature (258)..(258): n is a, c, g, or t
agtcttccgtatagattgtcagagataagaaggaggtggtttggggataacaaataagcagtgtgtgctagttcaagacaaacaaagaggtagataaggatacgtgtcttttccctcaaaatagaatcctgccctaaagcaacgcaaggtagagcatacttcgtgtgcaaagccagagatagacgaagcagccttgccagcagtcactgagagatgaattaaagggcttataaagagaaaacttgagccttaacagangactacattgggatcatggcagataatacatt

SEQ ID NO: 609188 - DNA, 1305 bp, Homo sapiens
  misc_feature (316)..(316): n is a, c, g, or t
agcggatgtggcgcagtccggagggaggagcaaacgtgacgaatcatagtgtgggtatcgggagccgtccgccaggcgtcgagccgccaggcgccactccggctgccgtgccctcgcgaaatagtaccagcaagacctccagacgcgtatgcaggtgcacatataaaacgtccagcggccgactcgtaggcgcacggccgtccctgcatgttactgaccaggacaagcccatttggcgcctgaactgacagacagagtttcgagggccggggcgcgctggcatcttctcacgacttcctggccgtagctctgaatnggaactggtggttcacgagaccagtccagccgcaggtagtcgaatggaccgactcgtctggtgtcgcatcgagtttgggctccgtcaatgccaccagatgcctggtggttgaggcgtacgagcgacgagacgcacgggaaagagaggcacttctaattggtagagaatcgactttgtgtggcgaaccgcatagcccccaggcaacctcgaggttgggtagccagaacccaactcaataagccacgccgtgggcggcgagtggccactccctgggcctgacccagagtcgccaggcagagtaactcggaaacagagaccgtgggaagaaagcgcccacacatggtaaagcctgtgaggcaaggggaagacccgttcgctccctggcacaacaacacggcctcaatttacgcccatcggtcatcgttcattgcaaaggttgggtcccctcggcgcggaggaagggggcaagaggcgtcccagtgggggctcctgttggccccggggagccaaacgacacccgcaaggtgccacccttttctcgtgggtgggggccactttcctcccccgtgcggggttccctcaccttggaagtttgcgtcctccctttctggaggccctttcttcgatcggcggggtgacttccggtctctgggaagggggcggaccaaaaaggggtgggcgttgtagggggcaccaccgcgccattatcgcgcccccagaggaggtctcctctgtaccacggggggaggcgttcttctcggcctgccggtgtcgccccgcggctcgttgtgttgtggagtgccagtggccctttgtgctgggaccggaaattcgcaatttccatctccttgtggcccatttaaccattttgtgaaacacccgatcccgcgagtgtggccccgggcgtttgtcccgcgttcgcgcccccctatttgacctacccttggctccggttgtccccttcaccaaaaaggattttggcggccctt

SEQ ID NO: 609189 - DNA, 358 bp, Homo sapiens
cagcactcagaatattgcttgtcagcctcgctcatgcactgttctgcgtgacttgtccttgagatagtcggacttcttaccctaccgtgtgtccacctgctcggatgttacgttctgtcaaccagatttcttgagcgaactgttgagccagtcttactctggctcgtaggtccatgagacgagatgtctgagaacacaagatgctgtcttgttgtttaaaaatgacataatgtgcgatcccacgcaccgatgtctatttttcagcgtggagaatgagtctttgtacattcctcacttgaggtaagcagctcagttgggtatgaacgctgtggctctgacaggagagtggatacctagg

SEQ ID NO: 609190 - DNA, 164 bp, Homo sapiens
atgctgatgtgatctagaggatccctgtggagagggggttaggtgcaactctaggtcagggggaaatgagctgtgagaacagggctcccccgatcttgttggcccagagcatatgtgtggtgaagtgtctgtgcagtagggttgggattaaatgttctgttggg

SEQ ID NO: 609191 - DNA, 1151 bp, Homo sapiens
  misc_feature (207)..(207): n is a, c, g, or t
  misc_feature (222)..(222): n is a, c, g, or t
  misc_feature (399)..(399): n is a, c, g, or t
  misc_feature (535)..(535): n is a, c, g, or t
gtaggcgttgggcgaccatcgtccgttcgcttagctctacaagtccagatgggatctgaggatactcatattcatgattcgtcgatctctcggccatctgcttaatatccgcagctagctccaccaactagcagagccatcattcaatcgtagttgaaatgtcgcgcagtgtcatcagaattgacatatgcaaccgaataagataanacattatcggccaanggagaatcgcctgcttgaacgaagtgggaatgtggggctgcccccatatgcatatgcccgatagcgtatcatataggcatcatagcttcgacacgacatggttagacagatgagggcagctggtataaatcaacacatgtgtagacttaatcattctctcatgtggcgttcacctgngatgtacgagcccggacctcgcatatcctatggttggcacctatttgacctatgtatgtgccccaagggtctaacttgtatagtacgtatttatctcagatagccaacatctcgcacttatatcacaggggatacncactacattgagcgtcttgcctttcgagtcgacgacgatctcgtgacacattgctacgtacctgtcttagacattgtttcagtagatgggtcatcgccaagccatagcgagtaatccctctcaaattatgctcgggggaacgaactcccgtaagaaaggccattgacagcataccataggagctttggacagggccatggacggtcgttgcaccttgcgacttccaattcgttcatggaggcactcaaagcacatcactagtgtatttccccaacttgccaggccaatggcttacattgaggtccacccgaaaagcacgcagcatcgatccgtagcactccgaattgaggcgccaggaataccaagcgaactattccttctcttgtaacaagtaaaacaccatcgagcgattaattactacttcacaggccaatctgggatagctttttgacgataggaccccgtatcacaaaggatccgagactttggcgcgcgcaccacgggtgtttctcgcgtaagtctaaagtagacctagcgtggcgggcggacacacctggggcagtccgcgtctgttacgaccacgttggggctgtggcattcccgttcctgtataaac

SEQ ID NO: 609192 - DNA, 865 bp, Homo sapiens
  misc_feature (19)..(19): n is a, c, g, or t
  misc_feature (109)..(109): n is a, c, g, or t
  misc_feature (114)..(114): n is a, c, g, or t
  misc_feature (118)..(118): n is a, c, g, or t
  misc_feature (122)..(122): n is a, c, g, or t
  misc_feature (124)..(124): n is a, c, g, or t
  misc_feature (130)..(131): n is a, c, g, or t
  misc_feature (139)..(139): n is a, c, g, or t
  misc_feature (153)..(153): n is a, c, g, or t
  misc_feature (157)..(157): n is a, c, g, or t
  misc_feature (171)..(172): n is a, c, g, or t
  misc_feature (175)..(176): n is a, c, g, or t
aggcgagctcgccgcgttntcagtgtggcagcaaccgcagccgagcccgagcgggtgcggcgccatggcgtcgcggggctgctcaccgtgtcctgctccggccgcccgngcccnagcncagncncagacnncgcggcanccccagctcgcgcncganccggggcccgcggnncanncgctcttccaggacgttttccgcagagcagacaagaatgatgatgggaagctctcatttgaggaattccagaattactttgccgatggggttctcagcctgggggagctgcggaactgttcagcggcattgatgggcatctcaccgacaatttagaaacagaagaaactgtgtgactacttctcagagcacctgggatgtctaccggcctgggtgctggctgccattggaatcgctgaaccgtgcagctgctcgctgccatggatgccaccaagctggagtacgagagggcctccaaagtggaccagtttgtgacacgctatcctgctgcagggaggacggtgagccagctgcaatgccacttcaggagctcgcctggagcggggcgtcaagataccctggatggcccaggcccattggctgcgcggtcagatgcagagagcgtggagcgcgcacacgcaggctctgtggacagccggatgggcaggagtgccagaagaccctttgaggacgtgtcatgcactggttcattccacccgtgagtacccactgagatctaccttgacacaagcggctgcactatcacagtgccgcaagatcgagttgagcgcctaccaaggacgacacctggcatacgaggaggtcatccaacccagctcaaagtgaacgggccacccgagctgacacccg

SEQ ID NO: 609193 - DNA, 385 bp, Homo sapiens
ccaccacgccgaaagctcattcagtacacgcttcagaaccgttttctcacacacagtggcaaagagagtgaggttgccatccagggaagccatgagaggccggagtacactatctgcatactgagccgctgaggccctggcgtctggagatgcattccctgtgccccgaacctggcccaggatgtcggccatttgtcgaacacactcatcaatccgtacctggaaactgttttcaaacaccatgctgagctcatccagaaccgtattcagtttcacctgcagctccttcagactgtctgcagcttcaaggtccagctccttgcctcccatggcctcaaacattttctccggctggaccctcagttgctgcaacgttgtcatcaag

SEQ ID NO: 609194 - DNA, 154 bp, Homo sapiens
acaggcacactacacctatccctactagttattatcgaacatcagctactattcaaccatagccctggcgtacgctaaccctaacattcttcaggcaactactatgcacctattgagggccaccttgcaatttaaccattaccttccatattaa

SEQ ID NO: 609195 - DNA, 1089 bp, Homo sapiens
cgcgtccgcggacgcgtgggcagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgcgaactgtttagagagtttgcaaaataaatgcatttgacactcctgattcaccgctaatgagaggcaaggagtttagtgaccctatacataataataccttttgaccatatatggagaaccaaggaaccataatgaagctggttggtttgctcctaaattcagtggacaagtggtgacccgacaatgatgggccgggcgcgggggctcacgcctgtaatcccagcacttggggaggccggagggggcggatcacgaggtcagggaatcgagaacctcctggctaaccgggaaacctgtttttaataaattccaaaattagccgggcgaggtgggcgggcctggtgtcccataaacccgaaaggtagccgcggagagggtgaacccaagggggagagcccagcgaaccgacatgggcacgcgcacaccgcgggaaaggaacagcatcccaaaaaacacaaacacggcggggccgccaaaatcacaggggccattgtcacactctagtaagagcgccatcagcgatacaagaacgccgccacaacaccgacgacaacaagtgagaaaccacgggtcgccaccccgacgagacaagaaccgtcgactgaaaacaccaatagtcgagtcccccaccagcaccc

SEQ ID NO: 609196 - DNA, 216 bp, Homo sapiens
tcagccagtgtcataaacacccgacgtcatgtatttgagcatatcagtaaccccctctaaatttaataccagagtaccttatcgttgacaatattgatatgggaaaacatttgcgtgccattacagacggtattaaaagctaaagtttcacatactagtattgagctaacatcaatatacacaattaggcgtactgtggtatagaattctgagtgg

SEQ ID NO: 609197 - DNA, 834 bp, Homo sapiens
ggcagacactgaccttcagcgcctcggttccagcgccatggcgccctccaggaagttcttcgttgggggaaactggaaaatgaacgggcggaagcagagtctgggggagctcatcggcactctgaaggcgtcaaggtgccggccgacaccgaggtggtttgtgcttcctccctactgcctatatcgacttcggacccggctatgcaagtcgtagactcccaaggatagctgtggctgccgcaaaactgctaaaaagtgactaatggggcttgtactggggagatcagccctgggatgatcacagactgcggatccaacgtgggtggtcctggggcactcacagcacgaaggcatgtcttatggggatgtcagtattgatgctgattgggcatgaaagtgcgcccatgctctggtacagggactcggagtaatcgcctgcattggggaacaagctatatgtaatagggaaactgtcgatcacgtgagaaggtggtttgcagagcacgacgaaaggtcgtcgcagatagcgtgatcggactggagcagctgtcgtacctggcctattgaggcctgtgtgtggcccattggtacttgtccagtactgctaacacggcaacaggctcaggaagtacacgaaaagcttcgaggatggctgaagtccagcgtctctgaagtcaggggctcagagcacccgtttcatttgttgcagggctgggactgggccaccgcaagaaactggcaccccgccgatgtgaccggctactgaggggggaggggccctcaaacgcaagtcggacactataagccacaatgagcatcctttcttcctcggga

SEQ ID NO: 609198 - DNA, 627 bp, Homo sapiens
tagaagagctacgagctgcgtgacggccagtgtcaatcaccatgggcacctgagcggttccgctgccctgaagcactcttccagccttccttcctgggcatggagtcctgtggcatccactgaaactaccttcaactccatcatgaagtgtgacgtggacatccggcaaagaccgtgtacgccaacacagtgctgtctggcggcaccaaccaatgtacccgtggcattggccgaccaggatgcaacgaaggagatcacttgccctggtgaacccaggaacaatgaaggatcaagatcatttgctcctcctgagcgcaagtactccgttgtgacatcgggggctcattcctgggcctccgtgtccatctttccagcaagattgtgggatccagcaagcaggagtaatgaacgacgatcacggcccttcctatgtgttccaaactcgcaaaaattgctttacttaagggcgggattaatggaactttaagttgggccgttaaacacccactattcctgtgaccaataacctttaaatttgggcgtcaaggagacaaacaaaggatgggagaatttgggcatgggcattttgaattatgggtaacaatatgggtagggggtaaagggagc

SEQ ID NO: 609199 - DNA, 259 bp, Homo sapiens
ccccgcggcttggcccgtatttggggtgtcttctgggccctacaggatgcgatccgcttccttcagagcggtctgtgtggtcccctcgagaagttgctcgatttattcttgcagttgatctggagcgcaattcaccatggaagcttccagatgctgctttgtctggagctgcagtctaatcctgcctcctgttcaccatgattccctccgtcctcccatccttctgttttatttattgcatagcacttccagctctctg

SEQ ID NO: 609200 - DNA, 453 bp, Homo sapiens
  misc_feature (1)..(1): n is a, c, g, or t
  misc_feature (185)..(185): n is a, c, g, or t
  misc_feature (309)..(309): n is a, c, g, or t
nggccatgtggaaatggtcagttaatatttcaggcaattaaaaaaaacctaaattatatggggttttttgaaaaaggctactttacattttatgacttttcatcctcaactctgaaatcacttcatgtgacttctttacagacctttcactgtggtctcttgaatcagtgggatgctgggcgcgngtgtcccgcctgtggtctcagtgcttttgggaggctgaggcgggcggatcacgaggttgggggatcgggaccatcctggctagcgtggtggaaccccgtctctgctgaaaatacggagggttgnccgggcgtggtgcggacgcctgtggtcccggctactcgggaggctggggcaggacaatggtgtgggcctggggggtggagcctatcagtggctatcgcgccactgcactccagcctgggggacggagtgagactctgtctcaaa

SEQ ID NO: 609201 - DNA, 169 bp, Homo sapiens
  misc_feature (47)..(47): n is a, c, g, or t
  misc_feature (57)..(57): n is a, c, g, or t
  misc_feature (66)..(66): n is a, c, g, or t
  misc_feature (164)..(164): n is a, c, g, or t
tgaatatctagcggtatatatcttccagctggagattagctaaactngctggtgtanaaccgcaancagctagtgaacatctttcaaaattagtagaagctaatttaatttcagtaaatacatggggacgacatcgttattataaaattgataatgataaagtngttga

SEQ ID NO: 609202 - DNA, 1453 bp, Homo sapiens
gagcagaagaaggacggacccctggagcacacgccagcaagttttatgcgataggggagcatctacagtatctggttccaatcgtcacacagagcactaactaaacaggagcgaacacatgatgatgacgatgactggaagcccctgcaaagcacgccaggggtgtgcctcactgcttctggcgcagcctgactgctgaatgcatgacgattgtgcccaacatgtactccccgttctattgaagtgagacacagtcacgaagccagatgtggcggtaccggtgatgcgagcagtgatggtcttgtggcttggtatctttgggacaggatccacgcaggccgcagtcgagcctgcaaaaaccaacgtgatgattcatcaatcaggtgcgtgaatgcacgcgatcccgtatacttagtagatcttaatggtacatacgtagcaccccagtgataagtaagtctccgaggcatcacaggctggccatgggaactcgtacgggcaagaacttaagtggaggctcggcgttccttgcagagcttgcaccattcacagtggatcgtgctagcttttgtgactcccctcttgctgacgagtcggtcgtagaatttcgcaggggtacttctagttggcttgacacgcgcagtaggctcggctgttcaaacaattgtcgtggctcgggggttgtatacttcgcaaggttctcgaggctgagagccttcgcgtatacttgacaacggcgttgactcagtaaccggtttggcttgcagtgaagttccaccgggagacgtacaaacccatgtccttagtttttaccctggggtttaattccttgtcgttgtacgaggttgtcagaaaccttgcggagtaagcatctcaaggcaaaggctttgcccgtacagaagcaccgtcacaagtaccccacgagcccttggagttgggcaccaaccgcaagtaaacccaaccggctggacgggcacggtttccttcgccacattaatttgaagattcgttcattgaagtgggcaaagaactttgcgtggcacaccatccagtctagggttgccacgacacgggaatttggttgacatccctgagctcgattcacacggaaagagaccgcaccctaagtggggtcgcatcccaattggggcaaacagcacattggacacaccaagcggtggtcctttcgacgacatggcgcagggtccaaccagtcaattaccagcgaaggtcagaaattcgcggaactaggaaagtccccggtttccacatgcgacccgttcaactccatatgtatcttacgttgttgccaaacttcctgtccacacacattgtgtactttccgtgcacaaggtggccacaacgctccaaaagtattgcgcttttggcaggacatctcttggacgtttgggttgtatggggcctccccctgtgtttaaaccgaattggtaca

SEQ ID NO: 609203 - DNA, 453 bp, Homo sapiens
agtatattagaaaaacaaagaaaaataagccttatccctttacaagtgaaacaacacaatatgcatatacaatattatatatacatatatttcaaaatgtattcacaaaagacagattatagatacaaatattagaataccaccacacaagctcaagactcaaggaattgacagatctctgtaaggtgtttcaatataaataatgtaatacctattacaaagtttccaaggtaactactttccagaagtaatgaacagaggctattctttcactagcaacataggaacacttaggcttataatcaagtacagctgtacaaacgtaagttttgtctacaatgtagagtttgttcgattaatagcaaatgctccaatatatgccataattctacattttatgtacacagtacatacacagcgtattattgtactgatggtttacacagtccaatt

SEQ ID NO: 609204 - DNA, 117 bp, Homo sapiens
gtagaagttataaacacacacttgtggtgccaaataataatcttatttactgctgcagtcagaaggacatgtttttcacctgtgacttcctcccttgtacgctggattgtaattgtc

SEQ ID NO: 609205 - DNA, 104 bp, Homo sapiens
agcggcagtgcagaggttgatctcaggccactctgtttcaggcacagactccgttgctgtggctagcatctaggttagctctgcagaatcacctaaccaccagc

SEQ ID NO: 609206 - DNA, 529 bp, Homo sapiens
  misc_feature (6)..(6): n is a, c, g, or t
  misc_feature (13)..(13): n is a, c, g, or t
  misc_feature (262)..(263): n is a, c, g, or t
  misc_feature (281)..(281): n is a, c, g, or t
  misc_feature (284)..(284): n is a, c, g, or t
  misc_feature (335)..(336): n is a, c, g, or t
  misc_feature (357)..(357): n is a, c, g, or t
  misc_feature (362)..(362): n is a, c, g, or t
  misc_feature (364)..(364): n is a, c, g, or t
  misc_feature (383)..(383): n is a, c, g, or t
  misc_feature (396)..(396): n is a, c, g, or t
gatgantgaaccngttcaactaacttttgcactgaggtccctgaacttctttacaaaagccactccactctcttcaacggtgacactcagtatgtctgcagatgtaccccttgttgtagagtataaaattgcggatatgggacacttaaaatactacttggctccccaagatcgaggatgaagaaggatcttaggcattcttaaaattcaagaaaataaaactaagctctttgagaactgcttctaagatgccagcatatgnnccacgcggacacacgccnccntctgtacctctaagtacatatgtagatattgttttctgtaaataacctatnnttttctctattctctgcaatntgttnanagaataaagtccaaagtcngatctggtctagntaacctaaagtatttgtctcttaaaatacttgtgatttttataatacaaaagggtcttgactctaaatgcagttttaagaattgtttttgaatttaaataaagttacttgaatttcaaaacaaaaaaaacaac

SEQ ID NO: 609207 - DNA, 278 bp, Homo sapiens
  misc_feature (84)..(85): n is a, c, g, or t
  misc_feature (106)..(106): n is a, c, g, or t
  misc_feature (111)..(111): n is a, c, g, or t
  misc_feature (113)..(113): n is a, c, g, or t
  misc_feature (132)..(132): n is a, c, g, or t
  misc_feature (145)..(145): n is a, c, g, or t
ataggttatttacagaaaacaatatctacatatgtgcttggatcgtacgtttttccatgtagtccgctagtggtaccacctatnnttttctctattctctgcaatntgttnanagaataaagtccaaagtcngatctggtctagntaacctaaagtatttgtctcttaaaatacttgtgatttttataatacaaaagggtcttgactctaaatgcagttttaagaattgtttttgaatttaaataaagttacttgaatttcaaaacaaaaaaaacaac

SEQ ID NO: 609208 - DNA, 229 bp, Homo sapiens
  misc_feature (15)..(15): n is a, c, g, or t
  misc_feature (52)..(52): n is a, c, g, or t
  misc_feature (60)..(60): n is a, c, g, or t
  misc_feature (66)..(66): n is a, c, g, or t
  misc_feature (84)..(84): n is a, c, g, or t
  misc_feature (100)..(100): n is a, c, g, or t
  misc_feature (154)..(157): n is a, c, g, or t
  misc_feature (176)..(176): n is a, c, g, or t
  misc_feature (205)..(205): n is a, c, g, or t
  misc_feature (207)..(207): n is a, c, g, or t
  misc_feature (211)..(211): n is a, c, g, or t
gttttaatgtatctnttccacttattatagttatattcctacaatacaattntaaaattntctttntatattatatttatgctnctgtgtcatgattttntcaagctgttatattagttgtaaccagtagtattcacattaaatcttgcttttnnnnccctttaaaaaagaaaaanttaccaaacataaacttggctagaccttntnttgnggatttacaagacctttg

SEQ ID NO: 609209 - DNA, 288 bp, Homo sapiens
ggcgaggtgtaccagtgcttcggggcatacttgtacagcctgtcgcagatccgttgccagctcctcaaccctatggtagcatgcacgatgacagttggaaagctggctgttactgaccagcaaagacaagaatgcagaagtccacggatacatggatacccttcaccaggctaaaaaacaacttttatatgcagacggttcagataagactcttgggatttctaaaatcccagccctctctgtcttagttagcacaaaccgatagagatcatcaaacagcactttaat

SEQ ID NO: 609210 - DNA, 221 bp, Homo sapiens
gacttacctaccacagaaggactaagcaaaaggaaaaactctggaggcatcacataatctgatttcaaactatatataataggccaaagtcaccaaccagcatgatcctggcataaaaatacgaatataccccactggaatagaatagacaacccagaaataaacccaattacttaacagccaattgatctcagacaaagggaaacaccggggatcctcta

SEQ ID NO: 609211 - DNA, 854 bp, Homo sapiens
gtttctttaagaatgttgaatattggcccccactctgggggctgtagagtttctgctgagagatcagctgttattctgatgggcttccctttgtgagtaacctgacctttctctctggctgcccttaacattttttcgttcatttcaaccttggtgaatctgacaattatgtgtctgggggttgctcttctcaaggagtatctttgtggcgttctctgtatttcctgaatttgaatgctggcctgccttgctaggttggggaagttctcctgggggataatatcctgaagagtgttttccaacttggttccattctctctgtcactttcagatacaacaatcaaacatagatttggtcttttcacatagtcccatatttcttggaggccttgttcgtttctttttactcttttttctctgaacttctcttcttgcttcatttcattcatttgatcttcagttactgataccctttcttccacttgatcgaatcggctactgaagcttgtgcatgcgtcacgtagttcttatgccatggttttcagctccatcaggtcgtttaaggtcttctctgtgctgtttattctagttagccatttgtctaatcttttttcaaggttttagcttcttggcgatgggttcgaacatcctcctttagctcggagaagttggttattaccgatcttctgaagcctacttctgtcaactcgtcaagtcattcagaggaaggagtttggaggaaggagagactagggagggttcgttgtgtagagaaggatgttggcaggcgcgtggctcacgctatatccagcactttggagcagtgcaggcgatcatgaggtagagattgagac

SEQ ID NO: 609212 - DNA, 116 bp, Homo sapiens
gctggaggcctgggctcgagatgaacccggggtatgaagtagctccgaggtctgatagtgaagaaagtggctcagaagaagaggaagaggaggaggaggaggagtagccagccagg

SEQ ID NO: 609213 - DNA, 144 bp, Homo sapiens
cctgactttgctcctccggtattctatgagcatccaaggctctgatgggaaggatgaaggagtgcgtgccgtgctacgaacgctaccaacgagataccagctgatatgactgtagcccagtacatacctgggacaagatcgacg

SEQ ID NO: 609214 - DNA, 815 bp, Homo sapiens
ggcccaaggaaacatcagcagcacacacaggcggctgcagctggttggtcaacaagctggtggctggtgccaagggccttacagctccttgtagcgctggtggcttctgtgcgagtccctgggcgcgcgttctgctccgccgcggggtgcccggctcccgtggcgcaggacacctcgggcggacggacgacgggctggcacggccgtgacgggagacggacgcgcgagacgccttcgaggagcccagagggatgcttggatggagcccgagaacgcacgtagcagcaagcgggtcgccatgtgatgaaattcaagaaacacacacagtgaaacaagccatgagcacttggacaagtacgtggcacggacgcatgggtcattcaagcgccttggaagtaaagcctaggacaggacattgacgcacggaagccattaccagacggaagtggtcaatatacatggaacacatcgtgacacctgaaccacggggatgatcattagcatcactagacctggaccttggacgccgatgaaccaggacaaactagtgtggatgagaaagcgaaagccccacacgaagcacataacataagcgacgcctgggagactaacctggaaaaaagagcagaaaagtaacacagagggaagcgcgggtggagaacttgacagggcgaaggaaaaaccagggatacgcaagacaccgttgaacacgcatagggagaaataccggaagccaatcacaaacggcacagcacttgaacacccggacatgcgaaatacgagagcacaggaatgaaaccccgtgaaaccctagg

SEQ ID NO: 609215 - DNA, 144 bp, Homo sapiens
tacaggagctctgtgtgccccagaaccggaaggatacttaagctggttcaccagcctggactgaagaattgaacctgggaggtcgctggacccacggagcagctccagatgagcatggtcccgaggttactgacctgtggtgca

SEQ ID NO: 609216 - DNA, 1064 bp, Homo sapiens
aaaagtaggctaaggtacgaggccgggttaatcggcagaggttcttactcattctaatggggttgggatcccaatatggtctggtcaatctgcatcttgtgtgtcccaagaccctatctcctccccaacattcttatgccttggtcccagtaaggaacgaatgggggccagggaggagaacaggggggatcaagaagggaaacccaattcccccttgaaagtgggttcttgaactatgtgttgggggaagttcctctggatactaattgaatttatatacctcatgtttgggggttgacgtatatatatatatatatatatatgtgtatatatattacattatatggggcagggtgtgggcgctagaaatgtggaagcgagagactctttcaaatgtggtaatagatgggaagtgggggccactcttaatagagcgagccatataggtgcgtggtgagaggcgagagaattggacaggggggtgggatacgtcgataacagtcgtgtcgtgtggaggcgaccaccatcgtgtcgtgtcacccagcgtggtgtgtatgtggcggggtggtgagtctgtgctctcttctccatggggccccgggggtgtgtagcctcatgcctcccgccgagggggcgctctgcgtgaaggaaggaagcgctcgggccatctgtgtggcgcgtgtgtccgccgtggcgggagggacggccaggtatctcaccaagcagaccaagagagtggtcccagggtttgcgagcaccagggggcatttccgggccaagtggtaaggaaggacaccggaaatatgcgggagagacctccgggggggtaaatagcacaccagtgcctggggggcacccgggccggatcatggggagagcgcagggccgcactgcttcgaagggggaacaatgggggttttgcgcagagaggggaaatgcggggcgcatggagaaccaacggggcggggggggacaaacacgccaacgggaggggaggccccacggcaaaggggggggggccacaagaacgcgcgccgagggacacctcgtggtgggtgcgcgag

SEQ ID NO: 609217 - DNA, 146 bp, Homo sapiens
ttaatgaagctcacctagacaactagggaactaaaactgcatgcatattgggtaatgcagttggttagctagtctccccatcctcccaactcactataccaggaggggctgaaaacagaagtggctcccctgaaagtcacagttag

SEQ ID NO: 609218 - DNA, 573 bp, Homo sapiens
  misc_feature (193)..(193): n is a, c, g, or t
  misc_feature (235)..(235): n is a, c, g, or t
  misc_feature (243)..(243): n is a, c, g, or t
tctaacggatcttatcggcatggggtaagatgcacgacatatataaccagccgtttcacaatgagtgactcaatggcctggagcgcccagtcgtgcttcgtgaatctttctacatcttcacaacctgtgcacctcttctggtttcagaatggttcatcgcttcagaagcaaaccccgtacccctcacacagangccccattcccctcggccccaggcaacggtcaccgtcacccncaaacccngtacccctcacacagacgccccattccccttgtcacacaggccctagccactgctcacccgctttctgcctctggatttgccacttctggacagttcacacacatgcggtcacataacatggggtcttttgtgacttgcttcttcatttagcacgatatcaaggcttgtctatgtggatgtctgtgtcagcttcctccttttccgtggctgagtaatacgtggccaggccacatgctgtttcttcatagacagctgagggtcatctgcgccatctccacctctggccgttgtaaataagtacttctctgaaaattcatctacaaacatca

SEQ ID NO: 609219 - DNA, 378 bp, Homo sapiens
  misc_feature (168)..(169): n is a, c, g, or t
tggatgtagtgaggacgtattagtagaatgagtattggttaaaccacctggattcatttgtaaaatggggcacctgtctcttaaattgtaatgaggatttgattagataatctagataaatcacttagcacaagagtctccagcccccgggactctttgactggtacnntggtctgtgtgcctgttatggcacttgggctgcacatgcagtgaggtgagcatgggagcaatgctatgcactagtggcccaaaactcctgccttcctgcctggatcatgtggcagcattatgatactcatatggagcacatgaccctgtttgtgaacttgtgctgtgtgagtggatctagtgtttctgtgctcgcttacaaagaaatct

SEQ ID NO: 609220 - DNA, 317 bp, Homo sapiens
ctctaagggggcgtgtgatatagagaggggaggtcacggttatgtggacttgtgtgggacctgtggtactcttatcccttgtgccaaggagaggttttccgtgtggggtctgagggtgtgagggggcacttagcagtgaaccttaagtctgggtacatgtaaccctgctgaggggctgtgcaggccgctcctacggtcctttgtggctgaggcagggcgggaggcatgcaagccagtgggggaaaacccctcttaagctgggcagccctctaccttggccccgggagccgtgctccttggaacgcaaagggccgagg

SEQ ID NO: 609221 - DNA, 481 bp, Homo sapiens
ctgatgacaccgccaaggtgaatgcggcgatcaccacggtgtctccccagatcgggttcaccttcatcgagcacggcaaggatgccaacggcgttgtctcctggaccggccagtcatccaccgatccctcgctgttcgccaacgtcgtgatcctgcccgccaccaagatgcagcaacagaccatttcggtcgcggtgcactccaccggtcacatcaaggcgaccgacgagaatgcgttcatcgccacggtccatgcccagtaccatgccgccaaggcgtccccgtcgcccaccgatacgtgatcagcggctgagcatcgactggatgccggcgatccactacgggatgccccagaggtcggtgtgaccgggatacaggatgatgaacccggcgatcagcacgccgccaaccccgatgccgtaccacagtgaccggatgaccctgatctgacgatcgctgagatgagtggagctgtcgatct

SEQ ID NO: 609222 - DNA, 101 bp, Homo sapiens
agggtgtaatgagtacggtgggagaactgatgtggacagaatgagggagaagggtggcccgggaggcatatgacatacgatatgacaaggcatgcatgcac

SEQ ID NO: 609223 - DNA, 414 bp, Homo sapiens
gagcacatgctgttggaaaaaaatggcactgatagacttccttgatacagggttgtcacaaaccttcaatttgtaaaaaactcaatacctacaaagagcaataaagcgaagtacaataaagtgtgcctgtaatatgaatgtacaaaatatagtagtttttgagatcttttttgggtattttattattcattttaacttattataaaatattttgaacataagaagtagagaaaatagtttaccaaatcctcatttatttatcacccccctccaggccttatttttaaaaatttggtaatagaacatatacaaattttttgcatttatgggggattttggcataattttgggaacaatttttgcaaggggggaatgatcaaaacccgggggttttagggaaagcccccaacccca

SEQ ID NO: 609224 - DNA, 249 bp, Homo sapiens
tcagcagcagttctactagatctgtggagatgcataatatgtaatacctatattgatagtaacaaaggaactgtagatagtgtgcaggctagatgtgctctggataaggctaccgtgactcctgagtctgtctaaaggtgcaaagcgtaacgatagtgtgtgaggctctgaagctagggcagcgcatcctgcagtgtaactgcctcctactgtctaaaggagaaccagggctactcctacaggggctac

SEQ ID NO: 609225 - DNA, 1038 bp, Homo sapiens
ctcgttttcttgcgctgtcttgttttgcgcttctactctgtagctctttgggtactctccgttctgtctgcctacttctcgtctgtctgacttgttgtcttctcatgtccttgcgtgctgtcccttttgtttgtagttttgttgagctctgttgttttgttatatcctctgcatatcacgtggtcacatatcagtggctcctgatagtggttggcttcttgcctattgtaatcaatccctttggttaattttcccccttctcccaacctttgttcgtgcgcactgttcgcgttcttaccgatcgtttcgcccgggcgtggtattgtcccctttttgtttgtcgcccctctgaaatgccccttccctttgttctgcgccaccctcctcttggggcgctccttgtgtccaccccattgagtgttttctttgtggggtgtccccgctttttgggggccccgtcccaatcccgtactgtcaaggtctcgccatgtgcttcatcccggcgctgttcgcctttttttgatatggatattctaggttttttctcagatgggggcgtttgtctaatagaggtgaatgagggagtcatcttcgttcctatactttgctcgggtgtgtgttggaaggacataggatttttggggggggaatcttcctgccgcctcccccactcccagtgtttatattttgatacccaacatgaattttcagttccctccctcccagcccccccatttcctgcgggcgggtaccaaggaccccttcaaagtccctggagttgggagggaggaatgggggacataaagcctgtcctgtctctattctaggccagagagagtgggttccaaagaatcctgggctcacctcgttagcgctggccccgccccggccttgggaccttggggttggtgatttgggggacaatgctacaatcgtctcccctgtttgttttacttcccccaaatggaccctttttttttttaaagagtccccgagaatggggaattgttccctgtaaatatatatttttccaagtga

SEQ ID NO: 609226 - DNA, 105 bp, Homo sapiens
accaggtaggcagccgcggtcatcgtagttaaagagcattgggcagcagtcatggccagcagtggccagttgcaaagttataagaggagggtttcttagcgatag

SEQ ID NO: 609227 - DNA, 172 bp, Homo sapiens
gggcatcatgagtcaccagatgaaggattcctttagtgcccacaaagatctttctcactttgcacaacttgtacttggccttatcgaggataagccaacagatgtgtaggtaacaaacttgtaaggcacttcaatctccagtctccgcctggcctccttgtacctggtgacc

SEQ ID NO: 609228 - DNA, 133 bp, Homo sapiens
gtaactcgtgtcagtcacaacacacaaatatgacatttatgttgggtgagaataacctaattaaatattgtctaccttctcatgtagccaagctattcaccacagacagaaaaccaatctcctaatgcccggg

SEQ ID NO: 609229 - DNA, 261 bp, Homo sapiens
cacctctgtcctctaagcagtcattctgctttgaatgagatcaagttgcaggtaaactgtagtgccggcattaggcgggtagaagctgagcatgactatcagttcgttctggtcagcaagggtagctaatgcatatcttgctaccttgtggctaattcagaataggagaaaacaggctctgggcagaacgcagcctacgcctacgtacacaaagccctcattttgtacacataccaacatttttctgatgtaacctcatca

SEQ ID NO: 609230 - DNA, 253 bp, Homo sapiens
tgagacagaatcttgctctgtcgcccaggctagagcgaaactccatctcaacaacaacaaaaaaaaaaggaagaagaagttatttaggcgggcattggtggcgggcacctgtgttaattcccagcttacttcgagaaggctgaggcaggagaatgtgttcccaagccaaggggacaaagagaccagacgggacattttgggaagttgaggtggaattctagccatgtgcctctcctgattttttagggtgcct

SEQ ID NO: 609231 - DNA, 118 bp, Homo sapiens
atatatgagcttcaatcactagactcatctttatataatcttcaccctgaaaaataaaagttaccaatgtaagcaatgttttatacgagtcaataaaagtttagattaatactgtttt

SEQ ID NO: 609232 - DNA, 1280 bp, Homo sapiens
  misc_feature (384)..(384): n is a, c, g, or t
  misc_feature (461)..(461): n is a, c, g, or t
  misc_feature (485)..(485): n is a, c, g, or t
  misc_feature (544)..(544): n is a, c, g, or t
  misc_feature (754)..(754): n is a, c, g, or t
catggtagttcatgtctgtaatcccagcactttgggaggctgaggcaggcagatcgcttgagcccaggagtttgacactaggctgggcaacatagggagaccccatctctacaattttgcgaggccaagatgggcagactgcttgagcccaagagttcaagaacagcccgggcaacatagcgaaatttcctctccacaaaaaatacaaaaattagccgggcgtggtggtgcaggcctgtggtcccagctacttgggaggctgggcaggaggattgcttgagcccaggaagtcgaggcttctgagctgtgatcacgccactgtactccagcatgggtgacagagcaagaccctgtctcccctcccccagcatatacacacataanattagcctagcatggtggcacgtgcctgtagtcccagctactcatgaggctgagacaggaggatcgcttgagcctgngaggtccagactgcaatagctgtngatgtaccaccacacttcagcctaagtgacagagtgagaacttgtctcaatcattcaantaaaataaaatgaaataaaatgcagagtacagccagcacttcgtatccatgatgtagaccttgagatccaagaggcaactgtaaactcttcaaaatccactgaagaggaaggcttttgacacccactctaattcaaagtcctaactcttaaggaggagttgaaaaaatgctagggcttacacaaggtactactcattattgcaaatggancctttaatcctaaaagaaatgcaaaaaactggagcagtcccccaggagttatcacagccttgaccttatctggcccacgtttaatcaggaccacacaaagctgggcacgtggctaacacctggactcctggcctttggagaaccaggcacgcaattcctcggggtgggagtcggacacactctcccacatgggaaaactctttccactaaaataccaatttcgcgccctacgggtgtcgccttgatccacgactcagaaggcttggggagagtatttgtgccaccgataaaagaggttttgccacaatcgatatatgattccgcacacgccacaggtgaacctttttatataaacacacacatttctgggttaatataggctcaataatgggccaacatctgtgtgacaccactggcgcgcaaaaagcgggttctttttttttatctgtgtcacaaaacatgcgacactatgcggtatggagacgcgtttctactcccacgagatatcttctcctccccccaggtc

SEQ ID NO: 609233 - DNA, 131 bp, Homo sapiens
ccacttcttcgaccccgccggaggaggagacccattctataccagcacctattctgatttttcggtcacctgaagtttatattcttatcctaccagtgcttcggaatcatctcccatcttgtaacttacta

SEQ ID NO: 609234 - DNA, 182 bp, Homo sapiens
gatcagcgatacaccgagcacgctggacaccaccattgtcgccgaccactggcgcaggaacagcgccatgaccccgatcaccagggccactgcgatcatcagggtcagttccacttcgtgcagcgaggcgcggatggtctgggtgcggtcctgcagcaccgacacctcgaccgaggccggca

SEQ ID NO: 609235 - DNA, 877 bp, Homo sapiens
  misc_feature (4)..(4): n is a, c, g, or t
  misc_feature (6)..(6): n is a, c, g, or t
ggtncncttgagaataagagagagagaagaaaagcaaagcacagacacacacgcaggcagagggtcgctcatggctgacgaggctcctacaccaggtctgacccaagtggcttcggcactggactcaggctgaggacttgggacacctgggaaccaaagccccctagcggcggccccgccccgggttcgcgcccccgccagtggcgccgttcccgatttggggccacacggggacaatacacaagtcgccttgggcgaagaagagcgtggcccgcttgtgtgaagccgggaaggtgcgccaattcttgcagttgggagcccccccctgataaaggggcccggccaaagcccaacgagtgtgagagccttcccgagccaaccaacacccatgcggccactctccttgcgcagataagacaagagacccccccggggggggggtacccacaaagaccacggggacacaaaaagtgggcgccggcaatgacaacggcaccccaccaagcgggccccgacacgtacaaacagcacgaagagaattctttgcccctaacgcgggcccgccccgtctgaaaagcactggggcaagaagccgctcctcaacactcatgtgtttttcacaacgcgccctctttaagtctacattgtcaaaagagcttctgctttagattctaaccacacgattcggccgaccctctactaaaagcaaatgggacaattttggggggaacacgcctgggatttatcttgtgtcgatgagcgcaccgcatgtagatatgttgtctttacaaacccgcagcaccttggttattagggccatggccccacaattgtgccagatgttgaaggcccccttaaaaattacaccaacataaaa

SEQ ID NO: 609236 - DNA, 862 bp, Homo sapiens
gctgaaccttgtggatctggacgtcctagggaatgtacgtggccgtggacgattggacaacagtgtgtacctgtggagtgcatacgctctggtgacatcctgcacccttgtgccaactggagcagtctggggaatatatatcctctgtggccatggactcaaagagggcaagtactctggctagtgggcaccagcagatgcgtgaggtgcagcgtatggagatgtgcaagtcaggcacgaaacggacgtatcagagaagtaatgcacctaggtccacgtgcttgcccggaagtgtgcgctccactaacgctgcgacacagcgtagtatccgtgtccagctggttcacgattctggccacatccatcaccatgactgttcggagtagcagaacaccatgtggccacactgacgtggccacagtcaggaagtgtgtgggctgcgctgggccccagatggacgacattgggccagtggtggtactgataacttggtcaatagtcgtgcctagtgctcctggagagcggtggctgggcttcctctggagacgattcgacccaagatcaaggggctgtcaagggaccgctagcatggtgtggcctggctaggtaccaactgtccgtggcaacagagagggcggcacatgtgatctgatacattcgcatctggaagtgtgtcgctactgagggccgtgactgaggtgacagcgcagtgcccacttcccaaggtgttggctccatcactctgggtctcaccgtatttgacaacggagcctcactcctcaggccaatggattcgggcacagaacacagagtagcttatctagggacagtaccgcatccatggtcgaaaggtggctgacac

SEQ ID NO: 609237 - DNA, 167 bp, Homo sapiens
agcccgtgccgtgggtgccctccagtcctgcagcccaaacacacctacccagaggcaccacagaatgcggacccaaagccagccgtacctccgagcccttagcacaactactttaatttgggaccacaatttagctttcaaaagttaagtttgcagtttgagcccgg

SEQ ID NO: 609238 - DNA, 120 bp, Homo sapiens
caggcgtggtggcggtcgcctgcaatcccagctacctgggaagccgaggcaggagatatctgctgtgaactcgggatagcatgaggctggactaagccgaaatcacgccactgtactcca

SEQ ID NO: 609239 - DNA, 447 bp, Homo sapiens
ctctaaatcgatcagtgcatgtgactgacatctgtatgctaggaatagtgtagtagggagaggttaatttccagaacttctcactgcatcaaactctaatctttaacgtgaactgtgctcttgggggaagtccttccagctagagataatgtgccacctgtttagaaatggagtcccattttaatgtaatggcgcccttcagtaaaaataccctcccgtgacacaggcagtgcatgtgacagagagctcacagtgtactagctctttgtcttctctcctgcctccggaggtggccctggccccctttacaggaaggagacactggctcagaaagggttaagaccacgctcagctggagacagaatcaggactagaactaagacctccccatggcagccaaagaaggatgccaggtgtgcaaagttcttatcacaatggcacgtggat

SEQ ID NO: 609240 - DNA, 110 bp, Homo sapiens
cgtttaatttgggcgcgccgctgatgatcatcatctgcctgggcgccctgacctgggccggcacccacctgctggacccctatcgtccgatcgaccggatcaagccgggg

SEQ ID NO: 609241 - DNA, 248 bp, Homo sapiens
cccactgtccacataagagacaaggcttggaagcaataagacacccagcccagggcctggatacttacgctgacagctgacaggtgattaaacaaattgctagctcagttctactcccgaaaggttatcacttctttgatctgctctgagatgggagccaacaaatcggaaagcttattttctggctggctgtcgaccctgagaagctgtaaccaacaggagctacggtccaacttcaaacctgtgtg

SEQ ID NO: 609242 - DNA, 400 bp, Homo sapiens
ccctccgcaccactgaggatgctatcgattatctgatgcatggcatactggaatacggcagactccattgcataccacactatgaatgtctgagttaggttttataactattaatttatatggttcacctctaacacagtttctgtgtgtcctgttcccccctgagaaagattagaaatggctcctgtgtaccaaattagcttcacagaagaacatgactattttcctcccactttttcttcttttttttttccacggcggagcctttgcaccttagggaccttttgcttttagcatcacctaattcaccattctttactcctagcctgatttcttatggcgggcggaagggggtctcgggaatccggtttttcgtgaattaaattcctccatggtgccg

SEQ ID NO: 609243 - DNA, 377 bp, Homo sapiens
gcctaacgaggtctctatattctgtgaatacgtgagacagatcgaggatcactaaagtgcataactctgatgagattcatctactgcccctaatctctggcttgacactacctactgttgtccagttggagacacactagaatgcactgaatgactattaggattgctgcctcctaatttatctcagcctcgcgctgttgatgtgaatgaggaactgcttggttgttaaaggagattttgctccctgctggcccaaacaggtccttatctaggtttggtccccactgacccacacaggtctggctggattggttacaatgatctccagaggctcaaccattccccttccctatccttgcttgggacatttcatcaca

SEQ ID NO: 609244 - DNA, 188 bp, Homo sapiens
ttcttgagtatcccctgtgatcaaaaaagagcctgaatagcaaggcaattctaagcaaaaagaagaagttggtggaggcatcatgctaaccgacttcaaactatactacagggacacagtgaccaaaacagcatggtactggtacaaaaacagcattgattgaagtcggttagcatgaaagcctctgc

SEQ ID NO: 609245 - DNA, 471 bp, Homo sapiens
atattatcctcgtctgcttgtcgaacagagaaaatgccaatgtgaaaaggtgaaataaaacacacaggagaaaacctaaagcacctagtatccatcaagcaactgtgtatcagttttggtataataggcaagacaacctacaaaagaaatccacatcccttttgagtccctatatgccagccatgctgataaatttcagattcagtttgacaattatcctttgaaacatgttaacacccagtatacagtatggaaaccagggctcaggagtgaaatgcccaacaagaccacacagaaaagtccatcagtattcatcaactttcagtcgaaggtccccgaattaaatgagaaacccattttacattcaaatctagtacacaaacatcaatcctcacgtaaaccatctctatgctgacctgcaagatgccctgttaatcttacagttatattaacgaattaaagtacctgttg

SEQ ID NO: 609246 - DNA, 132 bp, Homo sapiens
tgtggcagcagtaacagtgggtgtctgactggatagaggcaaactgagtgagcagcagatagtatccaacactgttagttctgagccctacatgactggctgtcttgctcattcttgccaattcattttttg

SEQ ID NO: 609247 - DNA, 1255 bp, Homo sapiens
gatcggagtctgcaaccggaggaccagaagttcgcctgtacactgacgtagtgtgcagattacattctgtcatatcactaccgttctgcatcgcgctatagctcgctcgttgttaacatatctcatgtgaggacctgtgcataaggtcgatgtcgcagaatgtgacggagcaataacactgtcgtgtcgaatcaatttcaaaactggggaaacagtcctatcactaatggatgagagaaatcgagctgtacggcacgagatcaccttggtgtcaatccttgatgacatcgttggcttacccgttggagtcctgtagcatttggcgtagagatcctaggagagatagcgtacggcaacgctagaagatccgtagctaaatcgacgagaaaatgccgtacgagctgcgaagctgtggcttgtgggcccgttgcatcccggcggtcgttggcagaaccacacatcttcctagctagtccacattgtatctgctacatgtcttgtaatcagtttgcgcggtataccattcaaattcgagggcaagagtgaactagtcatgtgaggacgctggtcgcctttgtcgagggctcgttccagtagtagtagcatagggatgaatagaggcacgctagcaatgctaggacgggacttgcgtacacttagttggaacttttgcacctgaaaagtaagtcctgagcctaacccaaagaggggaacagtgtggcacgaacatgttactatcccatgacgtgctccatagatatgcgacctccaggggataggatcataacgtggtacctatacgatcaatctggggacgacgtcgaccctagattagagcgaaatgactcgattggccgaatccatcgggccagggtcccgaaaaagcgacaacgtggaagggatgagttgccagaaggtatggggagcacaggttccctggggtttcttacccacaaaagagaatcgatccttgcttgtctaatgatcattgaatggcttctgggttcaccattcgcagtgaaccagcatgaggatttggagttgacgatgtgggttccatatgggtagaaggggcctaaagacaatggtagaccctgtggaaatatggagaaagggatcaatgaaagtagtcttttcatagaagggcttaaagggctaatgtaggtaaagggtgaagctggatttaggaaaagcacaggaaggaaagcgtaatttaataaagaggtcgggatataagcatgaggtcaaatgagaa

SEQ ID NO: 609248 - DNA, 336 bp, Homo sapiens
ccagggttttttgggggggggtttggttttattttccaaaagccaggtagggcttatttttttttttaaaggtcctcccggaaagaataaaaggggtttaaaatttggccctttgccttcgggaaaaaaaggcccgccaaagggtttttaaaacccccccccttgggggtttaaaggttgggggtgccccccggggttccaaaaattaaactgccaaagggcccccggggccaaaaaaaccccaaaaaaaggggtgggggtggtaaccatttccttccaaaagccccccggggaaggttggtttttaaaaccctttggtggtttttttttcctgga

SEQ ID NO: 609249 - DNA, 103 bp, Homo sapiens
ggctgggtcgcgtcggcgctggggcgcgaagcgggtcttgctggccgcaagaaccgcacttactgggaattcctcgcttcatggggaactaattgcaactccc

SEQ ID NO: 609250 - DNA, 203 bp, Homo sapiens
  misc_feature (123)..(123): n is a, c, g, or t
  misc_feature (139)..(139): n is a, c, g, or t
ttgctctgtggtctcctccgcagcacatcaccaaatgttgaacctcgtcctctcgtactgagcaggataccatggcaacacacatcatcagtagggtaaaactaacctgtctcacgacggtcntaaaccgcagctcacnagttccctatatagttggcgtgaacaaaatccaacgccttggtgaaattctgcgttcacaaatg

SEQ ID NO: 609251 - DNA, 157 bp, Homo sapiens
ttcaggaaaggggtgcaatccagaccccaagagaggttcttggatctctcacaagaaagaattcagggcaagttcacagagtaaagtgaaaggaagtttattaggaaagtaaaggagtaaagaatggctactctggctgggcacggtggttcacacc

SEQ ID NO: 609252 - DNA, 154 bp, Homo sapiens
tcgcgatatgattgcaaaatgtactacgaaactatggtaaccaaaacagcatggtactatcataaaaacagacctaaaccaatggaacagaataggaagcccataaataaagccttacttttatagtcaattgatctttgacaaaggtatcaag

SEQ ID NO: 609253 - DNA, 358 bp, Homo sapiens
  misc_feature (344)..(344): n is a, c, g, or t
ctgagcacagcaatttggcaatgtatcacagaaagcaacgtcacacaatcttttttggtaccccagtgcatacagaatggtgcatactttactgtagtctatcaagcgtgcaactagcatcatgtctaaagaatgtacttactttaggttgggcgtggtggtccacacctgtaatcccagcacttagagaggctgaggcaggcagattacctgaggtcagaaattcgagaccagcctggccaacatggtgaaaccccatttctactaaaaataccaggtgtcgtggtgggcacctgtaatcccagctactgaggaggctgagataggagaatcccttgaacccnagaggcagaggttg

SEQ ID NO: 609254 - DNA, 529 bp, Homo sapiens
  misc_feature (113)..(113): n is a, c, g, or t
  misc_feature (299)..(299): n is a, c, g, or t
  misc_feature (305)..(305): n is a, c, g, or t
  misc_feature (354)..(354): n is a, c, g, or t
  misc_feature (507)..(507): n is a, c, g, or t
  misc_feature (515)..(515): n is a, c, g, or t
gaggggctgagagaggaagagcagggtcagggataacactaggttccttccaaggggcctgaccagcaggcaaggtgtggggcctgagaggtggcaagctgtcaagaaagcancacaggctttgcagccaggaggacctggttcaaattctgtttctcattttctcagcctgtgccctgaagtcaagggtaagtcacctttccagaccccagttttctcgcctgtgaaatgggtgtgatgttacttatctcacacatattgaagtgggaagtatttaattaaagcacatgtctcaggcnggtaangctcaaatgaagtagttattagaagcgagctatgcacagagcttgttanccattaagtcttattgtcgctggacgctgagcactgtgacggcaaggaatgtagtcacctcacagacttctacgttcctaaggcaaggcttgatgagtccagttccttaacatcttcagctacaatccagcacagttggcttaggactcaggntcacagangtcaccagagcctc

SEQ ID NO: 609255 - DNA, 532 bp, Homo sapiens
cttgctgccggggtcttgctgccggggaggcccagatcctgagtggagggagtgctacagtgactgggcctctccctcagcaagaccccggcactccccgccaggcccagggatggggtggatgggcccaaaggcccagcacccaacacatcctttcccatgtccacattgtcaccataccatatccccattatcggttttgtataggagtaaatcgtctttccagattgcagtggacacagacccacgatctacgagccccggaccccggattctgtcatggacattgcatcgaccatagatttatctatactttaaaaaaaaaaaaaaaaaagatcaaaaatagaaaattaacatcaaaaaaaccaaaccataccgaaaaagaaacagtagaaaaaattataaaccagatcataagggaaagataaataataataaagaggaactccaaataaactggaaagaaaagaggaaaagaagaaatataacaataggggaaaaaaaagaagaaaatcactattataaagataca

SEQ ID NO: 609256 - DNA, 2302 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcacaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609257 - DNA, 2066 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609258 - DNA, 1945 bp, Homo sapiens
catccatcgcgctgctcaagctccatccatccatttatccatccatccatccatcctttattgagagtaaaaagccgccaaccagaccctgggaggaagacaggatggttcccgagaactagggctgctccttggcttttagagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609259 - DNA, 2126 bp, Homo sapiens
  misc_feature (49)..(49): n is a, c, g, or t
  misc_feature (70)..(71): n is a, c, g, or t
gccaacgatggcgtgctgccccgttggtgcatgcgcccggggcctgagngcgggaactagcagagtggcnnagcggggcctctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcacaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609260 - DNA, 1736 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagtggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609261 - DNA, 147 bp, Homo sapiens
ggatcccttactgtttatgctgtgaggctggacttgtactatgcacaccacctgctttttagcatgggtcctcaccacaagcctaatgtccgcaggcaaaaagtacaactcaggaggaatctgcccagtcacacaccacagacaggc

SEQ ID NO: 609262 - DNA, 1865 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccggggcagccccaagggctcggtgctatttgtaacggaataaaatttgtagccagaca

SEQ ID NO: 609263 - DNA, 368 bp, Homo sapiens
agaactggagaggcggatatgtgggtgcagattgggcggctgctccctgctactgggtggctggcgatgtagctgatcctcagcgggtggtctggtggactgctcgcgggcggagatgaccttgccatcctggactcttccacaatggtacgcacctgacgagtggtcaccggttctttcttgtactgagtcaggtgggaatacctctccctccagcaggcggcggtaggtggcactctcctgttacagccgcgtcttcacatccagcacgaatatgtattcctggttctgctgctccatctcgcagcgaaagcttgggccagctggtcctccacgcttgacaatcaggccctggatctgggacagat

SEQ ID NO: 609264 - DNA, 132 bp, Homo sapiens
attttggttcttagttgatgaatactcaacacccagttcattgttttggctgcacccacgcagtgcagctaatgtgtggcttaagaatgaccctcttctttggcctcacccaccttgggaaggtgcgcaagg

SEQ ID NO: 609265 - DNA, 2250 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609266 - DNA, 1800 bp, Homo sapiens
  misc_feature (180)..(180): n is a, c, g, or t
  misc_feature (1617)..(1617): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctctggcagcagcaacactccaggncagaactgaaatgctagagtagttcctccacagcaccccactcacaccttcactattccttcctctggttacctttcctgccattggctacttatcttgagttcccagggttaatggccaatgagggacttttccaataccgtgggtgttgtacatattcttgtggacgagccctgccggccg

SEQ ID NO: 609267 - DNA, 220 bp, Homo sapiens
tgggctggggaagaggtgacggaatcctgagccccaggaaatctggtgagagggctgactctgcagactgtgacttgcttgggcacatgcttctgggggagcccttctctcctcgtggcttgcatggatgctaccatgcttcccacagaccccagtggacagggcacagacagtgctacggccagtgatgactggccatgatctccacagcggtgtttta

SEQ ID NO: 609268 - DNA, 1517 bp, Homo sapiens
cactcctgttggctccttttctctggcataccctggtgttacagtgtacgagtcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609269 - DNA, 403 bp, Homo sapiens
ttgtaggtcgaatctacaggataccccattttatctgaaggctgccctggtacagacaacttttaattttcagttctctcagagacctcagttggggttataagcttactgttgggactttcttactgagtatgtcatatgtagctttgtcaaacaagactaggttattgagcttgtcccaaactttgcctttggaccacttcttctttctgtccttgccaccagatttgttcattgggtctctgtctttcttgtctgactttccagtgtctttcttcttcctgtcgtccttgggcagcatcgcgatgcccaggggacagcagcaacgactttaacctcgctaagatgtcagacaaaaagctatttagttttaagatcactttaagttcacagcaacattgaa

SEQ ID NO: 609270 - DNA, 751 bp, Homo sapiens
tttgacaaattggctctctcaaacacacttggcttcaagcgctggtctttccaatgagtctaataaaacacgaatctctcctggcccaaaaaatatttgttcgccccctctcatgatatagtaataccatgtgttcgcgcccaaaaaacaaatatatttctgtcaagacaggtgctacactctctctcgcgacacgactctggttctcctcaacataccagagctagacatacagaaatattgcaagaaacttaaccacgcgctcacatcattcctcagcaatccttcttttgtgcgaattaatttttccggtgcctttacccggctacatcctcctgctcccctgggttatcccttctcctctgtggcggcccgttgctcttccagtgccctctggcgcccgccatcgtgtgttctccgggtgtgcaaagagtgtaccttgtgggtcctgtcggccgccccttcgttttcccgctgtctcccagcgtgcacacggcccgccggcgtcactctgtgtggcgcccgccgtcgttttttgatattcgcctctcactgtatgcccgtgtgcaaccctactgccacccacactcttggagggagtcttcttttcctatcagctgacccacttgttctgccttttcgcataaactcttgtcacccccttctccctagccagcgaccccacgggcggtccccccaagaacccacccagaatcacaatgttccaatttttaaaagaaaccatcaaaca

SEQ ID NO: 609271 - DNA, 1709 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccggggcagccccaagggctcggtgctatttgtaacggaataaaatttgtagccagaca

SEQ ID NO: 609272 - DNA, 160 bp, Homo sapiens
cggcacgcgcagtgacataccttgcagttggtgtacctcctgaacccgcacatcatcagtgatggtccccacaaccacggccgtcttgtttccccggcgaggaagcttcatctgccggatcatccgggaaagggacagaggcggccggtgggcttcatgt

SEQ ID NO: 609273 - DNA, 151 bp, Homo sapiens
  misc_feature (139)..(139): n is a, c, g, or t
  misc_feature (142)..(142): n is a, c, g, or t
agcagccgctgtctccagtgccgcagcagcaggtagtgctcatagctctctttgtccagtgcttcggccttggtcccagcgctttcttaaggagcgggactcttcaccctgcacagccttgttatctttttttcatggnggnggaacaccc

SEQ ID NO: 609274 - DNA, 177 bp, Homo sapiens
aaattgccatgaagaggatgctgttggtcctattcttcataggcaaaataagaccaacagcatcctcttctatagcagagttctcatccccgtagatgctattagtctgtcactccatttggaagatgttcacctgagagatgttctggtgaaactgcttgctggcaacaactagtt

SEQ ID NO: 609275 - DNA, 433 bp, Homo sapiens
  misc_feature (78)..(78): n is a, c, g, or t
  misc_feature (160)..(160): n is a, c, g, or t
  misc_feature (293)..(293): n is a, c, g, or t
  misc_feature (368)..(368): n is a, c, g, or t
  misc_feature (370)..(370): n is a, c, g, or t
actcaactgggtgggctttccacccctcggggctccctcctgaagcaagtaagtaacccccaggttgaactcttccanggtattttcctgggaaagaaagcttaattacaaacttttcccttgaattacattaggttagaaaacatgcagcccaggcacnggtggctcatgcctgtaatcccaacactttggaaggctgaggtaggcagatcacttgagcttaggagtttgagaccagcctgggcaacaaggcgaaaccccatctctactaaaaatccaaaattagctggggngctcgtgcacacctatagtccccaggtactccggaggctgaggtgggaggatcacctgagcctggggacgtcaangnctccagtgagctgagatcacgccactgcactccagcctggcaacacagtgagacccccatctc

SEQ ID NO: 609276 - DNA, 249 bp, Homo sapiens
gggtttaaggaaagggtggggaaaaaggagagggattctaaagtttaaacgtcccaaaggggctgctttttcaaggaagcttattttgttttaaaccattaaaagatgtggtttgatccgtttatttgtatggaacaggggatgcttttaaaaaccaataatggcctatgcttttaaacaagaaagctttgtttcaaaccccaactggccctttttgtgatggggtttgaaaaaaggattccccgtttt

SEQ ID NO: 609277 - DNA, 430 bp, Homo sapiens
tgtagcagctcgcaatcctggactctaactcatattgaagagagaaaaatagcattaagtgattcaagcgtcttgcccggggaactctagaaaataaaggcactggtgcccagatgcaggtctgcatggtatgcaagcctgggcttcttcccacctcccccacagagagggcactggtatgttggagtgaagagccacgcaagacctctgtgaatgggcagagatgggccagtgacgcaacacagtaaagtgtattttggttataggcatcgtctctaaacttatgtaaaacattattaaaaaatggaaggacaacgatgaaatgatggccaaaaatatagaaaaggataccttgcatgtcctgtgaaatgcaaaggaattctaaagtgtcattatgagttacctcatggaagaaagcaaaaggtgaatc

SEQ ID NO: 609278 - DNA, 113 bp, Homo sapiens
aattttccggggaaagtaaagcctcaggaaagcccacgccttttttccaaagcctttgtttttgagaccttttaagttttaaaattaaaggccccccgcggtttttcctttga

SEQ ID NO: 609279 - DNA, 547 bp, Homo sapiens
  misc_feature (223)..(225): n is a, c, g, or t
  misc_feature (246)..(246): n is a, c, g, or t
  misc_feature (299)..(299): n is a, c, g, or t
  misc_feature (327)..(327): n is a, c, g, or t
  misc_feature (371)..(372): n is a, c, g, or t
  misc_feature (478)..(478): n is a, c, g, or t
  misc_feature (497)..(497): n is a, c, g, or t
atctatgcattaggaatttgacttccatttgatgttaaagcatatacttggctttaaggacacactaaaactattcaaagtttaattacattcagacaaagatcatctaaccactggtgctacatagggaatatttatttaattatcccttgctatctctattaatcagtttcctcaatttatccttaaaattttcctcaaatgcttagttattttattattnnntttttaaaaaattggggggcnaaggcgaaggacacagtttaaataattaagcaggcatactttttcctgtcttncctggttgattctaaattgcaggggctnccatgttaaattttagataatgagaaacaccctttggggggggnncgcggggggcttcagttttacctccataacccggggcaagggtactgggaattttttttcggcaagacccaacgcggtggttaggaagggttttgagagcccttcntcaaattttatagggccgngaagccgggagacctcccataaggatgtggttccctaggtggggtccctc

SEQ ID NO: 609280 - DNA, 273 bp, Homo sapiens
atccgggccctctacaccaagatggttccagcagctgtttcccattcagatttctggcatcggtatttctataaagtccatcagttagagcaggagcaggtccggaggacgccctgaagcagcgggcggaacagagcatctttgaagagcccggttgggaggaggaggaagaggagctcatgggcattttacccatatttccaaaagaggcaaagtttcctttggccaaattttttacattccctgaaggagaacctggcccccagagcccct

SEQ ID NO: 609281 - DNA, 341 bp, Homo sapiens
  misc_feature (77)..(77): n is a, c, g, or t
  misc_feature (113)..(113): n is a, c, g, or t
  misc_feature (151)..(151): n is a, c, g, or t
  misc_feature (277)..(277): n is a, c, g, or t
  misc_feature (310)..(310): n is a, c, g, or t
cctgtctatcgaaatccaggagttgcttcttgtgatcctgatgctggagcatttaggagttgcttcttgtgatcctnattctggagatttaggagttgcttcttgtgatcctnattctggagatttaggagttgcttcttgtgatcctgantctggagatttaggagttgcttcttgtgatcctgattctggagatttaggacgttgcttcttgtgatcctgattctggagatttaggagttgcttcttgtgatcctgattctggagatttaggagntgcttcttgtgatcctgattctggagatttagnagcagtttctgtttcaagaagcaggaactgt

SEQ ID NO: 609282 - DNA, 242 bp, Homo sapiens
  misc_feature (40)..(40): n is a, c, g, or t
tctagtgacctagagtgatcccaagcttaacgagggcttnaacaacagaaatgtatttttttatagatctggaggctggaaggttgagacaaaattaccagcagggttagctttcttcttggcttataaatggctttcctctccctgtgtcttcacatggtctttcctatttttctgtctgtgtccaaatgttctcttcttacagggacactagtattattggattagggccactcctcgtt

SEQ ID NO: 609283 - DNA, 898 bp, Homo sapiens
  misc_feature (571)..(571): n is a, c, g, or t
  misc_feature (892)..(892): n is a, c, g, or t
gcataaaactagccccaaagccactccaccttactacgcagacaatcttagccaaaccatttacccaaataaagtataggcgatagaaatagaaagctggcgcaatagatatagtaccgcaagggaaagatgaaaaattatataccagagcataatatatgcaaggactaacgcgcccgtataccttctgcataatgaattgaactagaagataactttgcaagggagagccaaagctaagacccccgagaccagacgagctacctaagaacgagctaaaagagcacacccgtctatgtagcataatagtgggaagatttataggtagaggcgataaacctaccgagcctggtgatagctggtagtccaagatagaatcttagttcagctttaaatttgcccacagaacccgctaagtccccttgtaggtttaactgtgagtccaaggaggaacagctcttgggacagctaggaaaaaagctggtagagagagtagaaatctaacaagccatagtaggctagaagcagccaccaattaagaaagcgtcatgctcaagaccactactaaaanatccaaaatataactgaagtctcaaacccaatgggacatctatcacctattgaagaactatgtgagtataagtacatgaagaactctctcgtataaggctggtcgattaacactgacgcagttaaggcaatttaataacaaagtttttactgtggaccaaaaggctgcctggggcaagaggccggaattacccgttccaaaaaaaaaaatgtgggcgccaagttaaacgtggggccagaaaagacttagacggtagtgtcaccaccgcgcgaatgtgcgtcgcatacacacacccattagatagcattgctcacatgatgnagaagc

SEQ ID NO: 609284 - DNA, 109 bp, Homo sapiens
ggtatacgtgtggaactgctgcagccatttgcctctttgtcctttagtgtaatctctccagcaggaaaggaacttagttcagtaatcttcacaattaccacacgtcata

SEQ ID NO: 609285 - DNA, 459 bp, Homo sapiens
cgtctctactaaaaatgcaaaaattaactgggcacggtggcgtgcacctgtaatcccagctacttgcaaggctgaggcaggagaattgcttgaacccagggtacagaggttgagccaagatcatgccactgcactccagccagggcaacagagtgagactctgtctcaaaaaaaaaaagcttaggatggaaaaggtaaattataacattaaaaataggtgtcgtggaagtgctttcaaaaacccgcaaataatttcatttggatttaaaccccgtacttttaaaaaacactcccaggtcggttacaaaacttaagaatgagaatatcacggccaggtatggtggctcatgcctgcaatcccagtactttgggaggctgaggcgggtggattacctgaggtcaggagtttgagaccagcctgaccaacatggtgagaccctgtctctactaaaaaaaaaa

SEQ ID NO: 609286 - DNA, 860 bp, Homo sapiens
aacctgctgcgtgcccaccttgctgatccctccctccttctagacaaaggcttcataagccagggaccttgggtttgctcacaaggcagcccctcacctagtaggcattagttcattatgtatatgtatatgtagtcctcaggttgtattccttaaatatatatagtttaaggatatgtattatatatatataaatatatatgtaattccttaaatatataattttaatacaatttttttttggagatggagtctcactctgtctcccaggctggagtgcagtggcaccatctgggctcactgcaagctccacctcccgggttcacgccattctcctgcctcagcctcccaagtacctgggactgcaggcgcccgccaccacgccaggctaatttttttttttttgggaatttcaaggggagaagggggttccaccggtgttgggccgggaagggtctcgaatcttcgtgacctcagtgatccacccaaccttgggcctcccaaagggcggggatcacgggcggtggaccaccgcgccgggccaaaacaaagttttcaaaagattcctttaataaccttttacaataacatcaaggaactataaacgatatagcaattatgtgaaagccagcagatctcaagggatcagaagctaggtactagaaagactgaacggccagcagggctggcttcgcaactccaacgcatctggacaggctgtggcaggcagcgatcagagcacacaaacacttgaaaatacccgggcagacgtcggtgggccccaaatactagagaaacatacaaaatgcccggatagaggggtgaaactgtaccacgacaagagaaagcacaaactaaag

SEQ ID NO: 609287 - DNA, 827 bp, Homo sapiens
tggggacagggtttcactctgtcacccaggcgggagtgcagggtagcctcaacctccggggctcaagcaagatcctccagtcttagcctcccaatgtaagctggggactggttaatgtggtggagccacctatgcccagctaatttcttgggtagtttttggtaaagaaagacaggggttttaccatggttggtccaggctgtgttttgagaactctcggggctcaagtagacctggtctggtctgggcctcccacagtgctgggagattggcaggtgtaggagccaccatgccgggcatagggggctggtatttcagtgaaattagaaaagtttcggaggcatcgaatgggataaatgggatgggatatatcaaatggtatgggtataaagtggggtagaatggtatggacattggtaaaatcccacagataatttatcttttggtgtaaaatagggcttttaaaactagacttgtcgtgaaccaatacaggttttttgtttttatgaggagggtgaaacagaagtgtggccctaacttttttaagtctggcccaatttcctgaatagaataattgggctttctaaattagggggaatgggggtgcccaatataagaagaagggggttattggaaacaattgagatatactgggggatacttttcaaggaagccgtgatatacactataacgagggctttggaaacacccgtttttgtgttaaaggaagttccattcttagcgaatacaggggactgtgtacccctctttatttcgctcccttaattttaaacaattatggctgacacggcatctggtaacgacat

SEQ ID NO: 609288 - DNA, 259 bp, Homo sapiens
taatgtcttaaaaatgtacaaaccctaactttaaaaatatgtttcgctttaagaaatactaacaatcttctgagccttcagcaagttgtaatcttttttttggtggagggtctgcctcagtgttgatggctgctaactgatcagcctgggggttgctgaaggctaggatggctgtggaatttcttaaaataaggcaacaattaagtttgccacatcaattcattcttcctttcacaaaagatttctttgtaccataaga

SEQ ID NO: 609289 - DNA, 660 bp, Homo sapiens
cgcggtggctcaggcctgtaatcctacgttttgggaggctgaggtgggtggatgacctgaggtcaggagtttgagaccagcctggccaagataaacacaaacacaaaattagccaggcgtgatggtgcatgcctgtaatcccagctactcaggaggctgaggcaggagaatcacttgaaccagggaggcgatgatggtggtgagctgagatcgtaccattgtactctagacggtgcaacacgagcgaagctttgacctaaaaaaacaacagcggagaaacagggtgtaactttcatccaggccatagtgcagaggtgcaatttcagctaactacaaccttagtcagctgggtcaagcaatactgccaccttagactccctagctgatttgatactacactgaatggctgcaacagagcccacagagtctacaggccttatttactatgtagaagatatactatgtgatcctataattaatgaatggatttattgatctacaacctagatgttagcccgttcacagcagcttaggcctcgtatcctacgctctgcgatgctgaagttgcctgatgacctgagtgcagcagtttgcagctggattggccaatattagcacgctaccacaatagacagtctttgatcctgcatgcttgattcc

SEQ ID NO: 609290 - DNA, 341 bp, Homo sapiens
  misc_feature (50)..(50): n is a, c, g, or t
aaaaacaggtgggcagggccagccccagggccctgggttttgaacccggnttttgatccctgttgggtttgaccggctcccccaaacaggttgcccaggctagtcccagtttccgggtgttttacaatgccggccccaaggattagggccaggattacttcgtgggcccctccattgccatttacctgttcaaccctgggggccttttcccggatttctccggccggagcagatcggttgagcagttttcaaccagtgtgggggggcccatgggggctttccccagtgtcctttttttagcccctccagtttgggccccctctttaaacggggggggttta

SEQ ID NO: 609291 - DNA, 120 bp, Homo sapiens
ttacagagatatgagctctattatctgatcaggtgcaaacaagctgcaacactccctgggcttctgaacggcaggagaagagcatctgaaatcccgcacgctgtctttgctggtgggaag

SEQ ID NO: 609292 - DNA, 474 bp, Homo sapiens
  misc_feature (13)..(13): n is a, c, g, or t
ctaacccgaccancagggattaaatataagcaaacatagatcacttgtcttacaggaaagcaactaatgctggtcccttggataagattcttcatggaagtgttggctatctcacaccaaggagtgggggtcatttaatgaacctgaagtactatgtctctccttctgacctactggatgacaagactgcatctcccatcattttgcatgagaataatggtaagactttaattgtaaaggaattaaaggttttgttcggtgcccagcttgcctttaatttctggtttgctattctctaatgagtttgttgaccttaccatttgcaccttatacacacaacacctcacacacgtatatgtgtgttcacaagtacatacatatgtatatacacacatgcatatatacacacatacataataggagcttaataagtacttttgggctgggcacggtggctcacgcctgtaatcccag

SEQ ID NO: 609293 - DNA, 450 bp, Homo sapiens
tagagtatcacgattactccgtagacgggaatgcgaatgagagaaaatggagtgagcaggagtggtgataatgaggtagacgaagaagaggaagaaggtggggatggaagaggaggaggaatgaagaaggtgatggtgtggaagaggatggagatgaatattaggaagctgagtcagctacggtgcaagcgggcagctgaagatgatgaggatgacgatgtctgataccaagaagcagaagaccgacgaggatgactagacagcaaaaaaggaaaagttaaactaaaaagaaaaaaaggccgccgtgacctatacacccttcacttccggtctcagaatctaaacgtggtcaccttcgagtagagaggcccgcccgcccaccgtgggcagtgccacccgcagatgacacgcgctctccaccacccaacccaaaccatgagaatttgcaaa

SEQ ID NO: 609294 - DNA, 2013 bp, Homo sapiens
  misc_feature (180)..(180): n is a, c, g, or t
  misc_feature (1719)..(1722): n is a, c, g, or t
  misc_feature (1911)..(1911): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagcatttctggctgctcctcctgacccggggcctggtgggggtcggggaggccagttattccaccatcgcgcccactctcattgccgacctctttgtggccgaccagcggagccggatgctcagcatcttctactttgccattccggtgggcagtggtctgggctacattgcaggctccaaagtgaaggatatggctggagactggcactgggctctgagggtgacaccgggtctaggagtggtggccgttctgctgctgttcctggtagtgcgggagccgccaaggggagccgtggagcgccactcagatttgccacccctgaaccccacctcgtggtgggcagatctgagggctctggcaagaaatctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccggggcagccccaagggctcggtgctatttgtaacggaataaaatttgtagccagacaccaaaaaaannnnctcgtctttctctgggtggcctctgatcttgcaccccgtcttcaccccagggctcctgaagactgtgggtcattcctcagggctctgggtgagtctctgcccttctgggctgggcgactgagatgggggactgctcttctccgagtgagctggctgagtgtgacccgtgagtcacacacccatgctctncctggagcctgtcaccttgcctcacaaggcctggctgaaggttgggggttggaactgcccctttcgtacccccagacgtgtctgttataacggatccgctaa

SEQ ID NO: 609295 - DNA, 699 bp, Homo sapiens
  misc_feature (289)..(289): n is a, c, g, or t
  misc_feature (360)..(360): n is a, c, g, or t
aaatctactcttctgataaggacatcagtcatattggaataggacccaccctaatgtcttcattttaatcacctctttaaagcccctacctccaaatacagtcacactgtgagaaactgagggttaggaagtcagcaagtgagtcttgaagagatactaaacaaacccacaacacagataaagtatgcattttggagatttccaagccagagtctcccgtgaaaaaggtaaacggaagcagttattgtgcagcaaaaggaaaaagaattacaaactgaacgtatggtanggtgaaggcaaaggcaagggtaggggcaagggcctttggggtaggctgaatcagaagggtttttcaacaantaaatcaatggggaaatgcatttgttgctcccaaggaaccctgggcaccttggactctgggtactatagcatgtcaagcaaatacaagcaaagcccaaacactctggatttgcatttaaggccaatctaaaactatccgggtgtttaagtttggattttttgaagtgcaggttcattcaaagggaccaaggttcccttggtggctcaagggtgaaagttagaaccagaaaacatccgttatccattcccaagaagttttgggaaggagccttgggtaagaaaagcagaagctgctttgacccgtgaaaaatatttgactcctatcaagtttttgggtca

SEQ ID NO: 609296 - DNA, 1166 bp, Homo sapiens
atctagctagtgtcgaggtcacggttagagtgtgcgtctgctgctgtctgtagtgcggagcgcagtgagcgtgagcgcactcagatttgccacccctgaaccccacctcgtggtgggcagatctgagggctctggcaagaaatcctagtttcgtcctgtcttccctgggcttcactgctgtggcctttgtcacgggctccctggctctgtgggctccggcattcctgctgcgttcccgcgtggtccttggggagaccccaccctgccttcccggagactcctgctcttcctctgacagtctcatctttggactcatcacctgcctgaccggagtcctgggtgtgggcctgggtgtggagatcagccgccggctccgccactccaacccccgggctgatcccctggtctgtgccactggcctcctgggctctgcacccttcctcttcctgtcccttgcctgcgcccgtggtagcatcgtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609297 - DNA, 254 bp, Homo sapiens
aggaaattttgttagaagttatgttaatatgataatgaattaagagtttataaatatatttttgaaaatagaaaagaaatgttttagtaataatatgataatggttgttgagaatttttgaggaatgttttgagtagttttattggttgtgtggattgtttggaattatgtggtagattagaagaatggtaaagatgattttaatttgagtatttttatatagtaatgtataaaatggaattatatttaaagga

SEQ ID NO: 609298 - DNA, 1687 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagccaggcggatgacccggacgacgggccagtgcctggcaccccggggttgccagggtccacggggaacccgaagtccgaggagcccgaggtcccggaccaggaggggctgcagcgcatcaccggcctgtctcccggccgttcggctctcatagtggcggtgctgtgctacatcaatctcctgaactacatggaccgcttcaccgtggctggcgtccttcccgacatcgagcagttcttcaacatcggggacagtagctctgggctcatccagaccgtgttcatctccagttacatggtgttggcacctgtgtttggctacctgggtgacaggtacaatcggaagtatctcatgtgcgggggcattgccttctggtccctggtgacactggggtcatccttcatccccggagagtggccacttatattttcatcttcattggagagaccctcctgtccatgaactgggccatcgtggccgacattctgctgtacgtggtgatccctacccgacgctccaccgccgaggccttccagatcgtgctgtcccacctgctgggtgatgctgggagcccctacctcattggcctgatctctgaccgcctgcgccggaactggcccccctccttcttgtccgagttccgggctctgcagttctcgctcatgctctgcgcgtttgttggggcactgggcggcgcagccttcctgggcaccgccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609299 - DNA, 436 bp, Homo sapiens
  misc_feature (121)..(121): n is a, c, g, or t
gggatccgggtggtaaatatcccccctgtattcattttttattgccatttaattggattctttctcctcttttcttctttattagtctggcctagcagtctaatctattttgttgatcttnttcaaaaaaccaggctctggattcattgtttttttcgtggtctctatctccttcagtcctgctctaatcttagttatttcttgtcttctgctagcttttgaatttgtttgctcttgcttctctaggtcttttaattgtgatgttagggtgttgattttagatctttcctgctttctcttgtgggcatttagtgctataaatttccctctacacactgctttaattttgagatggagttttgctcggtttcccaggccgagatcgcacccctgcactccagcctgagcaacagagtgagactctgtctcaaaaata

SEQ ID NO: 609300 - DNA, 976 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaggtgggatcgtcggtgggaccggagcgcgggcgggcgcggccccccgggaccatggccgggtccgacaccgcgcccttcctcagcccatcttcattgaggccgaccgccggcgggcacagctgcacgtgcagggcctgctgcacgaagcagggtccacagacgaccggattgtggtgccccagcggggccgctccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagaca

SEQ ID NO: 609301 - DNA, 651 bp, Homo sapiens
cttaacactctcatacggagattgaagcttcagctgaagtctcacccaccacgagtgacctcccccatctcaccccacttcacagtgactgaacgccagaccttccagccctggtctgagaggctcagcaatacaacgtggaatgagctccgtacaattcctccattgtcccatgggaggccatgtgagcaagcgccagagcactaagcaggagcaaggatgtggagcacaggcaggagccgatacaagaacacaagcaggatgaggggcggacacaggaagagccagaagaggacacaggacagacggagggaacgcaggaggaaggacaggggactaaggagggactgggaggctgtgtctcagctgcagacagactcagagcccaagtttcactctgaatctctatcttgctaacccttcctcttttgctccccgggtacgagaagtagagtctactcctatgataatggagaacatccatggagctcattctgatcagcccaggaaatagatgaagtgactgaaatatgtgatgagaactcctactggagaaagcataatccttgtagcctcctgcagctggcccacacagaggccttgctggtgctgtgctattcgatcgtggagaatacctgcatcataaccccc

SEQ ID NO: 609302 - DNA, 1087 bp, Homo sapiens
  misc_feature (180)..(180): n is a, c, g, or t
  misc_feature (793)..(796): n is a, c, g, or t
  misc_feature (985)..(985): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaccacccgcgtgcccgtggccagtgtgctcatctgagaggctgccgctcacctacctgcacatctgccacagctggccctgggcccaccccacgaagggcctgggcctaaccccttggcctggcccagcttccagagggaccctgggccgtgtgccagctcccagacactacatgggtagctcaggggaggaggtgggggtccaggagggggatccctctccacaggggcagccccaagggctcggtgctatttgtaacggaataaaatttgtagccagacaccaaaaaaannnnctcgtctttctctgggtggcctctgatcttgcaccccgtcttcaccccagggctcctgaagactgtgggtcattcctcagggctctgggtgagtctctgcccttctgggctgggcgactgagatgggggactgctcttctccgagtgagctggctgagtgtgacccgtgagtcacacacccatgctctncctggagcctgtcaccttgcctcacaaggcctggctgaaggttgggggttggaactgcccctttcgtacccccagacgtgtctgttataacggatccgctaa

SEQ ID NO: 609303 - DNA, 842 bp, Homo sapiens
  misc_feature (180)..(180): n is a, c, g, or t
tctttttgacgctccagggaccgcagggtctgggaaagttcctggttactccggcgaccggccggccgtcacatgacatgtgagccctggcggaacgcccaagaggcttccgtagtcgggtggcaggtcacgtgtcgaaggcttgcccgcggggaccccttccaccctggctccagcgtnacatgaccggctttaagcaacatggcggctgccgtggtgcagcgcccgggctgagcgacagcaagtgcagcgggctcctaccccgggtgaggggtggcctccgcgtgggatcgtgccctcttcagcccgctcctgtccccgacatcacgtgtattccgcacgtcccctccgcgctgtgtgtctactgagacggggaggcgtgacagggcccgggtcccttctcagtggtgctctgtgcttcagggcaagctccccgtctccgggcgcacttccctcgcctgtgttcggtccatcctcctttctccagcctcctcccctcgcaccctgctcttgccaaagttaacagtggcctcctagttgctaaacacagctccaacttcctggtcctgttcatgctaggagcctctggcactgttgacccactcttccttcctgaaactctctcctacctttgcgatgccacactcttctggctttcctcctgcctccctggctgttgcttctttgttcctttgaagcctcctctgtctgttctcactccaccccagaactctgtcctcagccccaggacctacgtactttccttgggtgactgtacccgtccttagcttcaggtgtctttggtagacacataaactcccatctaaggtcacttattcatt

SEQ ID NO: 609304 - DNA, 421 bp, Homo sapiens
gcagtacgacgtgcagaaaaagtagatgagcacagaacccctgatggcgatgcgcaagctcccaactccaggtgacagagggctagagagtcgtaccaaggccctgacctgcctgctagggcagtccccgcagccagatgggtcgtccaggcaactcagcatggaaggaacagtggccgtgccagggccctgtggagctgacacgggcggacagggcaagggcaggatggggagcagtcaggaagttccgggttgtaggggaggtcggatgactaatgggcgggttcacgtgctggtagttcacagtgcatacggacgcattcacatagggtggtcgtcccatctgccatgacagcataaccccttcgtggatgtggccaaaagacaatgtcaccgcggcttgacgcgccatcgtgcgctt

SEQ ID NO: 609305 - DNA, 301 bp, Homo sapiens
ccccccgtgagacaactttatagggttttcagtatgtaccatttttgacgcacatcttagaagacaggacattatggggctggtatcattagggtttgactgaaagtgagaaacagtattttgtaaaacatttacctaataatagctttcccaatcggtacttcccttggaattaaaaacaggaattacaatttaggtttatacgtggttttagatatgactcaatatacatagattttaactttatggttgggtattacttttttaaaggcgctcaatagaaattcaaatctcactttaa

SEQ ID NO: 609306 - DNA, 561 bp, Homo sapiens
acgtctacatacctcgtcaatgttatatttgtgatcgtcggctatgtgtgagaagggagcttagacaggattggaacttggctatcctacgtgttatgcaatcgtgctgacatacgtttgaggttgaggaacacagttaatagcatagttaatgataatggccgtgtcgggctgctctgagtcagaacaatcagaagtcggtaaagatggtagttatctatcaggaggtgccagggctcgggtgtggagcaggcctgatggagcagtggtacccaccaaggtggtagtcagaagtctagccagtcttgcaaggtgttgtgccattgggcatatcttcactcctcatagtctgcatgtgggtgcagttctttaaagatatatagccttatagctacagtagtttgcacaagtagatgcagctcttataaaccttaaaatacctgtctggtgtctacagagcatatgccattttgtatagagtcacccttccccaggccagggcctagagtcttcattttggggactttgtgttttggaagttctaggacataaagctttaga

SEQ ID NO: 609307 - DNA, 357 bp, Homo sapiens
tttaagactattccttttaattgtcaataagtttcatcaagatgtgtctgaatatgtcagtgcagtgaggctcatgcgagtaatatcagcatccaaggacgccgacgtgaatctgtcatttgaggtcaggggtttgagagcagcctggccagcatggtgaaaccccatctctactgaaaatacggagttagctgggtatggtggcacatgcctgtagtacaagctacttgagaggctgaggcaggagaatggtttgaacctgggaggtagaggttgcagtgagccaacattgcgttattgcactccagcctgcgtgacagagcaagactctgttcatacaacaccaaaacaaacaaa

SEQ ID NO: 609308 - DNA, 105 bp, Homo sapiens
tagataaaactgaaacggaaatcctatagctggagacaagagaaaagctagatgaagagtatgatatgggagctaacagatcaacgtgttcaccggaggaagttc

SEQ ID NO: 609309 - DNA, 309 bp, Homo sapiens
cgggtggtgataaatgacaactgtgaatttctcgaaggttgatgagtccgcacggctgaggattctacgtggttctcttggttccccgtggtgtgtgtgctgtgtggacggaggcctgcgcccttttatgatcaccgttcgttgagctctgtctgtacatggaccatgcacggaaggcgcccccctatgcccctgagggacggtgggaccacggcaccctttgaagaaggccttgccccccttcatctctgaagatcttcctccaagagtcgacggtgcccgtgaccctaatgtcaggctcctttgcgc

SEQ ID NO: 609310 - DNA, 512 bp, Homo sapiens
  misc_feature (9)..(9): n is a, c, g, or t
  misc_feature (33)..(33): n is a, c, g, or t
  misc_feature (216)..(216): n is a, c, g, or t
ggacaggcngagagagagaaaggagagcaggcnccatgaggaggaggaaccgaggaagataaaggagctgctgagtgtcaccgagggaagcagacggacgaaaacggccgaggcagtcccgccacatgacccccaagtcctgccagctatggcataggagaggccactccgggaaggctttggttgaaagtaagtggctgggatgtttaaacacancttaagagagaactatggccaggtgcagcggctcatgcctgtaaacccagcactttgggaggccaaggcgggtatatcacctgaggttaggattcgagaccagcctggccaacatggtgaaaccccatctctacaaaaatacaaaaaactagctggatgtggtggcacatgcctgtaatcccagctactcgggaggctgaggaaggagaatcacttgaacccgggaggcagaggctgcagtgggccgagatcgcaccactgcactccagcctaggcgacagggcaagatccgtctc

SEQ ID NO: 609311 - DNA, 174 bp, Homo sapiens
  misc_feature (63)..(63): n is a, c, g, or t
ccgtgatatttgagaggttagtaacaagattttaatctaggtcatctgagaccacagtgcccntcatcacaaacaatcctagaaaaaaattaagccaaaggagaaagttagtggaaaccacaggtctattctccatgtccatgattttcttttctgtggaaagtttcatttatg

SEQ ID NO: 609312 - DNA, 1091 bp, Homo sapiens
  misc_feature (12)..(12): n is a, c, g, or t
  misc_feature (63)..(63): n is a, c, g, or t
  misc_feature (71)..(72): n is a, c, g, or t
  misc_feature (76)..(76): n is a, c, g, or t
  misc_feature (90)..(90): n is a, c, g, or t
  misc_feature (94)..(94): n is a, c, g, or t
  misc_feature (124)..(124): n is a, c, g, or t
  misc_feature (126)..(126): n is a, c, g, or t
  misc_feature (133)..(133): n is a, c, g, or t
  misc_feature (136)..(136): n is a, c, g, or t
  misc_feature (156)..(156): n is a, c, g, or t
  misc_feature (158)..(158): n is a, c, g, or t
  misc_feature (160)..(160): n is a, c, g, or t
  misc_feature (182)..(182): n is a, c, g, or t
  misc_feature (186)..(186): n is a, c, g, or t
  misc_feature (193)..(193): n is a, c, g, or t
  misc_feature (195)..(195): n is a, c, g, or t
  misc_feature (197)..(197): n is a, c, g, or t
  misc_feature (203)..(203): n is a, c, g, or t
  misc_feature (207)..(207): n is a, c, g, or t
  misc_feature (229)..(229): n is a, c, g, or t
  misc_feature (236)..(237): n is a, c, g, or t
  misc_feature (243)..(243): n is a, c, g, or t
  misc_feature (250)..(250): n is a, c, g, or t
  misc_feature (255)..(255): n is a, c, g, or t
  misc_feature (271)..(271): n is a, c, g, or t
  misc_feature (273)..(273): n is a, c, g, or t
  misc_feature (275)..(275): n is a, c, g, or t
  misc_feature (301)..(301): n is a, c, g, or t
  misc_feature (338)..(338): n is a, c, g, or t
  misc_feature (345)..(345): n is a, c, g, or t
  misc_feature (347)..(348): n is a, c, g, or t
  misc_feature (373)..(373): n is a, c, g, or t
  misc_feature (398)..(399): n is a, c, g, or t
  misc_feature (402)..(402): n is a, c, g, or t
  misc_feature (406)..(406): n is a, c, g, or t
  misc_feature (420)..(420): n is a, c, g, or t
  misc_feature (436)..(436): n is a, c, g, or t
  misc_feature (452)..(452): n is a, c, g, or t
  misc_feature (455)..(455): n is a, c, g, or t
  misc_feature (465)..(465): n is a, c, g, or t
  misc_feature (481)..(481): n is a, c, g, or t
  misc_feature (483)..(483): n is a, c, g, or t
  misc_feature (486)..(486): n is a, c, g, or t
  misc_feature (488)..(488): n is a, c, g, or t
  misc_feature (490)..(490): n is a, c, g, or t
  misc_feature (494)..(494): n is a, c, g, or t
  misc_feature (521)..(521): n is a, c, g, or t
  misc_feature (545)..(545): n is a, c, g, or t
  misc_feature (548)..(548): n is a, c, g, or t
  misc_feature (559)..(559): n is a, c, g, or t
  misc_feature (579)..(579): n is a, c, g, or t
  misc_feature (585)..(586): n is a, c, g, or t
  misc_feature (604)..(604): n is a, c, g, or t
  misc_feature (665)..(665): n is a, c, g, or t
  misc_feature (782)..(782): n is a, c, g, or t
  misc_feature (802)..(802): n is a, c, g, or t
  misc_feature (849)..(849): n is a, c, g, or t
  misc_feature (851)..(851): n is a, c, g, or t
  misc_feature (863)..(863): n is a, c, g, or t
  misc_feature (868)..(868): n is a, c, g, or t
  misc_feature (905)..(905): n is a, c, g, or t
  misc_feature (927)..(927): n is a, c, g, or t
  misc_feature (935)..(935): n is a, c, g, or t
  misc_feature (939)..(939): n is a, c, g, or t
  misc_feature (943)..(943): n is a, c, g, or t
  misc_feature (953)..(953): n is a, c, g, or t
  misc_feature (957)..(957): n is a, c, g, or t
  misc_feature (960)..(960): n is a, c, g, or t
  misc_feature (962)..(962): n is a, c, g, or t
  misc_feature (968)..(968): n is a, c, g, or t
  misc_feature (977)..(977): n is a, c, g, or t
  misc_feature (987)..(987): n is a, c, g, or t
  misc_feature (999)..(999): n is a, c, g, or t
  misc_feature (1004)..(1005): n is a, c, g, or t
  misc_feature (1009)..(1009): n is a, c, g, or t
  misc_feature (1012)..(1013): n is a, c, g, or t
  misc_feature (1022)..(1023): n is a, c, g, or t
  misc_feature (1027)..(1027): n is a, c, g, or t
  misc_feature (1037)..(1038): n is a, c, g, or t
  misc_feature (1044)..(1045): n is a, c, g, or t
  misc_feature (1050)..(1051): n is a, c, g, or t
  misc_feature (1057)..(1057): n is a, c, g, or t
  misc_feature (1060)..(1060): n is a, c, g, or t
  misc_feature (1064)..(1064): n is a, c, g, or t
  misc_feature (1068)..(1068): n is a, c, g, or t
  misc_feature (1071)..(1071): n is a, c, g, or t
aatgtttttttntctgaggacaacgtggccaaggtcagcgactttggtctcaccaaggaggcntccagcanncagnaaacgggcaagctnccantcaagtggacagcccctgaggccctgagananaagaaantcnccactaaatctaacgtgtgnantntaggaatccttctctgggaaancaantcctatngncnaatacnatanacaagaattcccctaaaggacntcgtccnncgggtngaaaagngctanaagatggatgcccccnangnctagcccgcaccgcagtatatgaagncatgaagaacagctggcacctggacgccacatgcggnccaccancnnacagctccgagagcagcttgaaaanataaaaacccaagagctgcacatgnnacngctngcctccgcctgggnccatgggcctgtgggnactgaacctggaagancanggacctggtncccctgctcactgggncngancntnaacngagccccagcgggctggcgggcatttntcctgcgtcccagcctgcaccccnccngcacccatctntattaggacccacctgtggnacctgnngagcccactagaggggcnagggaggaaggaggccacggagcgggaggcagcgccccaccacgtcgggcttccctggccncccgccactcgccttcttagagttttattcctttccttttttgagattttttttccgtgtgtttattttttattatttttcaagataaggagaaagaaagtacccagcaaatgggcnttttacaagaagtacgaatnttatttttcctgtcctgcccgtgagggtgggggggaccgggcccctntntagggacccctngcccnagcctcattccccattttgtgtcccatgtcccgtgtntcctcggtcgccccgtgtttgngcttgacnatgntgcnctgtttgcangggnccnangcaaangtttgtcanggggttggantttgtgtgccgntgccnnccgnccnnccgccttgnnaganggaattgtanntaaccnngccannaggacnccnccgnccgnctngggggtttctccccccgaaa

SEQ ID NO: 609313 - DNA, 81 bp, Homo sapiens
gcggccgcctactactactactactgctcgaattcaagcttctaacgatgtacggggacatgccccagttgctgatctcat

SEQ ID NO: 609314 - DNA, 729 bp, Homo sapiens
  misc_feature (264)..(264): n is a, c, g, or t
  misc_feature (270)..(270): n is a, c, g, or t
  misc_feature (278)..(278): n is a, c, g, or t
  misc_feature (281)..(281): n is a, c, g, or t
  misc_feature (396)..(396): n is a, c, g, or t
  misc_feature (528)..(528): n is a, c, g, or t
gacccgcggtttgctatggcgatgagcagcggcggcagtggtggcggcgtcccggagcaggaggattccgtgctgttccggcgcggcacaggccagagcgatgattctgacatttgggatgatacagcactgataaaagcatatgataaagctgtggcttcatttaagcatgctctaaagaatggtgacattatgtgaaagcttcgggtaaaccgaaaaaccacacctaaaagaaaacctgctaagaagcaataaaagccaaanagaagnaatactgnagnttccttacaaccagtggcaaagttggggacaaatgttctgccatttggtcagaagacggttgcatttacccagctaccattgcttcaattgattttaacgagagaaacctgtgtngtggtttacactggatatggaaatacgagaggagcaaaatctgtccgatctactttccccaatctgtgaagtagctaataatatagaacaaaatgctcaagagaatgcaacattgaaaagccaagtttcaancagatgaaagtgagaactccaggtctcctggaaataaatcagataaacatcaagcccaaagtctgctccatggaactctttttctccctccaccaacccccatgccagggccaagactgggaccatggaaagccaggtctaaaattcaactgggcccacaactgcgcgcggcgaaccacaaaagcccactttttatcatgg

SEQ ID NO: 609315 - DNA, 871 bp, Homo sapiens
ggagaaataggagcgcgcaggcgcgaggtgcggatcgcagaacgggagtagcggagcgggacccgctggaatcatcatccaggacgtgccagaaaccacaagaaaacatggggagggttttcctcacgggagaaaaagccaattccatattaaagaggctacccaagagctaatgggtttttttgaagaaataagacagggcaacgattgagcgtgagtgcaaagaagaattctgtacatgtgaagaagcaagagaagcttttgaaaataatgaaaaaactaaggagttttggagcagctacacaaaagcgcaaaaggggagagtaaccgaggaagtgactggtgtcagttttaccttacctttccgttagtctttggcctcttcatgatcctcctgtgtcattttcctaatctggagatgcttcctaagaaacgaaagctcgtagacagacagtgactgaagggcacattcctttccctcagcaccttaatattatcagcccaccccccacagatgaagtgttggaccgcagggattgtctcaggttctgggatatgtagtgggcgcccagattccgttctactcggctgttccattgtgatcccgggcagctatgaggaagcgaaaggcaagtgaactggcggggagtggacagaacttggttagacccccccaaagttggggaatggcctccactcaggatggagtcatgggctgggccccctcagtacgggttttcaaccactttgcaccaggtacattgttccactacgagacataggggccgatcccaagaatggggttgaacaaagccagggggtgcgacaagcgttgggacgtttaaaaacgggagcgtgtcttcgattaggt

SEQ ID NO: 609316 - DNA, 384 bp, Homo sapiens
gtctgtaggccatcgagtcagcagccgtacgctgtcgctgaggaaggcaacagaggtgattgccacacgatgatgttgtcagtgggagtagatgacggagctcctgatcggtgccgcgaggtcgaatgaggcgggcacgtggtcgtcgatcagagccggtggtcgaatggcgtatcgcgtttgggacagaaatgccactgcagttgatgtctgattcatggccgatgaaggtctgtcggcacatggaatcccgcacgtcccacagcttgatagaggcatcacaggcgcctgacacaaacgtgcggccatcgggggccagggacagggacatcacatccccactgtgtccagcaaaacccactgtccgctggcctacagcacatg

SEQ ID NO: 609317 - DNA, 354 bp, Homo sapiens
ttcagaggatcctacaaagaaagaaaaaaaaaaacatattgggtggacatcagaggtcctggtccgtaagaaaatatttttggagaaagaaagatgctttggttcagggctacggagctgccctcaggcagtcactgaggatgcttttggtagtttaagaagctaagacatgagagaaagggcaggagtccggcccctcctcagagaaaatctgagcagcaaattagggatttccattccattgggcaagtgaggtccttttttttttttttattttaaatatcacgggggctgggtgttaacggggttaactcgtttaaccaacctcgaggaaccagacagggattgtggggg

SEQ ID NO: 609318 - DNA, 872 bp, Homo sapiens
caatttgcatgctttttattactttctcttgcctaattattctgagtagaaattccagtgctttggtgaatagaagtggcaggaagggatgttgctatcttattcctgatcctagaggaaaagattttagtttttcaccattgagtatgatgttagctgtgagcttttcatgtacaatctttatttactgaggagtttccatatattactaattctttgagtctttttattacaaaagatgttcatctggctctggaaccagataaatgttgacctgatagaatggattggaatgtccccttctggtttttgaacattttggaatattttgcggaggatcggcattaattcttcttgaaatgtctggtaaaattctccagtgaagttatctggacctggaacttttcttacccgggggggtatccgattactggttgaatcttcttactagttacaggtctctttggatccttcatttctccgtgattcagtatggtggtcagtgtctctaggaatctataacatttattctaggttgaccagtcttgtggcataccggtgctcacattagtctcttgtaatctttcttcatttctgtggcaatctgtgtacctgtcaacctctttcactctactattccagtacttcgacgaatttcctccttccccccttaatataagctcataagttctcaacaactggcaacttgatccttccatacaaacacgctcacgagtgtgcttctctcctcgctttttctcccgtgcgcaatactctcgtgcacactcttgcctcaacctcgctcactctacccatcccctctggcatgggaagtggcactcacctccttccaccccccgcaaagccgcacg

SEQ ID NO: 609319 - DNA, 780 bp, Homo sapiens
gtgccggtcagggtgtgtggagccgcctagtatgggggtctggagctaatcacgtgtatgacttctcaggtgtcaagtacgggtgaaacatgctggtaagcttgaaattaccatgacagtggaacaccacagaaagtcagacaaatagtataaaccggaatcgcgtctgcccctgtcctagacccgtggagccgggtgttgaagatatttatccagtagatcgattatgcactcgcccatccatatatgtactgcccagaggaaacaggaaatacgtcctttagcatagtaactcatgtcattgtgccacatgcactccgtgttggaattctctgttggtggtttttcatctaaactcagagttataagccaatggatagggtcacaagcctctatgtgatcatgctcgtgtgcatggagcgatagtggatacctagtgaatctttgtacatgggtaggtaagagatgggttgggtggatgagtagatggatgggtgagtcatactgtgtcatttaataagttgattggggtgatggcctattaagatcccgccttttgcaaataatggaagtacttaagactatgcagtttgttgagacttataaagcatgcggaggagttccggagctggacagaggtctacttaggtatgggtatcaggattatcttctaggtatatgaatataagtgtggggtcctggtatgagggtgaaatgacggttttggagggaacaggcagatggccgggggtgtggacgtgggaaaaattcccaggggtt

SEQ ID NO: 609320 - DNA, 451 bp, Homo sapiens
  misc_feature (32)..(32): n is a, c, g, or t
  misc_feature (439)..(439): n is a, c, g, or t
acccccttataatatatttttcccctacaccntaccatcccccttgataaagtttaatttataaattagggcacagtaagagattaacaataataacaacattaagtaaaatgagttaccttgaacgcaagcactgcaatacccataacagtcaaactgattatagagaaggctactaagtgactcatgggcgaggagcatagacagtgtggagacattgggcaaggggagaattcacatcctgggtgggacagagcaggacgatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacncacctttttaag

SEQ ID NO: 609321 - DNA, 922 bp, Homo sapiens
gtttttcacgccggccctatatgggggctggccctcgtgaccgcgctgttcccccccgaggtttttggcccccgccaatgggcccccccatgcgcttgtgccaaggaaggtttcaccaagcattgggcccacgaggatgtggaccacatgggggtgaacccacaggccgtggctgcggaccccgcacccccgctggttattagggcattctacggcccgatctatgttgacaccgcgcccccatcggtctttcatggagcgccttccctcggtgtagggtgctctccccccccagcggacattaatctggcgccgccgcctacatcccgggtgaccataccacgcccgggtttgctccaacaccgttcaccagcgtccctgaagggttgttttgaacaaggtgctcacgcaagaaaaaacaccttgcctataccaaagagaccgcgtaatctagaggattctccccgcggttgctcctgactgacgacaaaatatttgggggcgcacggacccacttaaagacagcccttctcgtgatacggccgagagaacacccaccacaccccttgtgaaaaagaattgccacccctcccgggcccgtttttctcccacccgctacaacttcccgcagacccaaattacatatccctccccaccacccctttgtaccaagactcttctatataatgggaccccttacccccttccccctttaaactgggaacataccaacatgaacagcccaacaccgcgaggactcccaacctctctccccccctttatctttggtcactactgaacgccttgtatctggccccctatatataaagaatcatctcttgaaaccccctcctgagtcatacacaatacaaaatcattcttcccccaagggaccccaaaagggcccacagcccccaaaaca

SEQ ID NO: 609322 - DNA, 325 bp, Homo sapiens
ctagttttagaagttcatagcatcaacagcatggggtgcaaaaaaaaaaatctacattaaaacccttggtgggaaggcttaacgcttccacagaacagaaactaaaataaccggttatacaattagtcacaaatacagtcctcgagtttttggcccatacacatgagtattggtctaaaacatgtcttcttggtagcagctaggcccggccaccacggtgctgggttgagttcacaaatctgtggtaaccggtagcttcccggtcacttctcgggctctcctctccggctaagcttggtttcctaattaaaatcttcggccacgg

SEQ ID NO: 609323 - DNA, 253 bp, Homo sapiens
ccagattaagagatgagatgggaaagttgctgagacagaaagcctagggaaactttaggctagatacgaaattcacacagtggaaatggcacggactctggggagactggtgaaggtcctcagccattcagcaccatgcgtgacgagctctgcctcgtggatccgatccatcggtgtggttatgccttgccaccgctttctcgtgggtatccatcctatagtcgtactgatggccatgccagccatggtctcg

SEQ ID NO: 609324 - DNA, 189 bp, Homo sapiens
gccgagtcttcgggcagctgctgtgccagcatctgctggtcatttcgccctgacagtcccaaccagaaccctgggacttgaatccagagacgtgcgtgcaggaacccgtcaacggagctgtgaattaagaggtttcctcgtttaaacctgtcttgttggggccccagatatcctcacctcagggcctcc

SEQ ID NO: 609325 - DNA, 210 bp, Homo sapiens
ggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatttccccgttttaataaccccttccctttaaaaagggggaaacttttaaaattaaccttgaggctttaaaatttggaccttgccctttttttaaaacctgggaat

SEQ ID NO: 609326 - DNA, 756 bp, Homo sapiens
gaagaggataatcgcagcgagaccgcatcatctggatatgcttcaggtcaacaggtaacagatgaaccgcctctggaggaacacgtgcagggcaacaaatgaaagtctacagctggtaaaccatgaagcaaattctgtggcagtggatgttatgcctcatgttgacaacccaacctttgaaggaagacgaaactcctaatcaagagactgctgtcgtagaaattaaatcttcaaaatctgtgtaagtagaacaacttgaaccattagtaataacagaactgccaatcagggcctagtttctattactaaagtgggagtaaattgtaataaaataacgagtgactactgaaatgtgctcagatgactaatattatgctatagtctcaaactggctggaacaatagtttaacctgtgaggcttttttccacaaactcatgataatatttttcataggcaagtttcctctcagtagtgataacgacattttgagacattcaaaactgtcttcaagaacgtcgcgtttgcatttgataacaattgttcttatagaaaacatgttgcttctaaaatgtggagtagctgtaaatcgcttactccatgatagtatcttaactgaaaaatactacttcttcgccttggccactgtgtcaggttcttctccgggctatatggtccgaaggatgtacccgcagcattaggcagaccttgaagcaataagcggtagtactcaaagttccacaacctctactccaaca

SEQ ID NO: 609327 - DNA, 164 bp, Homo sapiens
gcttattgggtgcatgcatgtgtatcaggaagttaaagaaacacatataaaactcccaggaataaaggtgagcacagaccctgtttaggatcaagtcagttcctggagcctgaatgatgactgctgaatcacgggaagccacgggtctgtacccacaggctgca

SEQ ID NO: 609328 - DNA, 110 bp, Homo sapiens
taggtacttaaggatccggaggaacatctaagccatacagtgaggagaagcaacagagcctgtctgtcccatgagcggagtctgtcctctgctcttctgcagtcaggtca

SEQ ID NO: 609329 - DNA, 682 bp, Homo sapiens
agagaactagtctaagttttttgttattgtttttagtaaaaacaggtttcaccgggttagccaggagggtctcgtgcggacttggtgatccgcccgcctcggcctcccaaagggctgggattacagggcgtgagccaccacaccgggccccggcacgttatcttttaaggaatgacaccagttccgtgggcttcgtgaccaaagaaaaaagtgtcacaggagacttgtgaagaggcagacagggaggggtgggtggcagcaacacgtgcagcgtgcttcgtggatgctgcgtgggggtgctctccggagcggggtggtgaacagcgcacttcaacagtgagcagggcgccgtggctccgggtggtgtcctcacttcagggggtgcaccgtgggttgggggaagccagccttgggggcaggaaaccagctcagaggagggtacccagctcagctgctggcaggagccaggtttttacagccataaggggggttaagaaaaaacacgttctgcaagaaactctcctacaccgtcgggagaacgggggctcctatgctggggatagagcttcactcaacggggagatgggggtggacgggtccctgaaaagcgggccttgcagggccaagtggaggcctcagggcctaacccagggcctctgaaagggggtgtgcagcaagggac

SEQ ID NO: 609330 - DNA, 619 bp, Homo sapiens
  misc_feature (361)..(361): n is a, c, g, or t
atgacaaggcactgggcactggtctgcacgtctgagcttggcgctgtgtagcagcgtgaagggtgtgcaggcgtgcaggactggagttcatctccagaactgagagagggcctcgggcatgaggcatccagtgctaggcttggacaggtacagcggagaggtacggagtgcgtgtgtgcagcgcctggtgggaatgcggagacccgtggacagagcttgtcagagtgtcctagagccagggggaactccaggcagcgcaaattgtgccctggatgttgagaagctgcgtaacaagtactgagagaacaaaagcttgtgggtcagcaggccccacaaagatgttactgcagacaggatcggncctgggagagaccgaggctccaggtgactcctatagcaagccggtgaaggggcgggtctggggctccagttcaggaatacatagtcagctgcagccactcctggatgttcacctggatttgtccagtgccatctttgtcaagagatttgaaggcacgaaacattgcgtccagcctgaccgagcagctgatgaagtgtcaaaatccatgttccactttcatctgagtagcgtcgcaaatcatgtaatagagatgtcatc

SEQ ID NO: 609331 - DNA, 313 bp, Homo sapiens
aggttttagtttacttagttaatccttaggtttggacattacaaggagacaatgggggtgaccatagcaattttagctgataaatgtatcagaaactctttcatcattttctgtcccctcctatcttaggctgaccggttccctgatgtgttacctgcttctgctactgatccaaactgcagacttctcattcatcccaaggcctccagcagtatccatgggaatcagctctaaaggaccagacacgtttccagcccttcatctggtactagggagagatggagggtatctgtctagtgatgaagaacaactg

SEQ ID NO: 609332 - DNA, 200 bp, Homo sapiens
tgggccctaagacccctggcagaacccagcctttgctcacacccgccccagcttttgccccggcttcagtcagggccaggaggaacacgtgaaggagaaaaagaaatgcaggaaccgcggggctcccggttccttgggaaaagggtgcccattggacctttggccctggatgagccaataaaccaaactctggcccctca

SEQ ID NO: 609333 - DNA, 276 bp, Homo sapiens
  misc_feature (20)..(20): n is a, c, g, or t
  misc_feature (23)..(23): n is a, c, g, or t
  misc_feature (25)..(25): n is a, c, g, or t
  misc_feature (29)..(29): n is a, c, g, or t
  misc_feature (55)..(55): n is a, c, g, or t
  misc_feature (57)..(57): n is a, c, g, or t
  misc_feature (60)..(63): n is a, c, g, or t
  misc_feature (150)..(150): n is a, c, g, or t
  misc_feature (169)..(169): n is a, c, g, or t
  misc_feature (180)..(180): n is a, c, g, or t
  misc_feature (183)..(183): n is a, c, g, or t
  misc_feature (188)..(188): n is a, c, g, or t
  misc_feature (225)..(225): n is a, c, g, or t
  misc_feature (244)..(244): n is a, c, g, or t
  misc_feature (246)..(246): n is a, c, g, or t
  misc_feature (269)..(269): n is a, c, g, or t
  misc_feature (272)..(273): n is a, c, g, or t
tcttcaaaaaaatgcataanagnanttcnactcatgtgcatgccacacatttccntngcnnnnccaccctgccccacgcctctacaggcacacatatgtcacacaccaaagggactccttcctgtaactggggaacagaagtgtaaaagnatccatccaagtggccacngataccagaantanccaantgcatttacgctgacaaaatcagtcaatttacatgcncaagggggggcgtctgcantnggggcttggggcggagggggttnggnnggg

SEQ ID NO: 609334 - DNA, 1081 bp, Homo sapiens
taaaaaaatttattaattaaaaagggggaaataggtgggagtacccttttcttccccaacaaaacaaaatcttaaagagccaacagcaaataaaaaaaaaaaaaaaaacacgcggggcgcgggttccacgcggggaaccaccccctgtgacgtgggagagcaccagagaaccccgccacccgcccggagggagagcggggggggcggccgggccccgcgggggggtgtggcccacaaagaaacccccacaacacagggtaaaacgcgtcgggatataaaaacaaaaaataaaacgccccccatgtgggcgggggcaaagaggaaaaattgtggcacaaaaaaaggggtggggcgcgggaggagaaaaaagaggaaacccggcggcgcccctctctcaaaaaggagggcggtgtcgcacaaggtggcccccccccagggccgcccccaaaaaaacccccgcggtgaggggtggggcccccccggagggagtccacgaggagaaagccgtggggaaatagtaagcagggcggggggaaatcacaccttaaaaataacaatgtgagggggagagggggcgccccaaaaggccggcaaacccccccggggggggaaccccccccgtcggggggccctcaaaagggccccccgcgggagagaaagaggtccaaaaaaaaaccccttgtcagaattcccccgggacagaaccacccgagacaaaacattaatcccgcggtggaacacatttctgtgtgcaataacaccccccggggagagaaatcctaatcaaaaggcggggggcgcacaagccgagaaaaaggcacccccgggacaaataaaagggcgggacggaagaacaaccacagaaacaaaacccccttacgtacttccccgtaaataaccctccgaggggaggaaataaccccgagaagggtgcacaggcgggcaaactgagagcccataacccaaattgttccccggggcaaaaaacttgtcgggggacaaaaagccccccgtttaataaaggggtgaccctaaaaacggcacccttaaagcccgttctccccggggagactaattcaac

SEQ ID NO: 609335 - DNA, 201 bp, Homo sapiens
aagaggggctagtcagctcaggttggtctagagacaggtacacagcagataccattccaccttactctctaaagaacagggcagcacacatataatcctttcctactttactaatgtattccttatgtggtaccagcaatggaggacaggcagaattaacccctgccatctagagagaatgttgttattacccgtaaaact

SEQ ID NO: 609336 - DNA, 839 bp, Homo sapiens
gacttacagagtggggacgtccgggttcgggagcgggagtgctcgtgtgccagcgactaaaaagagaattaccatatgggtgatgttgagaaaggcaagaagatttgtatatatgaacgtgtcccagtgccacacggcgcttgataagggaggcaagcactagatgacttgggccaatatctccataggtctcttttgtcgcggaagacaggtcaggcccctggttactcttacacagccgccaataacgatcaagggcatcatctgtgggagaggatacactgatggagtatttggatgaatcccaagaagtacatccctggaacaaaacttgatctttgtcggcacttaagaatgaaggaacgaaagggcagacttaatagcttatctcaaaagagctactagtgagtaataatgggcactgccttgaatttattaccataacagaagtgtctcatgactttcttatgtgtagccatcctttagtagatctcatagcaccagaagtcagatcatgagtgactggagcgaatatcaggtggtggcagtcctgattgataattaagactgctgtgtggttaaatgatatgttcatgttgggaaggtttaatagtaactccaaattggggacatgttttctctgtttactcctttcaaagatatgataggcttcgtaatgatgttcctgttttgcacgattgggtgtgctcttagacttctggggatgtatttagagtttctacgggccgtcacatttacacgggggtggtccggtttaacacgaatgccggttgggacggctggctagggaggggaaaaaggcggtcgtgccattacca

SEQ ID NO: 609337 - DNA, 437 bp, Homo sapiens
  misc_feature (39)..(39): n is a, c, g, or t
tggggcctttaaattccccccaagggtttccaacacccnaagtttcctccttagaaagaatactcctaagatgcacctaaactttcccccattcaccttcctgtcctaggcaggaagattcctactcaagttaagaagcagtgttgcccagatgcagtggcctcactccctgaaattcccagcaatttgagaggccaaggcaggaaaattgcttgagctgaggagttcgagaccagcctgagcagcatagtgagaccctgtctctacaaataatcaaaaattaaccagacatggtaatgcatgcctgcagtcccagctactcagaaggctgaggtgggaggatctcttgagcctgagaggttgacgctgtagtgagccacaattgcaccactgcactccagcctgggcaacagtgcaaaaccctgtctcaaaaaaaa

SEQ ID NO: 609338 - DNA, 278 bp, Homo sapiens
tggccggctctctacctcagaggtcggggcactccagccctgaaagccccaggtgtacccgaatgggcagcctctcactactcttgtctgggctaaaaggaatctaatcgggtggagggtagagaccctgagacagggggaggggggggggacggccaagccaccctaagacctggggaggacaactcagagagggtcttcgtggctcagtcagtcaagttcctcggagatctggctcggcctcacctaccccagggaacttccagggtagagagccg

SEQ ID NO: 609339 - DNA, 373 bp, Homo sapiens
ccttccttggggttggatgctctcatgcaattatttagtactgttcctgccttttagttcctgatgtcacagcccctaagtctacttagctagtgtctgcatctccacttggcatttgctaaaaccttccatgtcgagattcagctagtggccaacagatgctttgccaggagccctttatcagtttctcagcatcttaacgcatcttgcattgcaccctggatttgtatacattcttcctgatcccatttgtatttttccgtgatctaaaccattgtgcattctatagtgcatatctgtatattgtgcctgttcacaggatcgtgagcactgttagcttatttctctttggatgtttgttattattatcagg

SEQ ID NO: 609340 - DNA, 459 bp, Homo sapiens
ccccgtattactctttgcctgcatgacaggcttttatttggtgtgcagaaatcaaatatatgtttatctcactgtataaatgagaagctccctccattttcactccatgtctttttattattcccctctttcttctccagtactgtgcattttttatgtttttttgttttgtgaaattccactggcttaaactaatccattttggcatattttacaaattctagtatcttagaattgaaataaagaaggacaaaagatagtaaaaatgtgactgagagagagagagagagctgtttaatgccatattattaaatgcaagtcatttcttagaagagattctgcatttcattgtaagagaaaaagcctttgatgcgtcaattatcttttgtataccagtgcatctttggatttccacagactcatttgaattgtactgaaaaaataaattcttatagggta

SEQ ID NO: 609341 - DNA, 234 bp, Homo sapiens
gtgaatgagactggatgtagagacatagggtcacgtacgagacttctggtcagaggagagagactgaattggactaaacccgtcctctgttcccagcacgtatctcatattgccctcagtcactgaggaagtcccccggaggatgggagaggcacattcccttgggacagaggctacaggttggagctttttttcccctgtctcctaatcccattcccaccattgcctcgtgcg

SEQ ID NO: 609342 - DNA, 450 bp, Homo sapiens
  misc_feature (67)..(67): n is a, c, g, or t
  misc_feature (102)..(102): n is a, c, g, or t
  misc_feature (252)..(252): n is a, c, g, or t
tagaccactgttcgtgaccgggagatgcctgaagctttggagtttaacctttctgccaatccagagncaagcacaatattccagaggaactctcaaacagangctttggagtttaacccttctgccaatccagaggcaagcacaatattccagaggaactctcaaacagatgttgtagaaataagaagaagcaactgtacaaaccatgtatctactgtgcgtttcagtcaacaatacagcttgtgttcgacnatattccttgatgacagcacagccattcagcattatcttacaatgactataatatctgtgaccttggagatacctcatcactatcacactaagagatgcagatagatcattgagcatacctgatgaacagctacactcatctgcgacaggtatcaccatgtagaccaggatggtctgaactcgagacctcggatccac

SEQ ID NO: 609343 - DNA, 1130 bp, Homo sapiens
cgggtgtgttccacgcggccactgatggtgtgctcgcctcctggtgttgtgctgtgaggggcgccgcggggtgacccccccatggttgtcgtgtgctcccgcgggggggcgccccccacagactctggggggagccccccttcttcctgctggagcatggtggtggtcctccgccctttattaacacccccccttctttgtgtgggcaccgccgccgttttttgtgggggggctctcccccgtgtggctcctccggaggagaagattgggttgtccccacaacacgggggttttatggccgcgcgtgctgactattttggtcctccccagggccacttgtgtgggccccccccttttcgctccctcccccccctcctctgttgtggagtggccccccccccgcgtggtgcgtcgtcgccccgcctcttatatacatcccgcgcggtcttttttctccggcgcatatttttcgtaccacccgggggttttttctgagagtatttctcgcgacacactccttgcggcctcccctgtgggcgggtgggttctctcgcgagttgtgtcgcccccccttttttccccccgcgaggcgtcttgcccggcgctcacagggccacacaggagggtggcgctgtggtgtgaggatttttctcccgcgcatccctccacaggagggccggctccggggcggtgcactcgcgggaactatcttctctccgcgcgggttttctacccgcggaaaattcacacgcctcggtcccccgcgcggtgggaggccccaccaccccaggttgtttctcttcctcgtgttctccctcgagggggacaccctgttggccctgggggggccccccatctgtcccacgtgtgaccaccccggcttccacagagaggattcacactctgcccgttgccctcttggaattgtggggacaaccactgtgggggccccacaaaggtgcaccaatttcgcaaggaggaactccccccagttataactctttgccgcagaagcccaccctcgtgtgcccccccgggggggcgccccccccccccccggggggttttttgagaaaaaattttttttgtgtttttttccaaaaaaagggtaagccccccccctgtggaca

SEQ ID NO: 609344 - DNA, 211 bp, Homo sapiens
  misc_feature (150)..(150): n is a, c, g, or t
  misc_feature (193)..(193): n is a, c, g, or t
  misc_feature (211)..(211): n is a, c, g, or t
gcaagggcttgagtggctggggggaatcatccccatgtttggtccagcgaactacgcacagacattgcaagacagactcacgattaccgcggacgagtcaacgaagacagtctatatggaactgagcagtctgagacctggagacacggnccgcttcttctgtgcgaaacatgactactatgacaccagtggntaatttccccttgacttn

SEQ ID NO: 609345 - DNA, 179 bp, Homo sapiens
taatcacaaggtaagtgtgtattcaatggtcttagcatattcagagttgtgtgaccagtcgctacaggtgacttgtaggacgtttttatcacgtgctaaagaggagagctcaatctgttcagttcctcccatcccgaagcaatcacgtaatctacttcctctatatggagatttgctta

SEQ ID NO: 609346 - DNA, 794 bp, Homo sapiens
taccacgtcctactgtagcttgttcgcggtcacacttgtggtggggtgacgactccaccccacccgcccgcgctgtgttttgtagtagctcgctcgcgtgtcggtcgtcgaatcttctagttttccccgcagcggggtggttggcatacccatgttcggtgtcttccgcccccccccccctgtcgttggtttcatcatgtgtgctggccgtgcgtgccgcgtgtccctactcacacgaggatccagccgcggacccctcgtgcgggtgaggtctccccttctttggtgtggccgctttccttcactccggcggtgcgcttccaccacctacaatagtgtctgttgtgtcgcccccacccgatcgtggtgtgttctctccccccttcttcgttctccgccccccctccccgtggcggaccccctcccttcggtgggtgggagccccaccagttagtctgtttctcacgcgctgagatagagacgcgccccgctgctcccctccttctcctctcatatctgcagctactcccccaccagagaggagactcgttttttctctctgcctgtggtgtgtgctctcttatccttctcctcttgcggtcgggagggctgtccgccctccttgttgctgccgccctgccgtcagccccggctgagtgccggcggcggacagcgactgacgtacacgatcaccctcccccgcgccccccccccccccccctctgggggggggcccccccccccccccccccccttttttttaattattttcccccccggggtttcccccccca

SEQ ID NO: 609347 - DNA, 476 bp, Homo sapiens
  misc_feature (87)..(87): n is a, c, g, or t
  misc_feature (167)..(167): n is a, c, g, or t
  misc_feature (182)..(182): n is a, c, g, or t
  misc_feature (203)..(203): n is a, c, g, or t
  misc_feature (218)..(218): n is a, c, g, or t
gtacgggaggtagttttttatttcctgccaaaggatagcagaagctgtacctctgtctgagttctgtctcttggcttgacacccttnagaggaattcctgcctcttccatgggtcaggaagaggtgcctagttagtttcttctgggtgccgagttaattccttcccnccaagtgggtttaanccctggaaggagtgtcttggngccagggtgcagtgngcgtttggtgctgagcatggacctgaaacttcgtgtgtggtcagatttatgttccatgcgtggggatgtgcaccggaccaggtatgtgtgtaggtggacatggatgatgaggtgtgtgtgctgtgactgtgtgtgcaccctttgctgcgtatgacaagcaggctgtgtgtgtaggaccaggaagctgtacttgtggccaggtatgtggctatggactgacgagcttgtttgttgaacacttgctcagtgccaggcatc

SEQ ID NO: 609348 - DNA, 835 bp, Homo sapiens
  misc_feature (6)..(7): n is a, c, g, or t
  misc_feature (9)..(9): n is a, c, g, or t
gcctgnncngacacgaagatgaccctcgacagccgccgggcgctgatcaccagggaaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609349 - DNA, 342 bp, Homo sapiens
gaattttattcaagtccaacctgcagggcaacaactcaacacagccattcctgctctttcaggagaagccacaagtgtgggaagacaggcagctaagtctagggcacagacaaattagtcatactgtctgcttagatcctgagggcctgcgaaaccctcaaggtttcctggtgtcatcttaaggtgctagttattccattctggctgccttttgattcatttggttttctgcccacaggcaagcagaggcgaaaccaacctgccaactcttacctcaaacccattgagagagacctggggatttcctagggttttatttttacctattgctccccaaacaga

SEQ ID NO: 609350 - DNA, 938 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtgggcggcggggaaaggtgggcaaaggccggcggcgggcagaggcgggcaggggacgccttcactgagcccgctcccggcaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609351 - DNA, 1308 bp, Homo sapiens
  misc_feature (1)..(1): n is a, c, g, or t
nctctcgaaaaaggacgaggagcgtactgctgcgagttccctagcggcggttcttcgatctctctgctccgcgtctcgccagccttactatgtgctgcgtgcggtgtcttttctctgctcgctgcctggaaccacgtttttttgtagcgctgcggtcgtgcgtgctggtccgctgtttattctctacttattactcgcgattgctagacacctttgatctctcggctctttggaagtttgatcggcgggtatcttctggcgtgcgtcgctcaatgtatcaccggcgtgtgtgaccgatcacctgtacgtgcatgcctctgggggtttcgaatttgaggccccctgctactcttggtacttactctcttggtttggttgttccctcgttcagctcgcctgctctgtacaccttcttcgttgaccccagccgtttcttctaataacctcgctactatttcgccctaggtctactggatatctatttgtctgtgcggttttacgaacctcggtccgattctacggttggtattttttcttggaggcactgttagtggtattagcttttctctagggctacccctatattatgtttgccacttttgagcgtactttggtactactagacattgtttcactgttttgggagtgctggaggctcaaggtttctggcagggccattgctcctctctgggggctatctaatgtgttgggtcctgttcctaggcctctgctcctagcttctgtgagtagttccttgccttgtggcacgcgttactcctgtctgcacatagcattctgcctgcgtgcttgtctgtctgtgtgtccataattttccactttgtataaggacatctatgtaatattagaatagggcccatcctaatcacctctatttttctatcttgattttctctgtaaagaccctatctctaagttaaggtctacattctgaggtattggcatattaggactcataactatagcttttttattttttggaggacagttcaacccacaacagtaaggctggtttgatattctaaaatcaactactgttaataagtatatcgaccaggcgtcatgtggctcactgcctgtaatcaccagcagctttgggagggccaacggtgagcagatcaccgaggtcaggagattgagaccatcgtgagctaagcaaggtgaaagccccgtctcgtactaaataatacacaaaattagccgggcgtggtggcgggctcctgtagtcccaagtattcgggaggcctgaggcaggagaatggcgtaacccgaggcagcgagctgagatca

SEQ ID NO: 609352 - DNA, 307 bp, Homo sapiens
  misc_feature (201)..(201): n is a, c, g, or t
tgccccacacagggctctccatgatgggaagcagtggttagtggcttcataggccgtagtctgacatcgctccactaggctaaggggtgtcctaagagtggctcccccgtgtattccccttcccagtgacagcccctgcccagcataaaatcccaggaccctggtctctgcagcgcctgaggcagggtacttattgagtantagggatcgtgtatctatgctagacgtcccacagttcgtcgcgtggtctctccttttctgaatactaataggattgatagaactggtatagaaagaaaaaaaaaag

SEQ ID NO: 609353 - DNA, 758 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609354 - DNA, 1013 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtgggcggcggggaaaggtgggcaaaggccggcggcgggcagaggcgggcaggggacgccttcactgagcccgctcccggcaggtatagggcgcggcacggtccaggcgctgcacgcgacgggcgcgcgggtggtggctgtgagccggactcaggcggatcttgacagccttgtccgcgaggtcaccagccccagtccccagctgtgccgcttgctgggcacagagcctctggtaactgccccctgatacacacagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609355 - DNA, 1493 bp, Homo sapiens
  misc_feature (815)..(815): n is a, c, g, or t
  misc_feature (818)..(818): n is a, c, g, or t
  misc_feature (820)..(820): n is a, c, g, or t
  misc_feature (835)..(835): n is a, c, g, or t
  misc_feature (843)..(843): n is a, c, g, or t
  misc_feature (845)..(846): n is a, c, g, or t
  misc_feature (852)..(852): n is a, c, g, or t
  misc_feature (854)..(854): n is a, c, g, or t
  misc_feature (877)..(877): n is a, c, g, or t
cgtgggcctgccgtggtgcctggtcacctggggcatggcaacatggttgggcgtgcgtgggaaacggtggggcagaaggcctgtgcgtgcgtgtgcagatggcggtgcatgtggtgactgtccttcagctgatgccctgctcccgtgcagtgtatagtgtgctgctgtgcactgtgttccatgtgctgctttgcactgctgactgtgtgctgctgcgtggtgtgttggcttgtgatgccgtgactcagtgcgggatcttgacatgccttgtccgcgagggtaggtccctgccggtgtccccagctgcttgctgatgtgctgtgctgatgcgcatgtgatgtgggtgctgtgcatgcagatgctggtgggctggtacctctgttgcgctgactcccgcctcccctcgcgggcgctggcttctcaccgcggctgggcgcccgcgcaccctctctcggggctggtggcctgcgtgggcggccgggtggtcggcagagccgccggggcccccgggctcagaaagaggccgaaatggctgcgaagcaggccccgggcaggagtcgctcgggcgcagggaggaagtgaaccggccggaggtagcgcccggctgctggccccacagtcccgacaccttcggaactcctaactcctttacttgtccggctgaaaggtcaccagccccagtccccagctgtgccgcttgctgggcacagagcctctggtaactgccccctgatacacacagtgcccggggatagaacccgtgtgcgtggacctgggtgactgggaggccaccgagcgggcgctgggcagcgtgngcncngtggacctgctggtnaacaacgncnntgtcgncntgctgcagcccttcctggaggtnaccaaggagggcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609356 - DNA, 700 bp, Homo sapiens
aggaagagtaaatgggctccgaagtggcatattaacattataattccattcagctggcatgcagcggcgtgatctcggctcactacaacctccacctcccgggttcaagcgattcttctgcttcagccttctcctgagcagctgggattacaagtgcgcaccatcatgcctggctaatttttgtatttttaatagagacggggtttctccatgttggccaggctcgtctcaaactcctgacctcaggtgatctgcccacctcggcctcccgaagtgctgggattacaggtgtgagccactgcacccagcctaaagagaatattttctcaattaaaaatactatagtcttcagaaaagaatcaattaaagtgatgagaaatttcaaatatattaactacaaactgcaactttgaaaaatattgcaggcaattttattaagttctacagacaaatgtcagtaacatggtattagaaataaatatagctgatcaacagattaaagtttatgaatatatacccagaataattattctgctttgtagttttaattttggaaaaccattttgaaaagtttgctactgaaatggtattttttaaagaaatttcctatttcgaaaaaacgttcgatcatataactgggaaagattttcaatgccagtaggcccatttttctgatcaatagaaattttttaaaaggaag

SEQ ID NO: 609357 - DNA, 1208 bp, Homo sapiens
cgtgggcctgccgtggtgcctggtcacctggggcatggcaacatggttgggcgtgcgtgggaaacggtggggcagaaggcctgtgcgtgcgtgtgcagatggcggtgcatgtggtgactgtccttcagctgatgccctgctcccgtgcagtgtatagtgtgctgctgtgcactgtgttccatgtgctgctttgcactgctgactgtgtgctgctgcgtggtgtgttggcttgtgatgccgtgactcagtgcgggatcttgacatgccttgtccgcgagggtaggtccctgccggtgtccccagctgcttgctgatgtgctgtgctgatgcgcatgtgatgtgggtgctgtgcatgcagatgctggtgggctggtacctctgttgcgctgactcccgcctcccctcgcgggcgctggcttctcaccgcggctgggcgcccgcgcaccctctctcggggctggtggcctgcgtgggcggccgggtggtcggcagagccgccggggcccccgggctcagaaagaggccgaaatggctgcgaagcaggccccgggcaggagtcgctcgggcgcagggaggaagtgaaccggccggaggtagcgcccggctgctggccccacagtcccgacaccttcggaactcctaactcctttacttgtccggctgaaaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609358 - DNA, 223 bp, Homo sapiens
cgaacaggacaagcaagtagatcagcggagagggttagacccagggcggaagaaaactctttatgtgactcttgccattgcgcgccctcctgcttcttgccaactgctacccaccaacgctaagggtattgctacgaatacttgcatgcgtgcctttgctctgcaacctaagatctggcaatgatgcaccctgctatccctgccctaggctccaaggggaagt

SEQ ID NO: 609359 - DNA, 376 bp, Homo sapiens
  misc_feature (173)..(173): n is a, c, g, or t
ttaccagtatagataatttactcttgtatttttagtagagacggtgtttcaccatgttgatattagacccatatcaacatatgcttccctggctgggtgtggtggctcacgcctgtaatcccaggcatttgggaggccaaggcaggcggatcacctgaggtcaggagtttganaacagcctggccaacatggtgaaacccccatctctactaaaaatacaaaaattagctgggcgtgatggaaggcacctgtaatcccagctactcgggagcctgaggcagaagaatcgcttgaacctgggaggcagagattgcagtgggccaggatcatgccattgcactccagcctgggcaacaagagtggaactccacctcaa

SEQ ID NO: 609360 - DNA, 932 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcaggtgagctgccctgtgggctggacgggaattctcgtgagtgatgccagctctgcctcacggtctcgctgcgattccagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609361 - DNA, 208 bp, Homo sapiens
  misc_feature (178)..(178): n is a, c, g, or t
  misc_feature (199)..(199): n is a, c, g, or t
tatgctgcaatagaaaacattgaaaatatgcttacttcagagaataagtcattgaaccccaatacttcggctggcatacttattcagaaaagtaatagaggagcagtggaaccagcagttgaaaagataagcatcagtggcggagtagattgggcgaatcagtttgcagatttataanacctggtcactagattttttnccttcgaga

SEQ ID NO: 609362 - DNA, 129 bp, Homo sapiens
tatttactggcacctcccagctcccacctccccacttcagttccccactccttcttctgcagttcccacctcccagttcccacctgccagctcccacctctttcctcgcagttcccaccccccactgtt

SEQ ID NO: 609363 - DNA, 1492 bp, Homo sapiens
cgtgggcctgccgtggtgcctggtcacctggggcatggcaacatggttgggcgtgcgtgggaaacggtggggcagaaggcctgtgcgtgcgtgtgcagatggcggtgcatgtggtgactgtccttcagctgatgccctgctcccgtgcagtgtatagtgtgctgctgtgcactgtgttccatgtgctgctttgcactgctgactgtgtgctgctgcgtggtgtgttggcttgtgatgccgtgactcagtgcgggatcttgacatgccttgtccgcgagggtaggtccctgccggtgtccccagctgcttgctgatgtgctgtgctgatgcgcatgtgatgtgggtgctgtgcatgcagatgctggtgggctggtacctctgttgcgctgactcccgcctcccctcgcgggcgctggcttctcaccgcggctgggcgcccgcgcaccctctctcggggctggtggcctgcgtgggcggccgggtggtcggcagagccgccggggcccccgggctcagaaagaggccgaaatggctgcgaagcaggccccgggcaggagtcgctcgggcgcagggaggaagtgaaccggccggaggtagcgcccggctgctggccccacagtcccgacaccttcggaactcctaactcctttacttgtccggctgaaaggtcaccagccccagtccccagctgtgccgcttgctgggcacagagcctctggtaactgccccctgatacacacagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcaggtgagctgccctgtgggctggacgggaattctcgtgagtgatgccagctctgcctcacggtctcgctgcgattccagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609364 - DNA, 950 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgtgagtgccccagctgtgccctcagccccaccccagccccagcctcgccctcatcaccgaccccagccccagccagcttgggttcctcttcgtaggctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609365 - DNA, 726 bp, Homo sapiens
  misc_feature (627)..(627): n is a, c, g, or t
tgatctagcaggatccccttaagtcacccgcgtcaccgtgcgtgagcgaatgggccagatcgtcgattcagccgaaatcaacgttgaaagtttcagtgagattattgaacgcggtaatggcgcctcgctggataatcgtatcgaggtgctcaacagcctcgttgagcaattttccagcgccgaccaacgcctgctggatctgcatgccgactacccgcagcacttgctcaaaccccgcctcgaacgttttcgcctgcaaataagcgagttcagccaacgggccatccacgacctggcctacctgctgcgagggaaaaaagcccagcagcccaagcccggcagctccagggccgagcccgccccaaggcgtgaagtgatcaagacacgtcatcacggcttggtgatgggtgagccccgcgaagcagacagttcgttggtcgacgtcaaggcacacatgaccggcaaggtgctcgccacgtttcatgagaaggcaccgggagtctgggttaaacggcagaaagccccatcgcagccaagcgcaccggtagctgtggatctggacaccagcatcaacacggggcaagcgctattggatggcgaacaagctgaaacccgtaaataccaggntttctccaggaaaccctggcatgcgccgcaggatatccaagacatgttcgatgatcatgcaaaggcgctggaaaaagctcaacgatatgaggaagccga

SEQ ID NO: 609366 - DNA, 466 bp, Homo sapiens
  misc_feature (285)..(285): n is a, c, g, or t
  misc_feature (379)..(379): n is a, c, g, or t
  misc_feature (404)..(404): n is a, c, g, or t
  misc_feature (409)..(409): n is a, c, g, or t
gtacacaccaagggcctcgcgcttttgtgcgacggtgttttctacgagctcacccaccagctggcgtaggccactgccaagccccccagtactatcgcggtgcaagtggtcccggaccagctaatggccttcggtggctccaaggaaccggtggccgattgcaagcttgcacagcatcggcaagatcggcggcgcgcagaaccgctcctacagcaagctgctgtgcggcttgctggccgagcgcttgcgcatcagcccggacagggtttacatcaactattacgnacatgaacgcgcgccaatgtgggcgtggaacaatctccaccttccgcctaagagccgacagggacccacgtctgtttgcgctggtctccaccgnggaacccgccggcacgtgtgtgttntaggncccgcccaccccaaccttctggtggggagaaataaacggtttagagactaaaaaaaa

SEQ ID NO: 609367 - DNA, 981 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctggtgagtcaggtgggagccagccagcgtggtgccagcagtccctgtgtgtgccatgggtaggggtgggagggaaagatgggcggcagcttccttcctctatgcccatgacccccgccctgaccacagaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609368 - DNA, 1087 bp, Homo sapiens
  misc_feature (988)..(988): n is a, c, g, or t
atagcgacaccgtacccacctaccagagcaacatgagcggttacctgaaacaacaggtgcaactgacacagatagccatggagcaacaggtgaagagctacaagaaagccttgacggcgtcgttgccggttcttgatgcggaggtggacattgactataaaaaccaggcaaaaatcgcaaaaaccctgtccactcagaaccttggcatcatcaggcggctggaattcatcaacgaccgcttcaacgaacttaaaaccctgggagatgaaggcgcggcgatcattcgtaaaaccatacgagagttgccgcagctcacgctcattgaactcaaatctcttgagattggcttgggccgttacttgtgtatcgatgagacgcaaagccaggttccagccaccgtgcgtgagcgaatgggccagatcgtcgattcagccgaaatcaacgttgaaagtttcagtgagattattgaacgcggtaatggcgcctcgctggataatcgtatcgaggtgctcaacagcctcgttgagcaattttccagcgccgaccaacgcctgctggatctgcatgccgactacccgcagcacttgctcaaaccccgcctcgaacgttttcgcctgcaaataagcgagttcagccaacgggccatccacgacctggcctacctgctgcgagggaaaaaagcccagcagcccaagcccggcagctccagggccgagcccgccccaaggcgtgaagtgatcaagacacgtcatcacggcttggtgatgggtgagccccgcgaagcagacagttcgttggtcgacgtcaaggcacacatgaccggcaaggtgctcgccacgtttcatgagaaggcaccgggagtctgggttaaacggcagaaagccccatcgcagccaagcgcaccggtagctgtggatctggacaccagcatcaacacggggcaagcgctattggatggcgaacaagctgaaacccgtaaataccaggntttctccaggaaaccctggcatgcgccgcaggatatccaagacatgttcgatgatcatgcaaaggcgctggaaaaagctcaacgatatgaggaagccga

SEQ ID NO: 609369 - DNA, 1111 bp, Homo sapiens
gaacagaatgaaggagatcgcatagtggctctctcctgtacgggattctgcctgtagctgcgtacaatgtggtcgaagtcgtacaccagaacctagtgtgatgttctgaatcagcaaacctttgagcaggtatgcactcattgcatcgtaccgactacgccaatggtggataactcatcgtccattctttagtgcatcacatatgctggtaagcaatggaatccacgacaatgtcccatgtgggcatcactcaggatgaacttaacatgttagcctcctacttccattcgttccatgcaagtgtgcgcttccatgaaggctggatgcaacatactagggtactgccgccacccgatgatttagcccaagatataagatcaagcactaccgcaatcagtgaaactatgtctgttccaatacattgggagtagaaaaaccaggcatagtgaagacccattacaaagaaagtcgattctataagccactaataacttgcagacagctgcataattcttatacgctgcaaggcgggctgctgaatcttttggcgtgtggatattgcaaccgttccttagaatgggctaattcgcgaaaaacctttactccaatgcatcccaggactgtacctgcacattccccacgccatagccaattgtgcaactcgagtttccccagggaactccgatttgcacacgggcttcttggcactgccacttactacagtgcctccgagtcccccccgccccacatgggaggaacccaacttagggaccaagtacccacgggcaaaacttatactggtaccaggcgcttgtaatcattactagggcaccaggggtaatgatttcccaaacgagttcccgcacttcacacgttcgcccactctgggcaaaagggcaatcttctgactctcattcggcgacaagtttggcaacccagttcgctaaccctcaccctaactgcgttccgttcggcaaccacaactgctctcgccaggacgggctatgactctcactgcgccaagcactagactaacgcttgcggggcccaacactgcttcgcacttacgacaccccactctcacgagcgcttcatccatccaaccaccacc

SEQ ID NO: 609370 - DNA, 427 bp, Homo sapiens
  misc_feature (400)..(400): n is a, c, g, or t
gggggcatggtgtcaagtatctgcgctgaaaaaccaggtgatgtaactctttcctaaggctctgtcttcagggacttttgtgacatatcactgtattggtcacctaggagatgtgagccttgtatgggctttgtctacaggaggctttgtgacatatctctgcactgatctctgaggtgaggcaactcttgtctaggcactgactgcaggggacattagtacatatcccttcactgatcacccgggtgatgcactcttgtcttacacctgcctacatggacattttgacacatctgtgaactgatccaccaagtgatgaaactcttgtcaagctctgcctacatgggctttgtgacacatctctgcactgatcactctggggagggtactcttgtctatntctgcctacaggattctttatgattta

SEQ ID NO: 609371 - DNA, 263 bp, Homo sapiens
ttctggcccacgatcgtgaagtctgggaaggaatgagactttcaaggaccagggtatgggtgggttcatggcctggtaatcccagctccttgagggcccggaggcaggcagatcgtttaaggtcagaagttcgagaccagccgggctaacatggtaaaacccggtctctactaaaaatacaaaaaaattagctgggtgtagtggcacacacctgtagtcccagctactcaggaggctgaagcaggagaatcacttgaacccgg

SEQ ID NO: 609372 - DNA, 411 bp, Homo sapiens
gctgggagtgttgctctactctagggagttatttttaagtaatctcatctgtcaattggattaccatccacaaactgaccttgtatatattccattctttctcccagcccagccacacactccaaggttttccctttgcttataaggggtagtcacccttttttatttcgaccttccaaacattctgggagttctcctcctttagagccaactacagcgcagaggagcgctttctcctgctgggttctccgactggccttccctgcagccggtcctcttcgcccttgtcctcctgtgctacctcctgaccttgacgggcaactcggcgcttgtgctgctggcggtgcgctagccgcgcctgcacacgcccatatactacttcctctgccacttggccttgccatatgcaat

SEQ ID NO: 609373 - DNA, 704 bp, Homo sapiens
  misc_feature (25)..(25): n is a, c, g, or t
  misc_feature (34)..(35): n is a, c, g, or t
  misc_feature (40)..(40): n is a, c, g, or t
  misc_feature (47)..(47): n is a, c, g, or t
  misc_feature (57)..(57): n is a, c, g, or t
  misc_feature (66)..(66): n is a, c, g, or t
  misc_feature (69)..(69): n is a, c, g, or t
  misc_feature (79)..(79): n is a, c, g, or t
  misc_feature (93)..(93): n is a, c, g, or t
  misc_feature (100)..(100): n is a, c, g, or t
  misc_feature (110)..(110): n is a, c, g, or t
  misc_feature (123)..(123): n is a, c, g, or t
  misc_feature (125)..(125): n is a, c, g, or t
  misc_feature (136)..(136): n is a, c, g, or t
  misc_feature (144)..(144): n is a, c, g, or t
  misc_feature (165)..(166): n is a, c, g, or t
  misc_feature (169)..(169): n is a, c, g, or t
  misc_feature (171)..(171): n is a, c, g, or t
  misc_feature (177)..(177): n is a, c, g, or t
  misc_feature (185)..(185): n is a, c, g, or t
  misc_feature (187)..(187): n is a, c, g, or t
  misc_feature (211)..(211): n is a, c, g, or t
  misc_feature (216)..(216): n is a, c, g, or t
  misc_feature (223)..(223): n is a, c, g, or t
  misc_feature (227)..(227): n is a, c, g, or t
  misc_feature (239)..(239): n is a, c, g, or t
  misc_feature (299)..(300): n is a, c, g, or t
  misc_feature (320)..(320): n is a, c, g, or t
  misc_feature (359)..(360): n is a, c, g, or t
ctcggtatttttggaagggtcactngggcttatnnaaagnttaagantcccagcacntgtttaaanatngtttcatttngcaagaaaaaaaanttcaagnaaaagatacnaggcatcggccantnaaagaaagtantggatgancacctttagattcttaaatannggnancatttngaccctcngntggaacagatagtaaaacatgtantttgnacatgcnagcnaatgctgctgcnaactaacatgcattgattcattaagatgttattttgagggtgttcctggtctttcactgnnaattccaacattcttacttncaagtggaccaatggataagtctatgcatctataataanntataaaaaatgggagtacccatggttaggatatagctatgcctttatggttaagattagaatatatgatccataaaaatttaaagtgagaggcatggttagtgtgtgatacaataaaaagtaattgtttggtagttgtaactgctaataaaaccagtgactagaatataagggaggtaaaaaggacaagatagattaatagcctaaataaagagaaaagcctgatgcctttaaaaaaaatgaaacactttggatgtattacttaggccaaaatctggcctggatttatgctataatatatattttcatgttaagttgtatatttttcagaaattataaatatta

SEQ ID NO: 609374 - DNA, 319 bp, Homo sapiens
ggaccacaggtgttcgaaacagtctcaatggtgtcatgcgcatcccctgtaaaaactggttgttcctgaagtccaataatagtacctatgttagccaagtagtcggcgtgtgccatgatgacgttaaacgcaccttgccaatcattcctgcacagacagtcttgtgagaggaggttctgtgacggagtctcattctacagacgaggaaagtgggaggtgaaggaaactgtcaagccatgaagcctggaccctcagtcacgatgctaaacagcttccttggtcaagcagaagagggaagcattggggtccaaggacctgg

SEQ ID NO: 609375 - DNA, 687 bp, Homo sapiens
gaggctgaggtggagaatagcttgaactcaggaggtggaggtttagtgtagagctgatatggcgccactgttatgtccaaccgagcgagtatgagcaagattccgtcccagaacagagaataagcagttttgccatcaggaaggatatctcgctccacgtttagatggacaggcctcattttggcagctatgcgtgtttgagatgtagcaacgtgaatatccaaggttcctcccgtagctcaagtttttacttgtgattaacacacacgcacatttgaattccgtcttcagaggcacaagcatttgggcttcatatctcaacagcaaagagggcctgttcagcaatgtcccttcattttagacgtcatatgaggctcgagcgattgcatgatagtagtaaactagtctcctggaaactaatggctgtagggtgcttctagaatatgttacagaattcagagttagctattaatagactccctggatcttgacttaaggtgacaaaatgagactttaattattgttaaagaaatgctgtgcaatatttgtataacgtagagtcctctagtacttttgggtattgtcgggtttagtaattaaggagcttaaggcatttaaaattgtggaaccattgttcagggaaggtattgctttgatgtacagtggtctccaggaattgtaaagatg

SEQ ID NO: 609376 - DNA, 128 bp, Homo sapiens
  misc_feature (44)..(44): n is a, c, g, or t
attcatgcactctggcctgcaggagcactcctaggagaagagancaaaaaggtgggaaggcccagcagggacacggcttcatacccaaaagtccagaacattccaccccaaggcttcagtgcctgacc

SEQ ID NO: 609377 - DNA, 336 bp, Homo sapiens
agagtattgggattactagcataagccaccacgcccagccaaaattacatataatacacctttaatatgtacttagtgtatgtccagagcatatatattatatatagttttcatctggttaaaaaataatccaagtgcaataaaccaggtgctgtgaggatagggaaaagcagggcagtgagctgcagcaggacagggaaggccaagatctactgtgggctgcgtgggagttggggtagggaggccccagctcccggtgctcggtgggaggaaccatagtcctctaggcagtgcctgatagccagagagtagtgagcaaacaacaggtgggtacgt

SEQ ID NO: 609378 - DNA, 352 bp, Homo sapiens
ctggcagctcatatacctaaaaacgtgagatgcgatgctctcctctgacctatggaactcccgtgaggctgcgttctgagagcttcctctagcaggagcccaactgtaggagctgtatttctcaccttcctccacattccccctcacaagctgacaggcacatggaatttacactcactcctaagtcatgagtactgttagccatgaagaacctgtaaacatgctccattaaattcagcagcccatgactggctctgaaccgcccaggtaatgggaaccacgattgccatgacagctggcagaagctataggcatgctgttaccataatcagagtgacatgtacagttatat

SEQ ID NO: 609379 - DNA, 197 bp, Homo sapiens
tcgatctagcaggatccttgaaattgtgtggtgttatgggtacgctcgggaagcaggtatgaacctaggcatgtccgaaacgcccgtccgaagacggcctctagttgcgaacgaatggtcaataagtcttgtcaaaacgcgaagtcgaatcctagttgctaaccctacatcgatggatcatgtagcctagtcatact

SEQ ID NO: 609380 - DNA, 211 bp, Homo sapiens
gaggtcacatacggaaagaggagagcggccaaagcccctggtgaattctgtgcatctgcatcctggtgcacttggagcacggcagggtgtgttactgaacacagcagtctgttctcttggccatcagtggtgtacatctcacgggggcagtgggagcccggaggatctatatgtgccccaatgcttctctcacagcattgtccgggtctgc

SEQ ID NO: 609381 - DNA, 234 bp, Homo sapiens
ttcagatacaccaccctcaagtaggtcccaggtgacagcgtgccccctttgtgtctatatgtactcaactatttacctacaacttataagtgagaacatgcagcatttggtttactcttcctgttcagatagctataggataacagcctccagctccatccatgttgctgcaaaggacatgatctcattctttctcacgactgtatagtattccatggtgtatttgtacacata

SEQ ID NO: 609382 - DNA, 89 bp, Homo sapiens
gcactgaaaggtctgtacctgagcctggatacttgaacagaggcagacactgcggctcaaaaccccaaggaatatcctagctctgagac

SEQ ID NO: 609383 - DNA, 732 bp, Homo sapiens
cgagaagatcatgctgtacactgtcctggctgtgctagaggatacatccagagatattcgagaggctcttcatgaactcttatgctgtactaactgtttcaaccaaagaagggattcatcttggcatcggtggagctgcgtgaacaaatttaagccaagtagccctactagatagggacatccatatggaagtgcttgaagtctctgggaaggtcgggcatgcaaccctggtgcttcccttggtgccagagcttctgagcagccacccatttttggacacaggtgaaccagacatggatgatccagcttatattgcagtatttggtacttattttcaatgctgctaaaacctgtccaagcaatgccagcattgtgtctcacgatcacacgcgttcaggcagctatgcctacctccgagacagtctttctacaatctggttacctgggcttgaggtgtaccaggtagaagaactggtgtcatcagctgtttactcccaggatcatacctcaatgaggatccttcccagcagttcctgcaggagagccttgaaagagtgtatagtcttcagcacgttggaccctcagggagcccaggagctgctggaattcaccatcaggggtatctgcaagagactgggagaacttcaatctgaatgggcaggagtagctgatttctctggcagctatcttcgctgtcaactacttctcatcaagggccttgcaggaaagtag

SEQ ID NO: 609384 - DNA, 162 bp, Homo sapiens
tggtcgaaggctcagtggtggttggtggccttgacgtctcaaattcataatcttcatcatatataacgtaggcctctttcgtaggtactgcagtgtcagtctccaagcctgagaactcatcttcttcagcgtagcactccgggatcccattggagactgaca

SEQ ID NO: 609385 - DNA, 288 bp, Homo sapiens
taataccgggtctgaggcttatggaagcctcacagaggccaacctgcctgaatcacaggtggccagtggggcaggggctggggcgcccattgcctcttccccagagaaggctgaagaggacaggacgctggcgggcaaccagggcccacctgccctggtcagctacacccactccctgatggagtggtgccacgaagtcaccactggctaccgtggcgtgcgcatcagcaacttcaccacatcctggcgcaacggcttggccttctgtgccatcctgcaccgattcta

SEQ ID NO: 609386 - DNA, 215 bp, Homo sapiens
aactgtatgcggttgatgaagccgggttgggcgagggtgtcatagtccttctcgttgaagctacgtgtcgtgcactagttcacccaggctgcgacgtggtgagcacgtccatgtccacgtcgttgctgaacgtcagcacggtgggtaccacgttctggttgggcatggagtgagccggatcatccagactgtcgttgggccttgacgccgtacgg

SEQ ID NO: 609387 - DNA, 392 bp, Homo sapiens
  misc_feature (28)..(28): n is a, c, g, or t
  misc_feature (58)..(58): n is a, c, g, or t
ccttgacctaattatttcaaatacctcnctttttataagaaaaaaattttgtgatttnccagggaacttctaggacatctcatagatcattttaaatataaaaggtctcctggggctgggcacagtggctcacacctgtaatcccagcactttgggaggccgaggcaggtggatcacgaggtcaagagatcaagaccatcctggccaacaaggtgaaaccccgcgtctactaaaaatacaaaaattagccaggcatggtggcgggtgcctgtaatcccagctacccgggaggctgaggaaggagaaccgcttgaaccaagaagtcagaggttgcagtgagccgagattgcgccactgcactccagcctggcgacacagcgagactccatctc

SEQ ID NO: 609388 - DNA, 150 bp, Homo sapiens
  misc_feature (70)..(70): n is a, c, g, or t
  misc_feature (116)..(116): n is a, c, g, or t
acctttcagcggaccatgaactcctgagcccgaccaactaccacttcctgtcctcaccgaaggaggccgnggggctctgcaaggcgcagatcactgccatcatctctcagcaaggngacatatttgtttttgacctggagacctcagctg

SEQ ID NO: 609389 - DNA, 261 bp, Homo sapiens
tgactctcggaatcggtattctcgagctgttcggaggttggctcattgaccaccatcatgcccacttgtggcatcctcgggaacctgcgtgatgactccggggtggatacgctcccgtgtgccccttaatcgcgcgcgcacgacgcgtgctaagaagtacattcctagcacgttcggcagcgccatgaggaaaagcattgcgtcggccagatcaagaatcgatgccatatttgtcgcagctccgactaggagcaagatgag

SEQ ID NO: 609390 - DNA, 359 bp, Homo sapiens
tgcgaatattgcacgagatctccgctgtggagaccccgccatgtgctgtcgcactatgtgcatgtgatatgtggcgcgcgaactgttccagagtttctgtgcacagagggataagccgacctccacagactgtgagccaatatacctggaaggccgcaatttctttcgcttcaacagactgagttacacgcaagaatgtgggcgcggagaccgcaacccaccggaaaggtgccggtgggcaattaacggagataccggcacaggaagacctgccactcttatatgcgcggcaccattaacaggaacgcgccgaaccgtgcaatggaagcaatcgcaagggcagaggcatattgtgcgcc

SEQ ID NO: 609391 - DNA, 779 bp, Homo sapiens
  misc_feature (16)..(16): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctggtcccacagatgtacataaccgaggggcagagaaaacagtcgtgtatgcagaaataagtaggaagtgacgtttgccgattttgcttttaataacacaaattgtaagcttcaaaaaa

SEQ ID NO: 609392 - DNA, 176 bp, Homo sapiens
taaaacaatgttcaagtaactaaaaaaaaaaaaaaagaaaacagaggaacaaacaaacaaaaagcagaagacaaaagacaaaatggcaaacatcagccctaacatctcagtaatgacattaagtgtaaataatctaaatacaccaattaaagatagctattggcaaagtggatttt

SEQ ID NO: 609393 - DNA, 239 bp, Homo sapiens
  misc_feature (32)..(32): n is a, c, g, or t
  misc_feature (69)..(70): n is a, c, g, or t
  misc_feature (72)..(72): n is a, c, g, or t
  misc_feature (74)..(74): n is a, c, g, or t
  misc_feature (163)..(163): n is a, c, g, or t
  misc_feature (224)..(226): n is a, c, g, or t
aactcgttggcgaagggttgagggcgaaaatnttctttaatatcgcgatggtggtgataatcgaagtanntngngggggaagagatatgaataaagttacgcacaccccaggcgacagccattcacccaggcggcgagtggcgcgaacgttagccagatcganagcctgttgtgtcccccagggtgaggtaaagctggagcagtgccacagcgtatcattgccnnntggcatcactttg

SEQ ID NO: 609394 - DNA, 931 bp, Homo sapiens
  misc_feature (16)..(16): n is a, c, g, or t
  misc_feature (559)..(559): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaaggtgagcagaggctngggtacctcccccaacctaggacaccccacttgccctgctgaccccagctgtcccggtgtagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609395 - DNA, 398 bp, Homo sapiens
tagaggattccatgccaataacctccaatggcccctcctgaaggacaaccttccggactctgggaggtagggatcgtcttaaatcagaaatgagaggttcttgtccccctagggaaatttgggaaatatagcatgagatgtgagccctgaagccggggcatggatctggggctctgcccctggctctgtctagtggagaagggtgtgttttctctacctgacccttgcatccccttggcaatggcaactttctgcattgttgttcctcagatttcatttaaataaaaacctgtagtctgggcaacatcgggagaccccaactctacaaaaaatacaaaaattagctgggcgtggtggtgcgtgcctgtggtcccaactacctgggaggttattggcat

SEQ ID NO: 609396 - DNA, 1026 bp, Homo sapiens
  misc_feature (16)..(16): n is a, c, g, or t
  misc_feature (654)..(654): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgtgagtgccccagctgtgccctcagccccaccccagccccagcctcgccctcatcaccgaccccagccccagccagcttgggttcctcttcgtaggctccaccaagggtgccctggacatgctgaccaaggtgatggccctagagctcgggccccacaaggtgagcagaggctngggtacctcccccaacctaggacaccccacttgccctgctgaccccagctgtcccggtgtagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609397 - DNA, 1289 bp, Homo sapiens
  misc_feature (16)..(16): n is a, c, g, or t
  misc_feature (559)..(559): n is a, c, g, or t
  misc_feature (1041)..(1041): n is a, c, g, or t
  misc_feature (1086)..(1086): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaaggtgagcagaggctngggtacctcccccaacctaggacaccccacttgccctgctgaccccagctgtcccggtgtagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaaaaaaaaaaaaaaaaacaaaaaaaaaaaaaaaaaaaaaaaaaaaaaaaaaaaaaaaaaaaaaacaaaaaaaacccaaaacccctaaacaccaaaaaaccaaaaaaacttancccacaacccaacttcacagcccctttccccattttaccctattnaaatccattttcacatcacacttttcttacaatttcaaaattttacaaatacctaaaaacttcccattttcacaaatttattgcacctaacccccttttcccctttttgcaaatatccccaattaccaactaccccttccccttttccaaatttctaaacattccaaaactccaaacgatattgggaacctgctaactctttg

SEQ ID NO: 609398 - DNA, 341 bp, Homo sapiens
  misc_feature (44)..(44): n is a, c, g, or t
  misc_feature (62)..(62): n is a, c, g, or t
  misc_feature (71)..(71): n is a, c, g, or t
  misc_feature (96)..(96): n is a, c, g, or t
  misc_feature (214)..(214): n is a, c, g, or t
  misc_feature (323)..(323): n is a, c, g, or t
cttgaacttcatacttcgatatcatattctagtttacagaacanattttaatcaatagaagnattaagatnaaaaacatggccggtcggggtgctnacgcctgtaatcctagcactttgggaggctgaggcgggtagatcacaaggtcaggagatcaggaccatcctggctaacatggtgaaaccccgtctctactaaaaatacaaaaaattanccaggcgtggtggcaggcgcctgtagtcccagctactcgggaggctgaggcagaagaatggcgtaaacccaggaggtggattgcgccactgcactccagcctgggcaanagagtgagactccctctc

SEQ ID NO: 609399 - DNA, 926 bp, Homo sapiens
ctaccgatgtcattgtccacagaatggaagaaaactattataaaatttatatgaaaccaaaagagtccgaatacctaaagcaatcctcaggaaaaagagcaaacctggaggcatcacattagccaacttcaaaccataccataaggctacactaaccaaaacagcacagtgccagtacaaaaacagacacatagaccaagggaacagaataaagaacccagaaacaaagctgcacacctacagccatctaacatttgacagagtaaaacaaaaataagcaaaagggaaagaacttactattcactacattgaatggtgctggaatagccagctagcccatgccaaaggatgacgctggacctctacgtctcatcatatataaacaattacatcaagatggattacaaactttaaatgtaagacttcaaactctaagaatcctagaagacaatccaggaaacatgattctgtacattgccttgggaaagcatcatgactaactattcaaaaacaatggcaacagacaccacaaattgacaagtcagacctaattaataaagagcttctacacagcaaaaaaaccattaccagaataaacagaccacttcagaattgagagagacatctggcaaacctctgcatcaaagagacctatttcagaacgtatagcgactgacaattggacagcaaacaaaacagacacaaaaaaatggtcgcggccggcctgaaagcttaaacatgttgggccgccccaagacgcacaggctacacgtgtcaagaaccggcgcaccggggccccaaaaacgcggccgggggacacccggctgcgtcggatcaagcgcaccacccgcggcgcgggccagacccgcgagcgcccgccgagcaagaaaccgcactgactcaccacctcaaccaatcacacgact

SEQ ID NO: 609400 - DNA, 971 bp, Homo sapiens
  misc_feature (16)..(16): n is a, c, g, or t
  misc_feature (858)..(858): n is a, c, g, or t
  misc_feature (860)..(860): n is a, c, g, or t
  misc_feature (864)..(864): n is a, c, g, or t
  misc_feature (870)..(870): n is a, c, g, or t
atagcatagtagagcngggagactgcgccgacatggagctgttcctcgcgggccgccgggtgctggtcaccggggcaggcaaaggtgggcggcggggaaaggtgggcaaaggccggcggcgggcagaggcgggcaggggacgccttcactgagcccgctcccggcaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggatgacacgggttcattgccggggaaggggtctggctggtggtcttcaaaacttagcccangnggtnatcacncatcctcaaacgttctgcaaaaaaacacaacaaaataaaaaaaaaccgcattcggaaaaagaagagacaaaatccactagagagcctagtataggcacaaa

SEQ ID NO: 609401 - DNA, 1048 bp, Homo sapiens
gggatcttctcaatcgcggacagcccgtgcagaatctgcattccctgtgacacccacagggggctgctgtttgcggcctcacactcgggcgtctccatgtgcccatggccaactgcatgcctgtacagagagtctgtggggactgcctccctgcccggggacccctactgtgcttggagcggctccagctgcaatcacgtcaacctctaccagcctcagctggccactcaggccgtggatccatggacatcgagggagccagcgccaatggacctttgcacgcgcgtctgcggttgtgtccccgtcttttgtaccaacaggggagaacgccatgtgagcaagtccagcttccagcccaacacagtgaacactttggctgtccgactcctctccaagctggcgacaccgactctggctacgcaacggggcccccgtcaatgcctccgagtctcctgcgcacgttgctacccactggggaccttgctgctggtgggcacccaaacaggctgggggagttccaggtgctggtcactagagcgagggcttacaagacagactggtagccagcatactgcccagaaggtggtgcatggacggggtggcagacccaaacaagatgacgggtggaagtgtaccccgtcattagtcaagaacatcggggtgtaaatgcaccaagcctgctagccatcggcagctgggcggtgaagacaggtctacttggaaaggaactcatggtgaaggtgcacgcactatgatcaggcgggtggctcccagtataatcatggcctaacggacacggctaagacgtacagacttcctgaatcagatgactgtgcaaggaaccaaaaactccttgggtgttgcacatggaacacacaccaggaaggccaacagccgtgggtcactagacagctgatacatccccgtgactgttttggttacgaatcataatccagtacgagataagactcgaatagacaacaagagatgacaactagcacgcatgtgaacaatgaaggtgccgactcaacacgtcgcaatgaccacc

SEQ ID NO: 609402 - DNA, 1103 bp, Homo sapiens
  misc_feature (16)..(16): n is a, c, g, or t
  misc_feature (731)..(731): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcaggtgagctgccctgtgggctggacgggaattctcgtgagtgatgccagctctgcctcacggtctcgctgcgattccagattgtggccaggggcttaatagcccggggagtcccaggggccatcgtgaatgtctccagccagtgctcccagcgggcagtaactaaccatagcgtctactgtgagtgccccagctgtgccctcagccccaccccagccccagcctcgccctcatcaccgaccccagccccagccagcttgggttcctcttcgtaggctccaccaagggtgccctggacatgctgaccaaggtgatggccctagagctcgggccccacaaggtgagcagaggctngggtacctcccccaacctaggacaccccacttgccctgctgaccccagctgtcccggtgtagatccgagtgaatgcagtaaaccccacagtggtgatgacgtccatgggccaggccacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609403 - DNA, 1428 bp, Homo sapiens
gatcgtaatgacgggctatagtcgcacatctcactctgccgagctcgataccttacaatacaggcgtccctatcacgactaccaaggaccagactcctcgaaatgagttagcacgcacggaaacgattcgtgaccgaagtgcatactctatggatctcttctatgcctgaagagatgctgtcgagagaagaagctgaatgctcagagggactatgttactcgcctgctggtccaccaaagatcaggtccgcctgcagtcaacctggtaccatccgaacatgacaagatgggttcattcgaacatggacgaatcagaatatgccagtaagctgaataccgatcatgaagtgacattatcacagtgtagaaccgtgtacacatttctataacatcatgatgacggcctcatgtacttggagtgtggctgtccgtgacatggctcgtcctgcactctgagactagtctataaggacgattcatcgtgaatgctggcttaagtaggacctcacctgattacaggatagtaccctaaaagcaacaagtctggggatatctatcgagcgtgtatgtgactaagacaaatgtagtgcaccctagtaattgcgtccagatctaggactaccagcggtgagctcggggaatacgcttgttaagcggcgttggagtaagaccattcttcccttgcgaaaagctcaactatttagaagaaggaaggaattcccttagaggaggcgcacctttggcccctcgaggggtcaagtatgggagacttgataacatggtttagatagtgtgcacagtacaactcccggtcaattgaaaagtcaaatcgatgtgaagcatcaaagcatgggtggatacctgtgtgtgaccttggccccacgtgcaagtttacaaggcactacaaatgggacataatatcattgttgcacacggtaagcggagggatttcactgtttgaagcaatatccttggtacacacacaaatcattgagggagcaaacttgcaaggaaaatcagatcccacagcaaggtgcatacttggttggaaatggcacagggaaggaaatttacattggttccaaggaatgcctatattgggcgcgttgaattaatttgggcgcccctgtgtcataaatttgggtcaagtggtaacgaagggttttttaagaggagagaaaaaataagcgatttacaagaaagaggttttggctacattggtgacaagtagacatccgttgtcgagggtcaggaggtgacattcacccaaaaaggccctcctatgtgtttgtgtacgaaaagtattgaaggaaacattttgacacactatggatgggacatttcaatccttgaaagaatggaaagccataaaggagtgaatatggtctggacgattggcggagaagcacgtaataaactggaaaagag

SEQ ID NO: 609404 - DNA, 290 bp, Homo sapiens
aagcatttgcatcagctacagtcttaaattgcttctttaccaaggatatttacagaaaagactctgaccagagatcgagaccatcctagccaacatcgtgaaaccccatctctgctgaaaatacaaaaatgagctgggcttggtggcgcacacctgtagtcccagttactcgggaggctgaggcaggagaatcgcttgaacccgggaggtggagattgcggtgagcccagatcgcaccactgcactccagtctggcaacagagcaagactccatcttgagcctgtgtctg

SEQ ID NO: 609405 - DNA, 878 bp, Homo sapiens
  misc_feature (6)..(7): n is a, c, g, or t
  misc_feature (9)..(9): n is a, c, g, or t
gcctgnncngacacgaagatgaccctcgacagccgccgggcgctgatcaccagggaaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgggccccgtggacctgctggtgaacaacgccgctgtcgccctgctgcagcccttcctggaggtcaccaaggaggcctttgacagatcctttgaggtgaacctgcgtgcggtcatccaggtgtcgcagattgtggccaggggcttaatagcccggggagtcccaggggccatcgtgaatgtctccagccagtgctcccagcgggcagtaactaaccatagcgtctactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaaccgaatcccacttggcaagtttgctggtgagtcaggtgggagccagccagcgtggtgccagcagtccctaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609406 - DNA, 432 bp, Homo sapiens
  misc_feature (45)..(45): n is a, c, g, or t
gagatctgtagggcccgagctctagggctatcaccttgagtcagnatgtccaggcacccttggtggagcagtagacgctatggttagttactgcccgctgggagcactggctggagacattcacgatggcccctgggactccccgggctattaagcccctggccacaatctgcgacacctggagtgacccccacaaggccaagactatgctgaaccgaatcccacttggcaagtttgctgaggtagagcacgtggtgaacgccatcctctttctgctgagtgaccgaagtggcatgaccacgggttccactttgccggtggaagggggcttctgggcctgctgagctccctccacacacctcaagccccatgccgtgctcatcctacccccaatccctccaataaacctgattctgctgcccaaaaaaaaaa

SEQ ID NO: 609407 - DNA, 208 bp, Homo sapiens
  misc_feature (18)..(18): n is a, c, g, or t
  misc_feature (50)..(50): n is a, c, g, or t
  misc_feature (92)..(92): n is a, c, g, or t
tagcggccgcgcgctggnaaccaccactctactctctacttctgtgagtncgactttcttggattccacataagtgacatcacatgggattngtctttctgtgcctggctcatttcacttaatgtcctccaggtttatccatgctgtcacagatgacaagattcctttggtaaggctcagcagcactgcattgtgtatcagtacctca

SEQ ID NO: 609408 - DNA, 135 bp, Homo sapiens
atgagtaatttactcttaaggatgtattgtaagcgcctttatattgctgcttaccttctacaacttcgaacaacacatccttatcttgtcaccactgccaatctattttcctcaacaacatggaaatgtggtgtg

SEQ ID NO: 609409 - DNA, 711 bp, Homo sapiens
  misc_feature (16)..(16): n is a, c, g, or t
  misc_feature (255)..(255): n is a, c, g, or t
  misc_feature (258)..(258): n is a, c, g, or t
  misc_feature (260)..(260): n is a, c, g, or t
  misc_feature (275)..(275): n is a, c, g, or t
  misc_feature (283)..(283): n is a, c, g, or t
  misc_feature (285)..(286): n is a, c, g, or t
  misc_feature (292)..(292): n is a, c, g, or t
  misc_feature (294)..(294): n is a, c, g, or t
  misc_feature (317)..(317): n is a, c, g, or t
atagcatagtagagcngggagactgcgccgacatggagctgttcctcgcgggccgccgggtgctggtcaccggggcaggcaaaggtatagggcgcggcacggtccaggcgctgcacgcgacgggcgcgcgggtggtggctgtgagccggactcaggcggatcttgacagccttgtccgcgagtgcccggggatagaacccgtgtgcgtggacctgggtgactgggaggccaccgagcgggcgctgggcagcgtgngcncngtggacctgctggtnaacaacgncnntgtcgncntgctgcagcccttcctggaggtnaccaaggaggcctatgacagatcctttgatgagaacttgagtgcgatcatacatgtatcgcagattgtggtcagcggctttatagcacggtgcgttccagatgccatcgttaatgtctgcagacagtgctctcaggggtcagtaactaactatagcgtatactgctccaccaagggtgccctggacatgctgaccaaggtgatggccctagagctcgggccccacaagatccgagtgaatgcagtaaaccccacagtggtgatgacgtccatgggccaggccacctggagtgacccccacaaggccaagactatgctgaatcgcatcccactctgctaagtttgcttaagtaaccccacgttgacgactgtcattcatctttgttgctgagcgg

SEQ ID NO: 609410 - DNA, 110 bp, Homo sapiens
tcacgcccattacacaaccaggaaaacccacatgcttgtggatcccaaggcccaactccccgaaccactcaggtcctgtggacagctcaccttgtgtacattgggcgtga

SEQ ID NO: 609411 - DNA, 101 bp, Homo sapiens
cggttatattcttatctaccaggcttcgtaatatctcccatattgtaacctactactccggaacaaaagaaccatttggatacatggtatgtctgagctat

SEQ ID NO: 609412 - DNA, 516 bp, Homo sapiens
taaagacagggtcttgctctgccagccaggctggagtacaatggcataatcatggctcacagcaacctcaacctcctgggctcaagcaatcctcctgcctcaacctcctgagtagctgggtctacaggcatgcaccaccactcccagctaattaaaaaaaatttttttaagagacagggaatcggtgtgtgtgggggggtgtctcactatgttgcccaggctggtcttgaactcctggccttaagggatcctcccaccttggcctcccaaagtgttgggattacaggtgtaagccaccacgcctagcacctattcagtacaataatgtgctgtacagggttgtagcctaggagtaacaggctgtaccatacagcctaggtgtgtagtaggtttcaccacctaggtctgagtaagttcacttgacgatgttcacacaacacaatcacctaaggatgcatttccgtgcggcttaccctgtggctaagtgatgtatgattgttttatcagtcgacccgg

SEQ ID NO: 609413 - DNA, 113 bp, Homo sapiens
gtttaagctaggtagctagtagggtagaccctggtcctacttggcataagccaggccctacctagggagcccgtaggtacctacctaggtagctagtagagtaagtacctagg

SEQ ID NO: 609414 - DNA, 239 bp, Homo sapiens
catgccgataatcccagcaattcagaaagctgaggcaggaggattacttgaggccagactgggcaatatagcaagaccccatctctaaaaaattaggcatggtggtgcatgcctgtattcccagctactcaggaggttgaggtgggaggatcacttgagcccagaagttcaaggctgcaatgagccatgattacaccacggcactacaaccttggtggcacagtgagaacctgactctt

SEQ ID NO: 609415 - DNA, 351 bp, Homo sapiens
agcgtgaaggaggagctgatgttgtcaaccccccacaggcacaaagttcactagggcgcgtaggcacaggtcattacccaggaggagcgcagggggatggcgtgaccttgtcggtggtgtagctgtcccagatgatgagcttcccatcctgggaggcgctgaccagcagccttgagtcggtcccccagtgcatcgcatagatctttgccaggtgcccacggagtgtcctccggggtcctcagtgtggattctccccactgggtccagcccagctgtgatctgggtcagtgttgagtccccacatgcttttcgggcatcccggatctggttccggagctgctcgggctcctg

SEQ ID NO: 609416 - DNA, 290 bp, Homo sapiens
ggctgactctagcaggatcccccaagcagttaatacatgactcagaactcggggccgggtgtggtggctcacaccttgtaatcccagcactttgggaggctagaggtgggcggatcacttgcggtcaggagttcaagaccagcctagccaacatggtgaaaccccatctccactaaaaatatcaaaaactagcagggcattgtggtgggcgcctgtaatcccagctgctcaggaggtggaggcaggagaactgcttgaacccagagacggagaaggttgcagatgagccc

SEQ ID NO: 609417 - DNA, 1337 bp, Homo sapiens
  misc_feature (885)..(885): n is a, c, g, or t
  misc_feature (957)..(957): n is a, c, g, or t
gagctgcgtcggtgctgcagtgagaagatgtgcgtgtctccacaggagttaaacgttcctcgtaattttcgcttgtttggaagaacttggaagaaaggacaaaaaggagtaggcgaaggtacagtaagcttgggggccttgaagattgacttgcaacgatattgaccactttacccaggggtggaccagggcattgcattacttggggaccacccaagggaccacactttatggaaacaacacgaaatactcataacgcccttggacaaggttagaccactgtgggcaccttacagattagcccaagaaaggctccctaccgtccaggttcacagcactttttggtacaaccacaaagaactttaactacattagacacgcggtgacaattcagacttcacatttcgcaatgtgggaggacctggagatgggaattgcccccgggaaggacaaataccccaagtattgagtataagccaaaacatggggcaaaacaagttacattattaggccattacaacacgttgtggtacctttaccacagaatgacgtaaagacacagtgtcttacagtggcatgggtgcaccacaagggaacacacacttcaattgaacacggccttttcaccaacacagacccacacccacagacaacggtgaacccctcacacgcatttaccacaaacgaacactgtcacatatgattatctcacgggatgggggaactcgttccacagacaggttatggttgccatatgaacacagttccgaccacgaaatccctatattccttacgcttacaagttggtttgaccacagtgggtttccattagggcaattttcaacactgtttaaattccaaccgacaatttggcgcacaagaagnagtacaccaccacctttacacaaggttcaacacacagtaaaccagttattacaccaaggaacttcggacgtntcaaaaaccaccactttttgaacacccgttgtgcgaaaccagatatgtatgggtaacacgggacacaagtcagtaaattactgacacagtaaactaaacttggaatacacccgaacacgccgccagataatacatcggtatatgtaaccaagaggtattaacaccacagagatgacgtggatagaacaaaccgattacacctggcaacagcaaccgagagatatatagcatcagacgttcctgattgggaaacgacgtggtgcgcaacgacatagctcaaacattctcaacgaacccaactttcaacacaccactgtggacgagataacgttcccgacgacaaaataacgacaaaatgtcacagggggctacacaccaac

SEQ ID NO: 609418 - DNA, 146 bp, Homo sapiens
atctcccgactcgttcacttgcgatcagctctgacatactccatgaacaaaaagtatccagatgactcagtaagaaacccccatcacttccttccttgagtctctgtctgactgtccttgtccacccgcctttccatccaagaaac

SEQ ID NO: 609419 - DNA, 928 bp, Homo sapiens
aaaagcatcacaaggtggtacatcatgcaaggctcccttgagcactcccaagaagaactggtaatttgaaacaaaagtatgtgtcttcatttgtatcggaaaagtactgtctttaaatagtttctatgtagagattccccgacaatggatagaaattaaccgaatttaagacctgttttatggatggcaagtttggagacgaataggacaagagagttggaggattggaattgccattcgccagttactaattgtgttcagtattcgttacacaaactagtaataatcggttcacttgttgatagatagtttaataaggtggttggtgaatgtgaagtagcaaataactggtatatcgtgactaagcgcttaagaatgcctgtcttcgagaggaaggtgttataatattaaggaacagtgccaaatacacttgtgcatatctgcaatttagtctctttgaatgtatgttactggattagctccctcctcctgctgtgatggtaccgatgcatagagtcaagtcaagatccttgtgatgtgtgtcatggactttgacaatatgtaaatgtgttgtgagccagttgattgatttaaggcatcctatcaattgaatgcactctatgaagagtggaacgtaacatgtgtgtaacaacagccaataagctattcgctgtcctggcacaataaatggtaacatcatgaagacgactgggggagcctacgcaaaaattctcaacacaggggggcgcgggcacatagaggagaaacggcactgagccacggaacgggcaggaaaggggggcccctaaaaatcgcggcgccgattccacacacgggctgaggagggtaacaggaccgacaaaacaccgcgggacagagagacacataggaacgcaaccacacaaaagacaagacaaggcacgcacca

SEQ ID NO: 609420 - DNA, 1083 bp, Homo sapiens
gctctgccctgatgtcagagttggcatccggctgcatccagaggaaagggaaactgctctctctctctcctctgcctccacttctcttgggggtaacacaaaaggatccttctcagcaaatcatgtcagtatttcaagctctatttctatggcacttatctttcgagaagagtcttcacctcttcaggtgatgacttggtaggtagtaaggtagggagatcttgatttgtctgaggatgtcgctactttattctagtggaatatcctgtaccttgtgctagtgtgtcatacgaccatcgatccccattaccctatgcgttagtgactggcttatgggtcaaaaacctgttatgatttctaaatgttataaacagactaaatattcccgactggtgatgcctgtgtgacgacatttgggtatttagtaggaaacaatgcagtgtttcaaagcttcgagagaagcttcaaaagtggacacaattgctgaaaacgagagatgagatcagtgacacgagttatctcagtgttttgcataatagacaagaccacggcgttgtggttccctgacctgtttggtcgtttactgttacggatctgaatcatgttctgggtaaggagaggaggagcgaacactggactacagattcggtcttgccaaatcagaattcgttcggtcacagagtcaggtcagggctgggtgcggtggttcgaaccctgttaatcccaagcctttgggaaggctgagggcagtgcatcacgtagaagaaacaggcctgggccaaagggggtgaaaatcgcgggccctaagaataaaagatgcgccaaaaacttcagactggggcacatggggggccacatgcccctgggtgggcccgaagcatacaatggggaaaaggccgtaccgccgcaaaacaaactccggatggcaacccccaggcagagtggaaaggttgcgcacagcgacagctgggacaccactgccagagtaagaagttcacaggcgcggcgcaccacacaaggagaccctgactgtcaagagacccaaaacacagaaagcccaacaacaacaggagcaacacaacg

SEQ ID NO: 609421 - DNA, 913 bp, Homo sapiens
  misc_feature (62)..(62): n is a, c, g, or t
  misc_feature (193)..(193): n is a, c, g, or t
ggcgtgatagtctacacagaaagttctccgctcccagacatggtgtccctcgcgacttcctngctcggaagcgcagccatgccggcattgtgggaaggtgaacgagcttgccctaaggatgacccgtccaagccggtccagctcacagaccttcctgggaatacaagggctggtcattgaacgtcactatctntggcggagaatgtcggactaggccgtggtatccaaacggatgtagacaaacgcaacggaggtgcggtgccgagagctgtgctggaggcatatgatacgaggacgatcgacctcagtggatgcgttgatggcgcggtgtgtcggcctgtactgatcggaaaatccccttccgaggccttcccgggagccctatcgaatgacctgttcttttatgcctgtacgcggactttcagctgactgcaagtgctaaagcatggccggttgtcatgatagacgcatagtatgggcactacagagtctgacacggaacgaagggctctattagcatagtactggcaacatacatggcagcgatcgcaggagtggcagagagacgcgaagctgggagagaggacttcagcacgtccatgcaaggaagtcactgccaagtaatccgggtcgtttgcccagacccgagaggcgcctgcatgactctgcgccagaaaaacggccccacgcgtgatgtgagatccaggtgaacgggagggacatgtggccgccgaagctggactgtgcccgcgagaggctcgagcacgcatggtacctgtgaagcaagtgtgtggtgcaggatgagatgatcgacgtccgtcgggggtagaaccaaagggccaaggctactaaggggtcaccaatcgttgaacaccaaaaagctgccgcagagaccacgaggcctgccgcagtg

SEQ ID NO: 609422 - DNA, 144 bp, Homo sapiens
  misc_feature (18)..(18): n is a, c, g, or t
  misc_feature (36)..(36): n is a, c, g, or t
  misc_feature (101)..(101): n is a, c, g, or t
gctggactgttggagganatctgagtgtctttgcanacttggcttaaattgtttttttttaactaaaagtagttgtaggtgaaatgattaccttaggtaantgttttggtaaatggcttgaagttgaaccacagcagttttgct

SEQ ID NO: 609423 - DNA, 337 bp, Homo sapiens
aattcctcgtctatacattcagtgcaatcccaaacaaaatccctccacctcccaggttcaaacagttctcctgtctcagcctcccgagtggctgggactgcaggcacgtgccaccatgcccggctaattttttgtatttttagtagagacggggtttcccgtagttggtcggttgttcttgaactcctgaccttaggtgatccacccacctcagcctcccaaagtgctgggattacaggcatgagccatcacacccagcccaccatggtttttagtataaattaacaagctagcactgtatacctatgtaacaaacctgcatgttctgcacatatat

SEQ ID NO: 609424 - DNA, 435 bp, Homo sapiens
ggggagcccggtaatcgcataaaacttaaaactttacagtcagaggttcatttcctcttcttaacaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaactttttggcccctttggcccaatcctttttaaacttaaacaaatttttccattgggcccaaatttgagccaaattggccaattccccctaaaggggggcttattaaaaaaaaagggccccaatttaaaaaatttggaattggaaaaaccttgggtttcccaaaataaaaccctttggaaaaaaaccccttttccccaaatgggaaaccggccccccccc

SEQ ID NO: 609425 - DNA, 306 bp, Homo sapiens
gccttgctggtgatctcatacaggatcccatgtcagatcatgaggcaggaacagatgatgcagaatacagtcttcctggattgccaaggagtgttcctgggtcatgcctccatctgggtcctttctgaaacctgcatttggagcttgctggctgtgggagccaggtatactgtcaatcctgcccgcctgcccacgctgctgtcatgaagctggcccaccacgtgcctcctccagaaagccggaagctactccttgcctctgcatattgacttttccttggcatgccatcgggccgtacataggatg

SEQ ID NO: 609426 - DNA, 743 bp, Homo sapiens
  misc_feature (85)..(85): n is a, c, g, or t
  misc_feature (94)..(94): n is a, c, g, or t
  misc_feature (109)..(109): n is a, c, g, or t
  misc_feature (373)..(376): n is a, c, g, or t
  misc_feature (422)..(423): n is a, c, g, or t
  misc_feature (436)..(436): n is a, c, g, or t
  misc_feature (438)..(438): n is a, c, g, or t
  misc_feature (522)..(522): n is a, c, g, or t
  misc_feature (545)..(545): n is a, c, g, or t
  misc_feature (547)..(547): n is a, c, g, or t
  misc_feature (563)..(563): n is a, c, g, or t
tccccagcctactgcctctccaccacttctctcttcaaccccccaccccctaccctcccacccacttgcgctgcgcacacgctcncgccacgcncctgccgcgcgcgcngcgcacgaaaccaaaatccaactaatggctatatattctacgctacacaatacagcctcttctgttcataatatctctcacccccatccctcctcacttcccctgccactttccatgctttcattttgacctggtcccccacctgtgaagtgtagtggcatccatttctaatctatgcattcatccaacacacttatttattggctggagatagaaaatcacaccacctgcacaggccttctcggcctccaaagcccatccttnnnnttccccctccctctctcaaatgtattatcaccaccacacactgccnngcctccctccccncngcactgcctgaaggccagtgtgggcatagcattagctgcttcctcccctcctcccacccactctcccctcccatcgcatcctgntgtgtcaatgccacaaaatcctntnttcgctggaaccagtnctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattc

SEQ ID NO: 609427 - DNA, 349 bp, Homo sapiens
cagctggaacgggagtctgcgtatgcagcccggagtctggccttgtaggggcgaaggtgcaggtagatcgcggcgggcttgcagtcttgtagcgcctggagcgcgtccctgcccttagcggggcttgccccagtcgcaggggcacatccagccgctgccggctgacatgcatgcctgttgcgctgcgggatgtctgctggggtctgcggcagcctgcacctgcgctgggcgaccagctgcaaggtcccctgccctggctgggctgggcatgcaatggtgcctggggagacgggtgctggtgtgcatggcctgtggtggcccctacatgggccaccttcttgcccggctg

SEQ ID NO: 609428 - DNA, 898 bp, Homo sapiens
  misc_feature (130)..(130): n is a, c, g, or t
  misc_feature (630)..(630): n is a, c, g, or t
  misc_feature (827)..(827): n is a, c, g, or t
  misc_feature (886)..(886): n is a, c, g, or t
  misc_feature (898)..(898): n is a, c, g, or t
gccgccctccagcatttcgccctagaggcgccattgccgcagggtgattagttgtaggaagagagtcgcagagggccttagaggtgattcgaagagacgggtggtagatactctgagaaccattattatnggccaaccctgcttgaactcgccttgatcttctgtaaagaggtcttggttgggtgtggcgtgttgcgttcttctttcttccttcctccgcgcgtggtttgaggctgtcaggtaggccgccagcgtgcccgccgcgccctctccccccccccccccctctcgccccacccccccccacccgcatagtgcacgtcgccgctagatgtggtagggcgttgaggtttcgtggctcgccgtcgtgggtgggagatgagggatatcgtagggggcggcgcggcgggtggggtgcgcgttgggcattattgggggtgcgcagaacgagcgcgctccgcaggtcgagcgtcgcgtatgcgtatcttgctcgctgtcgtcctctactgtcattgtcgtggaatttgagtatatgtgcgaatatcaaattaatgttagatgtttgtcacttcaatccactacacgtgtgttctgcgcgaacggtgtgtgcaagacgggaggtttttggantgctgagagacgggtcggtgagcgactacggctgatgttgtgtacttgatcggtcgcacttcaagccagttccacctttagcgacagtatgcttgagtcagaggcccggcgtcgtgagcgacggtgaccgacgacataaggcaacgcttacagattgacggctgacgacatggtaggatagggaggcggcttctcgnaggtggtggcggcgggggggtgaagggatggaaataagattggcggtacgtgtcggggnacgccacgcagn

SEQ ID NO: 609429 - DNA, 335 bp, Homo sapiens
gactgaatacatatgatttcatgtatgccacattttgtgtactgattcatctgtcgatgaacacttgtagttgttcccaccttctaggctattgtgaatgccgctgcgtacgaatgtgggtgtgcaaatctctctgtaactccctgctgaagcccaattttgtaatgactgatgctacctacttatgaggacatgtacgactatgccaccatactgtcagcatgcaaccaactgagctcatggtaaatacagttacgttgcagctctttgtcatcactaatgaacctgtgaaaacaatagaagtacgaaaccagtaagacggcctcaagaaaaca

SEQ ID NO: 609430 - DNA, 434 bp, Homo sapiens
cttctgcttttcttgctgccctgtaatcattgtggccacagacattcctgcctaaacttaaccccttctgtgagcaaaaggtactgtgagttccttgagaaataggtactgtactggctagttttgtgtcaacttgacacagctggagttaccacagagaaaggagcttcagttgaggaaatgcctccatgagatccagctgtaaggcattttcttaattagtgatcaagggggaaaggtcccttgtgggtgggaccatctctgggctggtagtcttggttctataagagagcaagctgagtaagccaggggaagcaagccagtaaagaacatccctccatagcctctgcaccagctcctgcttcctgacctgcttgagttccattctcgacttcctttagtgatgaacagcaatgtggaagtgtaagctgaat

SEQ ID NO: 609431 - DNA, 513 bp, Homo sapiens
  misc_feature (182)..(182): n is a, c, g, or t
  misc_feature (238)..(238): n is a, c, g, or t
  misc_feature (327)..(327): n is a, c, g, or t
  misc_feature (496)..(496): n is a, c, g, or t
gtaatgccaagtgactgttcctgagagccagctctgggctgtcttcaccatgtaggtgggcttctgtctaaggagaacagcattaggagaggtgcatcggcccatgagcgtgaagtccacccagcctagtggacactgaagtgctcacaaggcctccacctgcctttgtaaaagccgaatgntgatctcaaaccatgggaagcccgaccgccccacccctcctcaccccagcgtttantgtttcaggggtcagctattatctcaagatttctatccaagtggaaacaaactgaatcatgcacacgacttatctgtgtggtgtcagtnacactcaggctcttgctacggaatgcaaagaacaactcacataccagtgtcaaacagaatgcacagaagagacctaaaacagcagcaggtcactcggttcacaaaaggtgactcccagtcaagtctgacacactgtcttggttgtagagcacagttgccatcctctttncctgggtaacatcaccg

SEQ ID NO: 609432 - DNA, 716 bp, Homo sapiens
tcggcacgaggccacgtcccccttactaccagacaagccttagaccaaaccatttacccaaatcaagtataggcgatagaaatgaaacctggcgcactagatatagtaccgcaagggaaagatgaaaaattataaccaagcataatatagcaaggacataaccccatataactactgcagtaatgaattaactagaaataacttagcaaggagagccaacagctaagacccccgaaaccagacagagctacctaagaaccagctcaaaagagcacacccgtctatgtagcaaaatagtgggaagcatctataggtagcaggcagacaaacctaccgagcctggtgatagctggattgtccaagatagaatcgttagatatcaacatataaatatgcaccacagaaccctctaaatcccctgatacataaaacatgataagatccaaagaggaacagatctttggaacacataggaaaaaaactgaagagagagtaaacaacttacaaaaccataggaagggctaacaagacacacaacaaataaaagaaagagtacaaggcaacacaaacccaataaccaaaacaaatcccaaaacatataaacagaactcctaacaccccaatggaccaatctacaacctaaagaagacgataagcaagataagaaacatgaaaaaaacacacccacaaaaccaggacaaatacaacaagacaga

SEQ ID NO: 609433 - DNA, 81 bp, Homo sapiens
  misc_feature (14)..(14): n is a, c, g, or t
tgcaaaggcttttncatctctggtccattcaacgtccaatttcttgtcaaaggaaatgatgtcttggtgattgagtgtaac

SEQ ID NO: 609434 - DNA, 94 bp, Homo sapiens
  misc_feature (1)..(1): n is a, c, g, or t
ngcaggtcgtgaggtctggacgagtcaagaaagccgtagccaacgctgttcagcaggaagtaaaatctctttgtggcttggaagcctctcaggt

SEQ ID NO: 609435 - DNA, 696 bp, Homo sapiens
aacataaaaacttgtatatgactttaaaaacaagaggacggcacagtattgtgcaaaatgtatatagcgcatatgcatggagcaaagcgggcgtggaccgtgttgcctaatgtttaataacaaaaaaatatgtattctttaaaaatctgcaagatgatgtctattagctgtgcatctcttacagttagcttatcttgcccgggtcggggtgggataaaggtgtgtcggttagcacctctggaagacctatctagagctctttcactttcctgaggttatttgcccttactggtgttggtatgtctgtgccggccatgggccctcattgccttgaattcctgctcttgatcagggacaagggaggtcaagctctgactaatgccatgatcctgattaaggggtacagacagggaagtatcgtgctacagctcatgaattaacctgtcccaagcctaatccccctccagtggcatcatgcctctacccaagcctttgtgtgcccatgttatgcacacagctgtaggcattcttaagtcccctgtcgcatccagtggaagcattttaaaagtttcttgttacttatatgggttgtcccttaatggctgctttacagatttagtcagtggctcgtagtgtcaccccttctctagattagggtgtcaaagagattgtttgcttaaatataatagccatcat

SEQ ID NO: 609436 - DNA, 796 bp, Homo sapiens
  misc_feature (245)..(245): n is a, c, g, or t
agcggggaggaggtggagagtgaggccgaggcgtggcggagcccgggaactccctcctcctgaagtaacgcgtcccgggccggctctgccgtcgttgctgccgccgggctgccccggaacgaaggagtgtgagagcgatgggagaggcgcccgcgtgccttcgcctccggcctccgtcagctcgacgctgcggctatgcaacgtctcatgagagcgctggccaggagtgcactagatttgataantgggctgcgattatatattaaagtagagcacacaaatagtcccagcacattaatgtacatgatcctggaaatttctccagagcctgtcagtacaagttgttgatgccatgattggagctgaatgccatctacaggtgtcatcgcatgctccgtcattcttcagccaatagggagatcatacctgttagttatctgccagatctttccaggtacaccatgcggaggatcctcagtgggttaacggccttgttggaaggtggcattcttcctcattctcatgtgtgtggcccatagttcagttagtccgttgctgcgtttcacacagggtgtgtgtgcctattacttatgtgagtccgttcgtcttgagttcattgcaaggcttatcaattctacccggaccgaaaccgtttctcatttgaaagggaaagggggtggaacagaatctctctagggtaatgtatagccaatgacgggaagcggccagcatttggcctggggaatgcggcgcatcccctcggcgtaccagggcagaggaatggttagtatccccg

SEQ ID NO: 609437 - DNA, 115 bp, Homo sapiens
ctctacgaagatccacactagcagcccatagcactctgcgcaaggtagccctttgtcttacgagacaggaagccgccgctgttcttcacggcaacgtcaagcgttctcctcagga

SEQ ID NO: 609438 - DNA, 308 bp, Homo sapiens
taaagttttattgttagcatttgctctaataatatcctttgatcctttcgctataaacacacacacacacacacacacacacacacacacatatatgtgtgtgtgtatatatatagtttgcttaaaaataaccaaatttggccgggcgcgatgactcacgcctgtaatcccagcactttaggaggctgaggcgggcggatcacgaggtcaggagatcgagaccatcctggctaacacggtgaaaccccgtctctactaaaaatacaaaaaattagccgggcgtggtggcgggcacctgtactcccagc

SEQ ID NO: 609439 - DNA, 154 bp, Homo sapiens
aaacagatgggctatctgattttaatgttatgcaagtgcaagcattttaggatatacggcaagcttctggatgccactgagaactggtggctgcaatggactgcggaagattgttgatgatgagataaggttaaagaactgggcaatcagaggg

SEQ ID NO: 609440 - DNA, 454 bp, Homo sapiens
  misc_feature (20)..(20): n is a, c, g, or t
cgaatctcgagctcgttacncctaattggttcttcgatgacgccctcggacacatgcgcgtgtcgccagggagtgctggtcgacaccgcggtccttcagacacgggcccgagtcgcccgggtcccctggtggaccccgctggacatcgggtacgggcacgagtccccggggacagctggtcgacccctcaggcccactgacatggacccgagtcccctgggacagctgctcaaaaccaagggctctcggaccaaaatgcaagtcgcccgggagggctggttgaccccgcaggcgctcggagctgggccggagtcgccggggacatctgttggaatcccggtgcctcgggaatggtcacgagtcgcccgtgagacctggtcgacccagtcggccctcaaaaccgtgcccgagtcgccaaagacatcgggtcgaccgtcatcgaagaaccaattag

SEQ ID NO: 609441 - DNA, 565 bp, Homo sapiens
gtggttgccgtggcttatagataatcacgtcattttctaagacccatctagtctctgcacagtgcaaataggtaagttgaatcaatgagggtttggtgggagtcaccacccgtgcctccttcggatcctttaatggtggcactcatctcggcagtccctccagaaatgcagtattcctttcagtttactgttttcccaggtagaggcaattctagtggcctccacttggccttttccaccgtaatagccctcattccacaggtcaagaaaccagtatggggattctgccagctgctgtgtcaaactattccaattttgcatctggaattgggaagataaccacaggatgggttcagggacctgctgtgcccactgtgagatgcacctgacctaaaattccattgatcacctgacctccataagccctgactctgactagtggaccatggtgacattttgggtctcctggaatcagggtcagttcagagccagtgtccagcagtgtccacaaaagttctgattatttccttttcctcagttgcacagttacactgttaaaatgcct

SEQ ID NO: 609442 - DNA, 236 bp, Homo sapiens
  misc_feature (91)..(91): n is a, c, g, or t
ccccccccttaaccaaaggtttattttgggggttaaaggacagggtttctggccccccccccttttttgaaaaccatttttgggattaaanctccctttcccagggaaaaagggttgtttcccccccccccccgggggccctggggggtgattttgggtttgtattttttaaacaaagggccttgccctttccctttgtaaaaaccctttgccagggttttaccccgttttaccca

SEQ ID NO: 609443 - DNA, 218 bp, Homo sapiens
acaagcacatacaggttttagtgtgaacctaagtcttcattttctgggataaatgcccaggagtgcagaggctgagtcgtctggtagttggatgtttagctttttaagaaactgccaaactttcctggagtaactgtgccagttcacattctcaccagcagcgtatatgtgattgtagatttctcggaatccttgccatcatttgtcaccgtccttat

SEQ ID NO: 609444 - DNA, 517 bp, Homo sapiens
  misc_feature (468)..(468): n is a, c, g, or t
tcggctaggtacgaggctgggtggttgaattccgcaatgtcacctttacttatccgtgacgtgacgtacctgcattgcgtaacatcaacctgaaaattccggcagggaagacggttgctctggttggacgctctggttcgggtaaatcaacgcatcgccagacctgatcacgcgttctttactgatattgattgataggcgacatactcctgcatggatggtccacgatctgcgcgagtataccctggcgtcgttacgtaaccaggttgctctggtgtcgcagaatgtccatctgtttaacgattacggcttgctatcaacagttgcttacgcacggcactgataccacgctacagcccgtgaagccacaattgaacgaagtcggccgccgctattgcgcctatcgtccatgcgcatcttcactcaagtaatgactggactataccgtgtctcgattacagctggatnttggtgaaaaccggacgtgtctgcctctctggtcggtccagcgctcatc

SEQ ID NO: 609445 - DNA, 262 bp, Homo sapiens
taaaaactttttaataagtgccattctgactggagtaaaatggtatctcactgtggttttcatttgcatttccctgatgattggtgatattgaacatttttttcacgtttgttgccaagatagatatttcactgtcttatgttcaagaagtctggaggaggtcaggtcagaactgatctggagctccctggattcggggctcaagctcctgctaccttgccgtctctgcccttcacagcttccactccgaagtccccacatg

SEQ ID NO: 609446 - DNA, 952 bp, Homo sapiens
ctgaccttaggtgatccgcctgtcttggcctcccaaggtgtgggattacaggcgtgagccaccaatcccggccaccagctaaatactttcgagtggttctataaattctgtaagaacagttacccaagactccgtctcaaaaaaaaaaaaaaaaaaaaaggaatattatttttttaaatgtgggttgtaaaaccccagggtggggcccatttttttcttcttttctcttttccccgcgaataccgcgaaaagggggccccaagaggtgtggcccccttaaaaaggggcttaatattttcggccggggcggggggggaggaaggcccggtaaaaacccccagcacatttgggggggagaggctctggaagacccaacggggcgacatcccacgggaggtcccgaggaggtgcaagagaaacacgagcctggaaaccaacgcgggggggcaaccttccggcttctccataaataaaagaggggccaaaaataaaacacggggggggaggagagggaatgggccgctcggtgggtcccccaggcatacaaccacgaggaagaggcacagagggacgaggaaaaaatcctttggaattccaatgaaaaggggaaggttggccagaggatagctgtgaaaaatggcccaacagggtgatcatcagagccgtggggggaaccaggggggagattgttttctcaaaaaaaaaaaggtggggtttattacaagaggcgagcggggggggggcaacaagagcatttgcgggacaacattcgagtttacaatggcgtaaataattgggggggaaacaaacgttggaattccgggtattttattataccacattgtggaagacttcatgctggtgagggacaccgcattcagggataaaattagagtcgtttttataaatggagcgcagggtcagttgtatcggcaggatcggcgataaggga

SEQ ID NO: 609447 - DNA, 815 bp, Homo sapiens
aacacccgaaaagcccaagggaaaaaaatccaaaaatttttaaggtttgaggtttataaatcgttaaaaaatagtgtttaaaaagagccccttcccctataagggcaccaaaatatttaaaattttaagagccatttgggaaaaaacgcgaaaagttttaattcccagggggtaattttacctccaaggttccaaggatatttccttaaccggtgtataaatccccatttggggattggcacaattttataaggggttaataatttaaaatttctacaagaaatcctgacaaggaccccactaaaatttgcctttaaaaatttaattttccaaagaccaggaaccaaatttgtggtcaattgtccagtttaacaaaaggggacttgaatgggataaaattatcctttaattatctagagctacccagttcgaggcttgaatttaatcatagcaaatgtttccttgacagcataatattaccatacaccatattaccttataattgccattacagttccttatcaaaaatgttaattctttgcgtgagcaaaaatcaataaaaccttatgtttgaccctaaagtatttgatcagggaacagaaggtgtaaattggacagatcccccgaataactttcttcaatcaagttgaaaatccaaacagctatgtaagtccccaggagagctctttttcccttatcttctcatttgttttgttataaactgtttaaatagttcaaatggttgtgcatgcctaggggatgaaacctatgtaatagaaatgtactgttttatgaataaggagtaaaattgtttt

SEQ ID NO: 609448 - DNA, 317 bp, Homo sapiens
  misc_feature (109)..(109): n is a, c, g, or t
  misc_feature (116)..(116): n is a, c, g, or t
  misc_feature (118)..(118): n is a, c, g, or t
  misc_feature (136)..(136): n is a, c, g, or t
  misc_feature (140)..(140): n is a, c, g, or t
ctgctacggacgccctgaagaaaatgaatggaggtgaagtgcaacattcattttccaagctactttacctttcacagatcatcgccacgcctccagtatttcgaatgtncgatgtntnaacatgatgatgcttttntgcnccgatacgcgcgttacccagggcacgccttggagaaaattgaaaagtggagccctggtattgctgaacgctattgcgaaatctggaagaagaaatcatcccttgcagctatggcgaaagcgttggtttttcaccattgtcgttattgtccgttaacgcagacctgcgtccgtagcgg

SEQ ID NO: 609449 - DNA, 115 bp, Homo sapiens
ccacttagctccctagtaatagggactattataggtgtgcgccaccccacccggctaattttgcatttttgtagacatggggtttcgccacatgcccaggctggtctcgagcccc

SEQ ID NO: 609450 - DNA, 346 bp, Homo sapiens
  misc_feature (47)..(47): n is a, c, g, or t
  misc_feature (99)..(99): n is a, c, g, or t
  misc_feature (180)..(180): n is a, c, g, or t
  misc_feature (192)..(192): n is a, c, g, or t
  misc_feature (272)..(272): n is a, c, g, or t
  misc_feature (288)..(288): n is a, c, g, or t
  misc_feature (320)..(320): n is a, c, g, or t
  misc_feature (338)..(338): n is a, c, g, or t
tttgattcaggggagacctaccttggggttgacacacgccagaattntggccttcataggcgtcccctgaagctgagcctgggaaggggttgacctctntctgttacaccctcatggagttaccgtgtcgatgacatctgagtggagtgtctgtgctgagggttgcagctgcagctgcgncagggctgtttnagttgctcagacctgcatgtacttggagaattgggaagacctggtgttgaggaagctggctggcctggagaccatagggnggggaggggtgcagantctgggcaacctgggagagttaggggacaaantaaggggagaattgccantcatgggg

SEQ ID NO: 609451 - DNA, 1004 bp, Homo sapiens
gtgttcctttgtgcgatgccggagctcgggcagccgtgattcgtcagaggtcatccgaaaggcgactcacgaggaggctgccatgtcacaaccgggcgtggggatgtccgtcagaacccatggcgtgagaaagggctgacgccgcctcttcggcccagaggactcagagcatgtgtgccgctaatgtgattgcgctaatggcgggttgaatccaggaggcctctgtggagcgatggaacttcgtactttgtcgatgcgatgacacctattgagatgggtgacttcgcctggtagcgtgtgcagtggcttgagcctgaccaagctctatcttcacacgatgccccgggagaggccgggatgagttgggaaggaggcagagtcgtgggtggcacgcgtcatcctggactaactgtaaggggacatcagatgaaaaacatgtgggcctgtcacttgtcttgttagccctttgttgtcgctcgtctctagaggtgagccagagcgtgaagggtccccaggttgggacctggcacgactctcagcggttcagaaaaaacggtgagtaggacagcaatgactagatttctacgcacattcaaatcgcgggatgagtcttctccatggtaggaatgccctaaatccgcccacaggaagcctgcggtcctggaagcgcgagggcctcaaaggcccgtctacatcgttctgccttaggctcaggttgtgtggctgaattatattcgtgtttacacttaagaactcctcatgtacatacctggccgccctgccacaggctcggggttacattattacaccagactagggggttgattgcaaggtcctagaggctggcatttcgtctgtgaaaacattaaagctccaaccgggtcactatcctcaccgaagaggttagagggcaagaaaatcaccccctggccatggttgccacaaggtgtaccagagcaggaaaaaccttcgagaaattttgaagcagcaggacggacaagcca

SEQ ID NO: 609452 - DNA, 268 bp, Homo sapiens
tgtcatgtcaccagcaaatttcaccggaatgcacctatatgcctcttgcagggcagagtcggtccggaaaccaaaaagccgaaacggagccgtgaattacgagagggagcccttgaagctttgtgtattataaccctccacttgaccgagtccttgggtctgtgtgagaaacctggcgcaccccgaaggtcctattttgggtgggggaaccgccttcattgggcccatttttggccgggagaggggtgagaaatggtccgtcaccgtt

SEQ ID NO: 609453 - DNA, 1037 bp, Homo sapiens
tccaggcggccgggaaaatgggggactttcaaactgagcgtggcctaccaaaagcagccgaccatctttcaaaacaaagaagagggtcctggctggggaagaaactgggcaaggagaagctcccgcggtactacaagaacatcaggtctggggcttacaagacacccaaggaggcttattggagggcacctacattgacaaggaaatggccccttccactgggtaatggtgtgtccattcagaagggcgagatcctactctgggaagtgggtagaccaagatagaaaatggcaaagaggaccattggtcaatccgccgaagactattctggcactaactatccggcaatgtacaagccgagcttcgaaaagagggcacacaagaaacatgtgtcgtgaacaccgtgagtccccacgtgagatacaggggagcgtccagaaatcgggtgacactcgagcacacaggtgggacagaggtgccggacctcgtgagacaaaaaaggtgcggcattcaagcgtgtgcctcaaggggtcacacaaaggggcgtgcgcgagagacacaaagaaagaagtttcccagaaagtttcgtgaagagcgtgagacaactcggcaccgatatccaccaaaagaggtacaaataagagcttaatatagacactcattgtacccaaaagaagacaacaagaagccaaccagaaaacaacaaaacaacaaagaacacgaaaaaaacaaggacgagggggattaactataagggagggcgaagaaaaacgacgtagaacaacaagaggaaaaaggaagaaacaagcagagaaaaaagagaccaccagcacacacaaaccaacaaacgcgcacaacaacacaggagaaacacacacaacagaaacacgcaaaagcaaagcagcgccacaacgccaggggaaagccgaacaaacacgaccagaccgaggcaaagaaagacgaagcaagaacaggcgaaaacacaaggaagaaagaaaggaaacaacaagagacaaacacggagacgcggcgaaacg

SEQ ID NO: 609454 - DNA, 1303 bp, Homo sapiens
  misc_feature (438)..(438): n is a, c, g, or t
  misc_feature (443)..(443): n is a, c, g, or t
ggttgcaatcaacatggaacctgagatctgtcaggtatcttcagtcgacctgtgcaagattatttagcacttaggatgccgctagtgcatccgaggggaccgtgacagacgcaatctagccagagcactcactgcgtgccagaaactgcgaagacaagaaggctcactgaacggtctgtacgctagcatctactgccatggtctcagctgcgtagagtagtggtaagggttgaatggacacagacagagtcctatttgtggtccttcagactgctcctgaaggtggctgtaaaggaggtgcgtagagtggccgtatcggatcatgagtcttccgtgagaggactcgtcgtcaagaaacaaggtggccctcaggatctcagcaaactgacgtgacatgtgaggtgtctgcacggtgatctgaaactatcggtgtaccgntgacnatgtgtagtacaaaggatataacggagatgctgactatggtgggagaatgaagggagcgacctggggaaagaggttgctgcgaattaaaagggacggctttggcgaaggaatcccaatgagtttactggaagaataaagtttggtgcacctctttacacattcatagctttgggggaatccacgtacgacagagactagaagggaaagtcctcgcatcgaagaattaccgaatgcgttattacaaaccgataacgattggaggtaaagcaacgggccagacatagcaatatttagcgcttgagcggcttgtgtgttaggacaagaatgcctccgattttgcggagagataagacggaagaccgtcctatgtgccgcgtcggcgtccctcgaagcaagacaatagaaccgattacgttggcgtatagacagacgttccaattgagaaaggggacacatatccgaggttgtatgtcggagatgagcttgagtggggctgtaagcgcttgaggaaactcggacatagaacttgactatggcttagttcaaattttgttcgacgcgtgtatggagaagagccacgaaggcacttttctacgagagataggcaaagaacgttgcaagaaagtgtccccagaggccataaagatgggtagaacattgtgggtgaatactcgtatgcacgaaggaagacgcagggatccgcgctgtgccagagaaaagcaacaggaagacaccaacgctagagagacttggattcatgggtagacatagggcgttgtgacttactcaccttcgggcaatgcactttggacacgttcacgcgtaggtgacgaggagaccgaggccaggaaaagacaag

SEQ ID NO: 609455 - DNA, 471 bp, Homo sapiens
cttactctgcccttattatccaataaaacagcgcagcaggcatttggggcactatcggtctctgcgtcttggtggtagtggtcccccaggcccagctgtcttttcttctatctctttgtcttgtgtttttatttctacgatctctcgtctccgcacatggggagaaagacccacagaccctgcagggctggtccctacagtggcgcaatcatagctcactgcagcctccaactcttgggctcaagcaatcctcctgccttggcctcctgggttgctgggactacaggcatgcaccaccacgtctggcaaagttttaatttttttgtagagattgaggtctcactatgttgcccaggctggtctcattctcctggactcatgcaatcctcctgcctcagcctcccaagaagtggggattacaggtgttagctaccacaccccactaaaaagctgagttctgtgtttcacgac

SEQ ID NO: 609456 - DNA, 343 bp, Homo sapiens
aattcggttatacattgtcatgatgacagatgagccagaactcactatctggaatacaaaatctcaagggcaaaacaaaaacaaaaaatccaaggtgacaagaagcaatagtgtagtataacaagtcagcaatgtgcatctgaatacccacccaagggctgggtttggaatgcattcttcctagactcctataactgcagcaaataaaacgggtggcttgtgcaaaggagcacatgccttccataaaataccaaggatgagcttggcaaatgttctagtggctctgagagtagcccagcaaggaaaggttctgaattctcccagggtcatcatagtaatgagg

SEQ ID NO: 609457 - DNA, 956 bp, Homo sapiens
gcgtcagtatcgacctagtacaacgctgtgctacaactgacactacgcttgagccagagggcgctagttgacgaaactgcatcaaactctgtagctcgatagggaggtctgtgagggatagccgatcacggaagcttcgcgaggaacacgtagcgactaggatagagcgtgctagatactcatctagtaataaaatggctacacccaggatgctacgagatactgaattctatcggtgcgtgtacgtagatgaactgcgggtactcaccgtgaactctgagtgcgtgacgccgaaagaccatgatgcaattccgggtgagtgaccctagtgggcttacgcccgagtagtactacgcaactacggagatgtacgtggaacgcgcaacgcgaacgtaagactctagcgtctatatgagtgactacgaagtgtcgagcgtatgacggaataacaaaagggtaagtccccacccggcatgaactcaggcgaggcctcatcaggtatggagtggagtcctgccctatgtgcaaacgggttagcctcaaatgagaggcgcatgacatcagacgatagataggaccgtattgcgtctggtggggcatgcccttatgacatagacaggaaacacgaccttacctgaaggggtatataaacacgtcttaaggacacgaaggacgcatatgacgtcgatctgtttactctgcagagactgcgagcgcaactacaggtagatgcaggcgaagtaatagcaccggtaacatggttacatggcaacatagcggcttcgtagctgggtcggccagtgaaaatgtagtgataatctaactattgatgcctcagtcgtgtaaggcatgaaggggcgcatagcagaaaagcgattatagaaactggtgtcgatatgagtcagacaacgcgcaggtaacgcctcgcgtagccctctcacacgtgcgcttttgta

SEQ ID NO: 609458 - DNA, 284 bp, Homo sapiens
ggattgtgaccagaagattttgaaaattaaatattactgaagatttcgacttccactgttaaatgtacaagatacatgacatattaaaggaaatgtgtaactttttgtgtaaatacatcttgtcttgttttcattcaaaaacatttcacttttggggttgcggtgtaaattttgcaggtataattcctggcattattttttggtggtaggattaatttggctgtaagatatcgcgatatgtctacacatactgtatacctcgtgtcatctgtaaggtgagagta

SEQ ID NO: 609459 - DNA, 339 bp, Homo sapiens
tacgccataaattaggaaacacggtatcaccatgaccaggtagtccttgtccagctcatgaacgtacttgcccacgatatccttggagctgaccaggttttccatttcgtctatgagcatttcggcggtccgctcgagttcctctttggcttccaaggcctcttcaagggcccgagccagggacagggccttggtttccttctccctggcttctgcctcagctctgtccctctcatccgcgtatttggaagagatgtttttctcctcggctaacaactgatcaaatttcctctgcttcttttccaggttggacacgagttgccagaagaagaaaatgat

SEQ ID NO: 609460 - DNA, 124 bp, Homo sapiens
gtgatctagcaggatcttcgggagccttaccctatgctaggcttgtcttgagaacatccctcagtaacttgactattcacattgacctacatggatgtcccatctggcagggctgagtcagttg

SEQ ID NO: 609461 - DNA, 1255 bp, Homo sapiens
  misc_feature (255)..(255): n is a, c, g, or t
  misc_feature (956)..(956): n is a, c, g, or t
  misc_feature (1030)..(1030): n is a, c, g, or t
  misc_feature (1099)..(1099): n is a, c, g, or t
  misc_feature (1103)..(1103): n is a, c, g, or t
  misc_feature (1134)..(1134): n is a, c, g, or t
  misc_feature (1136)..(1136): n is a, c, g, or t
  misc_feature (1172)..(1172): n is a, c, g, or t
  misc_feature (1202)..(1202): n is a, c, g, or t
  misc_feature (1253)..(1253): n is a, c, g, or t
gtgtgacagtgctgttcgtcttccttaatacttcttagaagacctctggaatcggtgccgacgtacactggatatcacaagtctctgtgatcacctaccggagcctgagaccgcccggccgcgggtgtgacatgacacagtatttcgctctccgcctgttcatccttttatgccactctgtattggtgctatcagaggtcgagcgtcacgcgacgcccactacgcgttgcctttagttgtctcgcccccgagcgntcaggccttaccatctagcgcttactcctctccaagtcgtgttcgctgggagttcatcccatgcccactttttccgcacccgatctaggaagtgggttacgcgcctcgtcatcatcctaccaagtatgtatgtatctctcctctccactcatccacccatctttaaagtccccttctgtctatactgatacagtaatgactccctcctttgtcagtcgggcatgagccttactgctcgcgggtgcatcccccacgcatacccgagcgccaggctgaggcaagccgattatgccatacttaccgcatgtcgctatgattcggtggtcgaaacaaccaataccgataaaaaaaaacatctgaacatcactttaatcgtgacctgcgtgtggagccatcaactttatcgttgtctaggtgccgtcgacgcgtcacaacggagactcattgattactttacgattgtttactcatctcgattttgcgttactgtcttctattattcgtccatacttacacatcagacatactcatattgaccttaactctcgcactcatcttcccaccgacgcgcggatgcgtgtcttgtactatgtcgtacagtcgtacgtactcgacgcatctgctagacgtcggcctcccagttacctcgtctactgttacgtagtgacgaccgtgctctccatctaatactgacgctactngtcgtcgaccgaccagtagtcgtatcctaaatatactcgagcatcttgtcactcgtacgcgctcctagagtagnctagatatctggtatgcagatatgcgagacgccagcacgctctatatgtatgtaactcgcgactcaagncgcncatgctgcgcactgacacgcggcgcgctcgngngtatagctcgtctgctcgcaccacgagacataccgncttcctgctctctcgtatatgctcgtctgnctcgcactcaagatcgctgacgacacatgcaacatacacagcatatgaatnag

SEQ ID NO: 609462 - DNA, 236 bp, Homo sapiens
ctcaaactgctgcccgggagctgaagctgcagtgtgagggattgcggcaggagctccagttggcgggcgccccgtagcgcccccgtctgtgcagacacctcctgggcgcttccgcatcctaccctgtagaagctgaacgagccccgcaagtgcttcctcgaggtggcccacgagcagccgggcaacctcaatgcctgggccaatctggcccacgtgtactgccgcacccggtgacg

SEQ ID NO: 609463 - DNA, 109 bp, Homo sapiens
acatggcgactcccggccctgtgattccggaggtcccctttgaaccatcgaagcctccagtcattggaggctagccccaatggttaacagaattccagagagtttcaag

SEQ ID NO: 609464 - DNA, 532 bp, Homo sapiens
tatgagtacaaattcagtggcctttgctttacgacagctagtccctattagcatttcttctttttccccgggggtactttctgatgggtaagggcgtcaagcacagctgtggtgtgaagagttagggccagtgtcttgaaaatcaatcaagtagtgaatgtgatctctttgcagagctatagatagaaacagctggaaaactaaaggaaaaatacaaatgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaacaaaagactatctggataacttataggaaagcctagaacctcccagtagagcggggatttttttctct

SEQ ID NO: 609465 - DNA, 122 bp, Homo sapiens
caaagcaagttggcacagaatttacaaaaatgtcagggcaggggagcatgcgagcataattcaagatagaaagatagagacagcctcccttgccctgacatttttgtaaattctgtgccgac

SEQ ID NO: 609466 - DNA, 208 bp, Homo sapiens
agtctaaattgaatcaacaattgctgaacgttctggtcaatcttcattattaaaagcagcttcacagctgggtgatttctgagtcaaatgtataacgaagcttgtcactatatcaagtctcttctctgggaggaggcatgggctgagatacatcttgtgctcaatatagctccccacatcgagtatttcacagcaatttctaggttga

SEQ ID NO: 609467 - DNA, 262 bp, Homo sapiens
tatcaatcagtcgctgacagcatcttatgtcactccgattttcataccacaccgtgtgctacacacataacgatgaattaatactattacatccgcatgggctccccagggtattgactggatattcggagaagaatatgcttcattcacggacagtttctattgccgcggtcgcaataacattatctgtcctaactttttccctttttaaaaaattctaaagcttcatgactttttaaaacatcacttcttggctgggtgc

SEQ ID NO: 609468 - DNA, 419 bp, Homo sapiens
gctgtacttccggcagaagctcagatgtttcgcaagaagctttcatcaaggcatattattctctagagacattgcagaacgagtacgccttttcatcttggatcactcgtattgtatctcgtttgtgtcacgatccggcattccagaaaaaaagaaaagaagaagtgatcgcacgagacaatattttaacaggaaagccactcactcaaggattcgatggaacatttgttggttgcggattcatctcgaaaagggctatgcaaaaactttctcctgaacaaccggggaaacttattggtattaccggggatattccaggggcttttaacttattgactgaaaatttgcctgaaatccttacagatacccggttggacagggtaaccagacccgtcgggggtaacccgagctccgaaatt

SEQ ID NO: 609469 - DNA, 86 bp, Homo sapiens
gagtgtcagcaggatttggaacaacctttttccccttacttatgtctactattaaacatattttaatacctttgaaaaaaaaaaaa

SEQ ID NO: 609470 - DNA, 829 bp, Homo sapiens
agcggataccgcgagcgagagcacctcccgagtcagcgcccgcgccctccgctgccgttctcctgccgggacctcgagcgaaagactgccgaggtgaaagatgagatccttggttgtactgggacgaacagagttctccgcattccatcgagcgaggagcggggctgcggcgagcggtatgggccagacaaccgtggggcaactgggcacacaacacgtgcagcgcagctcagcaggtatcagaactgagaagtcgaccaacagtacgaacatagaaacagcgacggagaggaaatccgtgcgtagagaagagagcaccctgtgacctcacggcagaagtagacgagaacgctcgcgccaaagaaacggcgaacgaggtaacgttgcaagacgtcgtacaaagaccacatgggcgcagacctggccttgcaaccggatcgccgccgaatcagcaacatgcacacaaggactcaaggagcacgcgccaacaaatgtggagaacagaaaaggagttgcggcggaacacccagacactcgacctgaagaagaccacgaaggcggtcggaacaacggcgcagggcaccaagcccaccttggaataaccaactgtcgactgaggcacaaccaacgcacataacagcccctcctctgacaccacactagcctgtcggcaaggcgagaacccaacacgggacacaaaggaccccccgacgaagagttgacacacacctgcctaccacgcgcgacaggggcacggcgccacgttgatggcaaaaagatcacccaataagaggaatagggcgcggaatgagcgagactaacggcaaac

SEQ ID NO: 609471 - DNA, 952 bp, Homo sapiens
ggcagtacattgagctccatagagacagtgccggggtcagagtgtggagccggacgggcactgggcgacttcctgtgccttcgcttgagtgcaaagataatcgtaaacgatgggcagataggaggatcctaatgaagcctgagaggccaagacatgtcagtcatatcgcagttcttgtgtcgcataacttgtcggcgaggagcattaacgaaggaacgcagcccacgatgcttcagtcagactttctcagaggtttgcgtagaggaatgtgctcatgatgacgcgtgtgagagaccatggtctgactagatgagacatcggaaccctttgactgactgttgcgcacatatgcggtaccaagtgccccgttatcgaacagcgagagactattgaatacatcgctagtaatctcgctcccatagaaggggcagagcaaatgacagacacgttcaatggagtcccaaatggtcgagccctatagaaggctctcctatctggcctttcgttcctcttccttgctctggaggtatcgccctagaagtcgacggacgaacattgcatggactgtccgagttggctgattgttcgtcgaacgagaactgggtagatgatgtcgggaatacactacctgggtgcagaattgagcaagcgagcctttgatcgcactgagatgggcttgcgacagctgaaagcgcaaaatttgccgagacaggatattcgctggcattatcggagctagaagggaatacgccctgattgcggtcaaacaaacagggaagttgtcgacggctgaaattcatggccacgtaccgcctggaacctgcatggcacgcagcgacgaattcagggacgcactgaacgagcgactcgaggatacgaatggacgcacgcattgcacccaacgcattgccgaccgtatggaagaacgcatgtcagtgagtgactgacgtaa

SEQ ID NO: 609472 - DNA, 624 bp, Homo sapiens
cacatgcttagagggtctggagaaggcgaggaagaaggaagggagccaagtaaaacatgtgactgaccaggggctttggagaagacaagccctgcaggaaggcacgcatgtggtcattctgtctgtagcctcccattcctccctgctttccccagctgcatctacctggatcctgaatttgaaccaagtggtccaatacggtcccggtcacctgtagcaacccctctgcaggaaccgcacaataatggcatatgcaaggtgtgacaaaattgttggcatcagatgaggtaaaagatttgtacaaccacaccaagaaacagcacaataaatctggatagcagctctggcagtcctgtcaagcacggagcaatggactgaactaacgcggaactactctgatttgtgcgcctacctttgactggaatagttacctctgcgactcaacaaggacacagactgagcactgatacactgcagcactggcatgagctcttcaggcacattcgtgtcaacgtaacgagaagctcagattcaacacgatgaacgtcctttcctgagcacttactacatgccagacaccataccaggcaggatgacgcaaaacacggtgatcgtgacatggac

SEQ ID NO: 609473 - DNA, 284 bp, Homo sapiens
ggtacgtcagccactgcgctgttagctctgatgaggtaaaagcaacttaactttgtctatctaattctcctgagtcatgaaagaaatttactttcagctctggatccacatgagggtatttgacgaggaagtttgtctgccctctgcttctgttgtaccttgtgtgaggcaatgacaacatcccatctttgcattctgtctaaatatcatattcatggaaatagaaacataacttccacaaacaagccctttccatcttactggcgtacacccgatacgctcct

SEQ ID NO: 609474 - DNA, 273 bp, Homo sapiens
  misc_feature (12)..(12): n is a, c, g, or t
  misc_feature (14)..(14): n is a, c, g, or t
  misc_feature (121)..(121): n is a, c, g, or t
  misc_feature (218)..(218): n is a, c, g, or t
  misc_feature (263)..(263): n is a, c, g, or t
ctggtacctccntnacatcatcactcgataccaggagaccttcaacgtcatcgagaggtgccccaagcccgtaattgctgccgtccatgggggctgcattggcggaggtgtggaccttgtnaccgcctgtaacatccggtactgtgcccaggatgctttcttccaggtgaaggaggtggacgtgggttttggctgccgatgtaggaacactgcagcgnctgcccaaggtcatcgggaaccagagcctggtcaacggagctggncttcaccgcc

SEQ ID NO: 609475 - DNA, 285 bp, Homo sapiens
  misc_feature (8)..(8): n is a, c, g, or t
  misc_feature (10)..(10): n is a, c, g, or t
  misc_feature (18)..(18): n is a, c, g, or t
  misc_feature (31)..(31): n is a, c, g, or t
  misc_feature (105)..(105): n is a, c, g, or t
  misc_feature (271)..(273): n is a, c, g, or t
cctgctantntcaggcanggagtccctcgcnggcacccggaatgggagttcacacgcgaattcctgccgtgtcctcaggacagctgctcggcccacccaacagtntgcgtgcggccaccacggactgcggccccagcacatcccgggagctccacggagccacctgtcgcctgcctgtggtggggccgtggcgtgagacggcaaaaatgactcacacacacatccagatagagaagctgccaccgtctttttaaaattaaacttttaattnnnccatcatcgtaa

SEQ ID NO: 609476 - DNA, 187 bp, Homo sapiens
aagtatacctagatggcaatttaaattagcgcggcagtacagtgcgggaaaccctataattgtgttaagtatcttttttcccatatggggtctcactgatatggtccaggctggactcacagtcctgatctcaagcaagcctcgcaccttggtctccagagcctcgggagaccaaggtagagccgag

SEQ ID NO: 609477 - DNA, 180 bp, Homo sapiens
gtgatgtatccaatgaatactgtatggcctgaaagctactatacaatcctgattcttaactgagaagggaagggaataagagactgtcacaaagccctgggatgcttctctggagttatgcagggaaacatggaccctgggcaagcagctctgggtgtcctagtgaatgtgattcttggg

SEQ ID NO: 609478 - DNA, 697 bp, Homo sapiens
atcttatctagtaatgtgatgaagtgatgatgtctgaactctacttagagagtgtatgatgtgtctaacagaacaaccagatgctctgtgtgaattccttcctgtagcggcacactgcaggatttccatgtagatagaagaactatagggcctagtacagcaggtgcacacaaatgtggcacagtccaaaaccccatgaattaaagacctactggaatggggtctgtgagggagtttggtaattagattatctcttttgtgatttttcattcagatctatatcctctatgggtcagctcagctttgaaattggctgatgaataggaaaatatacataccgagggtaacaattcacacatacagagaaacaaaaatgcacaaagcctgcttcagtaactttttgtttctggaattgtttccactttgcctttttcttgccaaaacgaagtaatcaaagagctcttgctttaacctcattccgtgtacaaagactgtcttttgaccagataatcatctgttgtggcgatctatcattgtaggacactgtatattgccaaaatagtggattcatggaacggggccagttgcatgtctaaacatcgcagagccctgggcagtcttaaaagcaggctcaccaagcatcggtgatagcatgtggtgggaccaatgccccttccccactcttcagcccgagtag

SEQ ID NO: 609479 - DNA, 125 bp, Homo sapiens
aaaacttacgtatggtccctgatcattaagaattcagaagtcttctgtaatgggatcagatctttcatctgtagtgtaatgaaatgttgacagaaagataacttgttcattaaaatatttttcga

SEQ ID NO: 609480 - DNA, 148 bp, Homo sapiens
tgaactccgcctccctggttcataattctcctgctcagcctctccagtagctggattacaggcgcataccaccacgcgtgcacttttactttattctttttgagcctaggatgacagagctaagactccgtctcaaacaaaaaacaaa

SEQ ID NO: 609481 - DNA, 570 bp, Homo sapiens
  misc_feature (404)..(404): n is a, c, g, or t
gtttaaaaaatataaaggatagaaatgcacacatgaatagtttaaaggaatgtacctgaccacagaggtaatatatacggcttacacaaggcatactttacaccgttacaacttctactaaaaggagggattatcatacgggccttacaagatgtgagcacttaacgataccggggccacagtgaccaaggaagcttctactaaattgttatataagtctgcactcatcgaaagagcacagagcatgggctaagttacatcccaatgccgagggaagccctgagatcccaatgtgacgtgcaaagggataccgaagaataactgtatatcttgaaaatggcaatgctctgtttcccagggaagaagcataggtatactggcctgctgcaagcaagcatactgtntttgcagctaaatatccaaataaacgagttgtgaggatgacatggcatggtgcaaaaagctgggttaaccgcaagatgacagaagtgttcaaaagacatgagaggacatgggaagcatcagcgcaatccacagaataggaaatgctgtgacgcttagtaactaatt

SEQ ID NO: 609482 - DNA, 186 bp, Homo sapiens
cgatcatctgtcattttctccattaacttcagtcaaattttacgatcatacacccaaaccagaatgacgaagagtacaatagactggcagtaccatagtgctgtgaggtgccgtgtttcttgcgggtaggagtgtccatggctcatctggggcttgcaggctgaactgcaaatgcaacctcctttt

SEQ ID NO: 609483 - DNA, 920 bp, Homo sapiens
atcagagcgtaaggccctcgcagtggaagatgatgctcaatatcgatgtctcggccaccgctttctacaaggctcaaccagtcattgacttcatgtgcgaggtgctggacattcgcgacatcaacgagcagcgcaaaccgctcaccgattcgcagcgcgtcaagttcacgaaggagatcaagggtttgaagatcgagatcacccactgcggccagatgcgtcgcaagtatcgtgtgtgcaacgtcactcgccgccccgctcagatgcaatcattcccactgcagctggagaacggacagaccgtagagtgcaccgtggccaagtacttcctggacaagtaccgcatgaaattgcgctacccgcacttgccctgcctgcaggttggccaagagcacaagcacacttacctgcctctagaggtgtgcaacattgtggccggacagcggtgcattaaaaagctgaccgatatgcagacgtcgaccatgatcaaggccacagctcgttcagctccggatcgtgagcgtgagattaacaacttggtaaagcgcgccgattcaacaacgattcgtatgtgcaagagttggcctgaccatctccaattcgatgatggaggtacgaggacgcgtcttgcctcctcccaagcttcagtatgggggacgtgtgtctaccggctcacggcagcagtgtccgcacagaacaaggtgagcttggctcgccacaggtgtttggattgcgaggcagcagccttccctgggtcggagaccgtttggccttcgctgtttgccccaaggcggtggcgaggttgccgggatttcccccggcggcgaattccaacgggcggctcggatggacccggttgtgagtcccccgggcgctagggccaatcgctgaactccccggcctggggtgccgcacctcgg

SEQ ID NO: 609484 - DNA, 1191 bp, Homo sapiens
ccctcgagaagcttatctagaccataacagtaataggcgcagcggagcccagtaaggtaagtaagaacataggacaaagctagtatatcctaatggaagatacctaaggtacatagactaacgtagctataggataactacaccaattaaaaaaacgcccggcgggcaaccgagcagtatctagaacaaataccagataagagtttctaaagggtacataaactaagagatctatacaagcaaggaagttaccaaggcgagcatcgattatacaagatatacgcgcgccgagtgccaggatgtggcggcgtggtggggcggggggagggcggggaggggggggggggtgaggggggggggggggggggggaggggtgggggggggggggggggggggggatgcctgtggcgcgaaggcgaggggagcggggccggagcggcaggtgcggcggcgacgacgggacgcatgatcatcactatgcccatgctcgttgctggtcggcctgcgcgcgtagcgctcagcaaaccagatcagcgaatcacaagaccgtcatggaagacgacacgctgctcattagaatagctcgcacctccagccgtagaagacaaacatacataatatacatacttccataataaataaataaatacacataagctagatagacacaaaatatatcagagttgagtgacgacacatcgaccacatgcgacagaggcagttcatcccgctaaccgaatacgacagaggctaaacacgcgcatcacgcaccgagcgcgacgctccgacgtcgagccacgagacgcgtagatcgggcatgtagaatgtacggatgcgagagccataaagcgtaaataaacacaacgaagataagcggcgcagcatgacacaggaaaaaaaaagaaaaagaaggagatagcaccgacgaggacgagaggtctgagtgacataagagacgtcagacacggacagacactgcgacagccagcgagctcaagacagtaggtagagcaccagctccacgacacactcagcggagacacggagtagcacacactagagcaggacacgagacggacgatgggagcagggcaggagcgacccgtgtgtatgcgggccgatgcgcagcgcgcctagcagagcgtaggcggagagagggactgagcgagggctcagacccggcgcgccgg

SEQ ID NO: 609485 - DNA, 718 bp, Homo sapiens
  misc_feature (42)..(42): n is a, c, g, or t
  misc_feature (56)..(56): n is a, c, g, or t
  misc_feature (84)..(84): n is a, c, g, or t
  misc_feature (93)..(93): n is a, c, g, or t
  misc_feature (184)..(184): n is a, c, g, or t
  misc_feature (229)..(229): n is a, c, g, or t
  misc_feature (267)..(267): n is a, c, g, or t
  misc_feature (285)..(285): n is a, c, g, or t
  misc_feature (308)..(308): n is a, c, g, or t
  misc_feature (323)..(323): n is a, c, g, or t
  misc_feature (354)..(354): n is a, c, g, or t
  misc_feature (358)..(358): n is a, c, g, or t
  misc_feature (362)..(362): n is a, c, g, or t
  misc_feature (378)..(378): n is a, c, g, or t
  misc_feature (383)..(383): n is a, c, g, or t
  misc_feature (390)..(390): n is a, c, g, or t
  misc_feature (398)..(399): n is a, c, g, or t
  misc_feature (405)..(405): n is a, c, g, or t
  misc_feature (428)..(428): n is a, c, g, or t
  misc_feature (430)..(430): n is a, c, g, or t
  misc_feature (448)..(448): n is a, c, g, or t
  misc_feature (468)..(468): n is a, c, g, or t
  misc_feature (495)..(495): n is a, c, g, or t
  misc_feature (524)..(524): n is a, c, g, or t
  misc_feature (548)..(548): n is a, c, g, or t
  misc_feature (560)..(560): n is a, c, g, or t
  misc_feature (640)..(640): n is a, c, g, or t
  misc_feature (657)..(657): n is a, c, g, or t
  misc_feature (680)..(680): n is a, c, g, or t
agcggcgcgctaggtaagatcgggttccgtttttcccgcggnttctggtgcctgtngggccggtgacccaacaccatgaagganacgccactntcaaactgcgaacgccgcttcctactccgtgccatcgaagagaagaagcggctggatggcagataaacctatgattattggatcatcaggntctcatttggtacagattacggatgctgcattgtggacttggaanacaagagttcttggtcaggttttctgtgaacttgtgtntacaaaactcaatcgggnaacagaaggtattcttttttttnaccttgaactctctnagaaggccgctccagctttcgaacctggcangcanttanatctcttggtgaagtngaatngactcanggaaaganntctaanaaattcgaagtgtatagacactnantctctctgtgttgttgcnggtgaaaaggtttggcaaanacgtgtagacctacatttattaaatcntgatggaaatattattgatgctgccagcnttgctgcaatcgtggccttatgtnatttccgaaganctgatgtctctgttcaaggagatgaagtaacactgtatacacctgaagagcgtgatcctgttccattaagtatccaccanatgcccatttgtgtaanttttgcctttttccagcaagganatatttattggtggatccaatgaacgagaagaacgtgt

SEQ ID NO: 609486 - DNA, 308 bp, Homo sapiens
cgctgaagctctctctgatgccttcacaaggacgtcgttttatgcagagagggttctgctaaacatggggatcgtcagttgcttcacttcccaccccccaacctccccatgactagggacagctgcaggcaaagaagatcttttgtttcttccaagttcatctgtttcccctgccaggattctgcataagctaatcagatatatacattaccaaataaaagaccatcagtcaatgtgaatgattcttaatgtatcctcttatcaaaacatttactgaggccaggcgtggtggctcacgcctgtaatcc

SEQ ID NO: 609487 - DNA, 496 bp, Homo sapiens
atctagagatccgtatgtatcgccacactatatttattatcacatgggatttcgtatattctgggaatgcaggcactctgtcttatcatggctgaatacggtaggcttatacttcacaatatatagcactttcaccaagggctgttgtttggtttaggtttattgtgtgttttaatcagcttccagaattgccatgcctcacctgtgaagtgggataggcagggtacccaagaggtgatcactccaggtggtgtctaagccagagctaccactgagcctaggagccctgatcctcaatattgataattagacaaaacttcctcaaaaatgttagaggaagagtaataggattgtgctacaatgagccatgtccatctctctcctgttgtatacttaaaagaaacactgactgcattgaggggaatcctaaaaacataaccctaacatggcactgttgcaagactgccccttggatcccatagttcgtgtggtactt

SEQ ID NO: 609488 - DNA, 4955 bp, Homo sapiens
  misc_feature (5)..(5): n is a, c, g, or t
tggangaaaacttaatcgaaacctggtcatcgggctgtccgggagctccggctcgggctgcggacgccatggagcttgctgaccacctggtgaagcgggcggctgccgtgcaggcggatgatgtggaggtgctgaaggtggggaggacccagctgatcgacgccgttctgaatctgtgcacctaccatcaccctgaaaacatccagctcccaccggggtaccagcctccgaacctcgccatctctaccctctactggaaggcctggcccctcctgctggtcgtcgccgcattcaacccagagaacatcggcctggctgcgtgggaggagtacccgaccctgaagatgctcatggagatggtgatgaccaacaactactcctacccaccgtgcaccctgacggatgaggagacccggacggagatgctgaaccgtgagctgcagaccgcccagcgggagaagcaggagatcctggccttcgaggggcacctggcggccgcgtccaccaagcagaccatcactgagagcagcagcctcctcctgtcgcagctcaccagcctggacccccaggggcccccccggaggcctccccctcacatcctggatcaagtgaaaagcctcaaccagtccctccgcctcgggcacctcttgtgccgcagccgaaaccctgactttctcctccacatcatccagcggcaggcctcctcgcagtccatgccctggctggcggacctggtacagtccagcgagggctccctggacgtgctgcccgtgcagtgtctgtgcgagttcctgctgcacgatgctgtggacgatgctgcttccggggaggaggacgacgagggcgagagcaaggagcagaaggccaagaagcggcagaggcaacagaagcagcggcagctgctgggccgcctgcaggacctgctactgggcccgaaggctgatgagcagaccacgtgtgaggtgctggactacttcttgcggcgcctcggctcctcccaggtggcctcccgcgtgctggccatgaagggtttgtcgctggtgctttcggagggcagcctgcgggacggggaggagaaggagccccccatggaggaggatgtgggggacacagatgtgctgcagggctatcagtggctgctgcgggacctgcctcgcctgcctctgttcgacagcgtcaggagcaccacagccctggccctgcagcaggcaatccacatggagactgatccccagaccatcagcgcctacctgatctacttgtcccagcacacgcctgtggaggagcaggcccagcacagcgacctggccctggacgtggcccggctggtcgtggagcgctccaccatcatgtcccacctcttctcgaagctctccccgagtgccgcgtcggacgccgtgctgagcgctctgttgtccatcttctcacgctacgtgaggcgcatgcggcagagcaaggagggcgaggaggtctacagctggtcggagtctcaggaccaggtcttcctacgctggagcagcggggagacagccaccatgcacatcctcgtggtccatgccatggtgatcctgctgacgctgggcccgcctcgagccgacgacagcgagttccaggcgctgctggacatctggtttccggaggagaagccactgcccaccgccttcctggtggacacatcggaggaggcgctgctgcttcctgactggctgaagctgcgcatgatccgttctgaggtgctccgcctggtggacgccgccctgcaggacctggagccgcagcagctgctgctgttcgtgcagtcgtttggcatccccgtgtccagcatgagcaaactcctccagttcctggaccaggcagtggcccacgacccccagactctggagcagaacatcatggacaagaattacatggcccacctggtggaggtccagcatgagcgcggcgcctccggaggccagactttccactccttgctcacagcctccctgccgccccgccgagacagcacagaggcacccaaaccaaagagcagcccagagcagcccataggccagggccggattcgggtggggacccagctccgggtgctgggccctgaggacgacctggctggcatgttcctccagattttcccgctcagcccggaccctcggtggcagagctccagtccccgccccgtggccctcgccctgcagcaggccctgggccaggagctggcccgcgtcgtccagggcagccccgaggtgccgggcatcacggtgcgtgtcctgcaggccctcgccaccctgctcagctccccacacggcggtgccctggtgatgtccatgcaccgtagccacttcctggcctgcccgctgctgcgccagctctgccagtaccagcgctgtgtgccacaggacaccggcttctcctcgctcttcctgaaggtgctcctgcagatgctgcagtggctggacagccctggcgtggagggcgggcccctgcgggcacagctcaggatgcttgccagccaggcctcagccgggcgcaggctcagtgatgtgcgaggggggctcctgcgcctggccgaggccctggccttccgtcaggacctggaggtggtcagctccaccgtccgtgccgtcatcgccaccctgaggtctggggagcagtgcagcgtggagccggacctgatcagcaaagtcctccaggggctgatcgaggtgaggtccccccacctggaggagctgctgactgcattcttctctgccactgcggatgctgcctccccgtttccagcctgtaagcccgttgtggtggtgagctccctgctgctgcaggaggaggagcccctggctggggggaagccgggtgcggacggtggcagcctggaggccgtgcggctggggccctcgtcaggcctcctagtggactggctggaaatgctggaccccgaggtggtcagcagctgccccgacctgcagctcaggctgctcttctcccggaggaagggcaaaggtcaggcccaggtgccctcgttccgtccctacctcctgaccctcttcacgcatcagtccagctggcccacactgcaccagtgcatccgagtcctgctgggcaagagccgggaacagaggttcgacccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggagggtgagtcaggccctgcttcacccacgccagatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 609489 - DNA, 1844 bp, Homo sapiens
  misc_feature (20)..(20): n is a, c, g, or t
  misc_feature (26)..(26): n is a, c, g, or t
  misc_feature (40)..(41): n is a, c, g, or t
aacttacggctagtagagcngggtgntaatcggccgaggnnccctctgcctctctggacttcctctgggcctgcatccatgttcctcgcatctggcaggggcgggaccagcgcaccccgcagaagcggcgggaggagctggtgctgcgggtccaggcccggagctcatcagcctggtggagctgatcctggccgaggcggagacgcggagccaggacggggacacagccgcctgcagcctcatccaggcccggctgcccctgctgctcagctgctgctgtggggacgatgagagtgtcaggaaggtgacggagcacctgtcaggctgcatccagcagtggggagacagcgtgctgggcaggcgctgccgagaccttctcctgcagctctacctacagcggccggagctgcgggtgcccgtgcctgaggtcctactgcacagcgaaggggctgccagcagcagcgtctgcaagctggacggactcatccaccgcttcatcacgctccttgcggacaccagcgactcccgggcgttggagaaccgaggggcggatgccagcatggcctgccggaagctggcggtggcgcacccgctgctgctgctcaggcacctgcccatgatcgcggcgctcctgcacggccgcacccacctcaacttccaggagttccggcagcagaaccacctgagctgcttcctgcacgtgctgggcctgctggagctgctgcagccgcacgtgttccgcagcgagcaccagggggcgctgtgggactgccttctgtccttcatccgcctgctgctgaattacaggaagtcctcccgccatctggctgccttcatcaacaagtttgtgcagttcatccataagtacattacctacaatgccccagcagccatctccttcctgcagaagcacgccgacccgctccacgacctgtccttcgacaacagtgacctggtgatgctgaaatccctccttgcagggctcagcctgcccagcagggacgacaggaccgaccgaggcctggacgaagagggcgaggaggagagctcagccggctccttgcccctggtcagcgtctccctgttcacccctctgaccgcggccgagatggccccctacatgaaacggctttcccggggccaaacggtggaggatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 609490 - DNA, 739 bp, Homo sapiens
gcatataatgagagagagagaactagtctcgagtttttttttttaaagagttggagtaagaagaggattaaaaaggaaaggcaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataagggggggaaaaaaaaaaaaaaaaaaaattataaggtaggaatataaataaagggggtgttttttaaaaaatggttagtttgaaaaaatgttgggttaaaaaaatttattatttttagaaaaaaattttattaggtgtggggaaataagtataaggggttaataaatgtgtttttttaaaaaatggtgttttaaatgggaaaagttatattggagggaaaattttttgtaaaattgtggtaaatattttttaataaaggttttttttaaaataagggggaaaatggaaaatttttttgaaaaaaaaattatatgggataggggaattttttttatgtggggaaggaggttttttaaaaaaagtgatttaaagttaaaggggaaaaattttttagggggtgtgttatttggaaaaattattaaataattttgggggtgggggggaaaaaatatatgttaattaggggggtttttataattttggt

SEQ ID NO: 609491 - DNA, 977 bp, Homo sapiens
  misc_feature (977)..(977): n is a, c, g, or t
cactcgcgggaagcgagagtctgagtcgcggggcagctccggtcgcgtcaagcgggagcgagatcgggagcgggagcctgaggaggcgagctcccgggggagacctgtgcgcgtgaagcgggagtcgaaccgggagcgcgcgtgaggccccggttgtgtggtcccgtttgtgcgggtgaagcgggagtcgctgaaggtcggatgaggactcggagcctgagcgggaggtgcgagcaaaagaatggcccgaggggattctgaggaccggaggagccgccatttgcccgtacctggacaaccatttaacaggagtgtgctgggactttgactttgagcaaactgtgtctatctccctctcacatatcaatgcttatgcgtgtcgtgggtgtgtggcaagtactttccaaggccgggggttgaagtctcacggccatacatcactaggtgtccagtttagccaccagtgttttccgtcaaccttccacaccctcagggtttaacgtgcgttccgagacaactatgagcatcatcgagtcctcatggggaggatatcaccgtttgtgtgaagcccactttcaccaaggcggcaaagtgtgcaacactttgcgaccagtgcaaggccaaaaatttgtcgcgggggcatattgagtgggcttaccacctctaccccttgccggcgtaatgtgtgggggccgtgaataacaataaggggccattgattaatgccaacgcgtggtcctccaggggcgtattgaaatggtcctcctctccgggaaatactttcgtggggagaggagattattaagaacctttcacacggtcccccgggggatacaacgttcttggcggggccgcgggttttggggaccgtgtagaacaccctggagccccccacaatttaggcgagtgtgtttcccctatagagcgtcgcgagtgttctgcgggaaacacgagttctcaacaccacggggcgttgn

SEQ ID NO: 609492 - DNA, 810 bp, Homo sapiens
  misc_feature (31)..(31): n is a, c, g, or t
ctttccagtgctttctgtcctgtggtgctcngggccttgccccctctgggtggctggggtggggtgggcagaggtctgcctgggcccttcagttctggtctggccctctctctgtgtcagatctgctggaggttctgagtgacatagacgagatgtcccggcggagacccgagatcctgagcttcttctcgaccaacctgcagcggctgatgagctcggccgaggagtgttgccgcaacctcgccttcagcctggccctgcgctccatgcagaacagccccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 609493 - DNA, 651 bp, Homo sapiens
gaccccattctgctatgagctccttggagccatcttctttcatcagtaactattctgagattcaaaagcttggatgtgttctagagtactgccctcctttataaaggagagatcctttgtttggttataataaaggtagtactgatatatactgtcccaggctaaggaattctctggaattattactgtgtttgctcagagaagaggtatgcaccaaaaaggtggaatcccaaatgttgaaggtgctgccaaactgctgtggtctgagtggacagggtaagcttacttttctgttggcatattggtgaccactagaataaaccttcttttgacacatcttatttttaatatcagtgcctcattagcttactattgccatccccctacatcttggactcctcctccatattttaatgagagtattgtggtagacatgaaaagcggcttcaatctggaagaactggaaaagaacaatgcacagagcataagaggtgagaattgtgtgtcgctgctgtcttcatcagctgacaggccagtggagctcttacctgtttacatgggcttgctttctttcccagccatcaagggccctcatttggccatagcatcctttacagtcatccgtctgcaaatggatatagagaacggact

SEQ ID NO: 609494 - DNA, 617 bp, Homo sapiens
aactcaggggcgacctgcgcgactgccaagacagtcagcagatcaaagagcagaagttcgtacatttcctggcccaggacagtctcccagcattgcagccgctttcctgcccacgttcatgtactgcctgggcagccaggactttgaggtggtgcagacggccctccggaacctgcctgagtacgctctcctgtgccaagagcacgcggctgtgctgctccaccgggccttcctggtgggcatgtacggccagatggaccccagcgcgcagatctccgaggccctgaggatcctgcatatggaggccgtgatgtgagcctgtggcagccgacccccctccaagccccggcccgtcccgtccccggggatcctcgaggcaaagcccaggaagcgtgggcgttgctggtctgtccgaggaggtgagggcgccgagccctgaggccaggcaggcccaggagcaatactccgagccctggggtggctccgggccggccgctggcatcaggggccgtccagcaagccctcattcaccttctgggccacagccctgccgcggagcggcggatccccccgggcatggcctgggctggttttgaatgaaacgacctgaactgtca

SEQ ID NO: 609495 - DNA, 217 bp, Homo sapiens
ataaggggaacccaactatctttcccccaaatgttagtcggaaacccatgtctccataaggcctacaggttgtcatgggagacgacttgcccaccaagaagggcatctgggaatgctggcggacactgggaactcttcgctcatcgggcctctgcaaaaatacacagcactaagagaaaaggatgacccctatgaagagaaaggagcgatctacagg

SEQ ID NO: 609496 - DNA, 162 bp, Homo sapiens
cagacgatggtcgtcttaatatttcatgattataaaagaacatcccagatccatgcgaagagtacagtccaagaattaatcacatttctgaacgcattttatgctacatatgtgtatacttagcgatcctcaggtgttcgtcccatttcgggtaccgagctc

SEQ ID NO: 609497 - DNA, 393 bp, Homo sapiens
  misc_feature (40)..(40): n is a, c, g, or t
  misc_feature (103)..(103): n is a, c, g, or t
  misc_feature (212)..(212): n is a, c, g, or t
ccccccaagttgaaaggtggggtgtggtggggaggtgatnggatccatgggggtggtttcctgatggtttaagcacccatcccccctagtccctgttaagagntcctcacaagatctgattgtttaaaagcgtgtaacacctctccctctctcactctcttcttcctgcttcggcccatgtaagatgtgcctgcttccccttcccctttcgnccatgattgtaagtttcctgagacctccccagcaatgcttcctgtaagcctgcagaaccgtgagccaattaaaccccttttctttataaattacccagtctcaggtacttctttatagcagtgcaagaacaatctaatacaatttcgttctttgaaaagattaataaatcaacaaagcaat

SEQ ID NO: 609498 - DNA, 1180 bp, Homo sapiens
gagccaagtacctggtggtggctgccatgatgatttccatttgtggaggtttctgaggtcccgttcaaccactgactcctgtgcgatggaactcggtggttggctgttggctgttctacagggcttctgtagtgggcagcgccaacaagtaaacgatcgtctcttcgcgcggatgcaacgagaggcgcctaccccagcgagcgattcggtctagtgggtggtcagtgttgggcgtagctatattccgttactctccagtgttctcggaggatgctcagtggctcttttgtgttatggcacttagctttgccttgtgctgttgcatgtgttatccattggcagtcgttgacgacgttcgtgaagcctcgagagcacacgacagactcggatggacaataaaatgggcacacggacattagggcttgtgcagagatggactagcccgcatggtgcattggttcctgggcatgcgcctgagaacgagcttaggacaggaagggcgatcaaacgaggacttcaacgggaacctatgactctaggacgataacgtcgcacatggaatagttaacaccaataagcttagccgtgatggcttagtgggtttcgccacgcgagacaccattcgcatggttgcaggctttgtccctgtgctccccatgaacccctcaagggtttcctgggcttaagcactgtttctcttgagaagcaccatggtgacgggttggcccccggtatcgcaagccccaaaagtttcattcctatttgggcgaaggccatttgggattgtgattaaggggcccggaaacttcaatttaattccaggggtcctggaattggtttttccacacagacagcagaaaaaccctctaggagaaaaccccggagcaagaaaaagagcgcagtctagatccccttccacgtatttggtcggctcctcgcacaacgcttcacacacggtgggtggttctcatttgagaacactccctcaatctggcgggacacacacgtggttgttcccatcaccgggaatgatcgcatttcaacgggggcgcgtctatcaaaaacattcacgacgaacaatcaacggggcggtgtttaaccacgcgacacccaagcaccgaacgattctcatcttacggcgaaagaacaacaacaaagcagtctgcgtgacgatggtctg

SEQ ID NO: 609499 - DNA, 1438 bp, Homo sapiens
  misc_feature (1021)..(1021): n is a, c, g, or t
  misc_feature (1123)..(1123): n is a, c, g, or t
cgggtgttgcgtacatgcggcccgcccctcgtgggtgcgtgtgtcggtggtgtacgccgagtttgctgagggcggcggtgtttttgccgcgggcgatggttttttgtttttggggggacaatataaggggagggaggttccaccacggacggttgggctttccaccacacaagtggtgccgaaggtggcgcgccgcccactgccccaccctcttgtggggtttttgtggggggcggccatttattactggttgttgtgtgcccccatccttgggagagaatagtcccccaacctttggtaagtatgtgttaagaaccttcgttttgtgttggtggccgacacaacaacgccaccttggggagaagtgttcctgtcggcgttcttcccaaccggcaagtgtttgtggaccttctttgggggcgcgtgatccccgcggcttgggtgtgtttctccggcggagacaagtttttcgtgcaccgctgctttgtgggccaacctgtcttcgggccgtcttggtccccccgtctgccggcgggcgagatgaggatttgttgtcatcccgctctgctcgttggtggtgttgtgtgaggaagaatatcttctccgcggcgttctactcgtctcgggggggaagaagtgctcctgatgaagagcaccccacgtggtgtgttttcgtgggaacaacaccttctcaacgagtggttaaaatttgtgggtggtcccccgcacgcccattgttggggcccacacatagggccgtcgcgtctcgggagtagaatcgcgtttctgttgcgccccccgcccgtgtgtgtgcggcataggggatctcgggagactccgggactcattgggcacaacataagggtcttaacactctcataggttgcacgcgcgctcttctgcgcaaagtggtgtttctctccacagtgtacacgtgagtatccacatgggcctctttcgcacaatttatttggcgcgctcaaaatgtgagagagctctctctccgcgaggatcccctggnctcacagaggggtgttctccccccacatgtccctgtgagaagagaggaactctggtgggcctgccacggcgccctcgggggcactcgcggcacacacggccnctcgggccctcttctcctctcttccctctcacacacccacggggcttcctccctctcctcgttcgctggggctccctctgggacccacgtggccctcttcttaccagccccggccctgttgtgccctggttcaaacgccagacacccccagccccttgactccccgggtggggaaggtggcccaaggaatgctctggagagcctgtaaatccacgagccgcttgaaccagtgtcttccggcctattctatttccaccatccgaattgacaccaccattgcgccccaataaagattgcaattttacccccctgtta

SEQ ID NO: 609500 - DNA, 168 bp, Homo sapiens
ggtcctggagtatcgcggatgctcctccgctccacgagatgctcctcctctccacgagatgctcctcatctccgccagatgctcctccgctccacgagatgctcctcgtctccgccagatgctcctccgctcctcgagatgctcctcctctccaccggatgctcctcg

SEQ ID NO: 609501 - DNA, 759 bp, Homo sapiens
tggtcttttcccttcatcctggggtgtctccagcggtcactaagggaaaaaagacaaaaaaaaataaaacagcttttagtaccgtgggaaaaaaaattagtcagcgagttatccccttattggatgaaaagggcaatgattggggaaacatgccccgagcaaatgtgattaaacttatggatgagcgaacacctgcgacgggtctcaagggaaccccagcacagaaaccgtggcagagtatcagcctcaaggaacaggatggcagactccctccaggagcggacagaggctgagggagagtggacgaaggcgacccccaaaagcgggacccaccccgttaaaaaggacacgtgattgggctctctcacaaatatgggccaccctgtgatttgggccccaaagactaaacagattctccgcaggtggcatttaagaaaaaacccctagttccagatttcccactaaagaagggaacaacaagtggtagacggtgcttccagcaacattctgcaccggggggacaatatttcactcaaaatactccagacgtagtgccgggaatagctacatattctcatctaggccacaagctggtccccagggaggaacaacgctcttcaatggtggtggtcctcccgggcttggagccaacattggaggcacaagcgctttataaagaaactccagagaccccaggaaagagacctttttgacccaagatgctgggaacttgctcaaggaatccaaatggtctggcac

SEQ ID NO: 609502 - DNA, 279 bp, Homo sapiens
ctactggttcctccagtgctggtattacaggcgtgagtcactgtgcctggccttttttatttttattttttggacacagagtctcactcggtcaccaggtaggacagtggtgcaatctcggctcactgcaacctcggcctcccagggttaagagattcttatgcctcagtctcctcagtagctgggattacaggtgcacaccagcacgcccagttaattttttactatttttagtagagacagggttttaccatgtgggccccactgttctggaactcc

SEQ ID NO: 609503 - DNA, 156 bp, Homo sapiens
gcgacttatgagactgacctgcaccggtaaagcttcagggggttaggatgagactggctgttactacgtcgggctctgtggctaactagcagagtatgcaatgagcgattttaggtctgtatgtcgtaggccgatggagcttgtatataattatgc

SEQ ID NO: 609504 - DNA, 524 bp, Homo sapiens
  misc_feature (256)..(256): n is a, c, g, or t
gcacagtgtataatatttatatcttcatactgattctcacgaagatatctggcttcatcagcatctctgtcgaaagccatcttggcatttgccattaagtcactaaatcctgatactcgggtatagtccttcagaaatataatacctctatactcgatctccctgatgcgcatttctacgcaccattggccgctttagtgttatgtgctctcactgagcgttcttaggtcctagctttttcctggtttaaaaatgnttcaagtctggcttacagtcatatgggaccatcttggaacactgcttatgaaacattcaaaccacaatctgcacatatcactcccctgagccaatggagacccacataaagttgggacagtattcaacaccagtggtgggcctctgaatgtatgccccttgaaattgtgaatcttttcctattttggaatttgctccttttctttcagagttgctcttctaaccagtgatgtccactgcgaataagcaaagagtttcagaggttgcca

SEQ ID NO: 609505 - DNA, 227 bp, Homo sapiens
aaagaaggaaaagaaagaaataacacttaacagtccataacaaagtgttaacgagatagacacatgcttattcaaaccacagatatgatccagttaattcccttcttagaatgtgcccatagtgccttattgcctcataataatgataataataagagcaacaataataacggcacaaactccagtcgatactgacaaactaccagagtaaccgtcatccccttgag

SEQ ID NO: 609506 - DNA, 101 bp, Homo sapiens
cgtgtttcaccaaccacatagaagtgcaaagaaaggaggtacaggcccgagctgtgttctaccccctcttagggttgggaggagctgtgaacatgtgctat

SEQ ID NO: 609507 - DNA, 537 bp, Homo sapiens
ggtgttctagaggatccgaagggtgatgcgttgaggcgctgtaatcccagctactcgggacgactgagacaggaggattgcttgaaccctgggagatggaagtgcagcaatccaagatggtgccattgcactccagcctgggtgacaagagcaaaagtccgtcttaaagacaaacaaaaaaaccacttgtaaccccaatgttatgagcacccagtgaccttataaaaggcacccatataacaattactggagctccaacgggaatcaccgggtcagactgggtgatggggttgaagcagggagtatcgggggggggcttgccaccctccaggacatcatccggtcgcttcaagtctcccaggttcgggctgccgtgatccggtgcgcacgaacttcgatgccttcccagataagggtgggccatccagctcaaggaaacccacccttcctggaacatcccggagctgatgaggatcctggtgtcccgggaacgggctggcgtgggacaaggcgtgggatgtgacccgtgaggccctg

SEQ ID NO: 609508 - DNA, 153 bp, Homo sapiens
ctctatctgaatcagatctcctattgaatcagatctcctatctgaatccagatcctcctatctgaatccagacggccatgatgacaaaaaggagacggatggccttgtactttgcatctggattcagataggaggcctcctatctggattcag

SEQ ID NO: 609509 - DNA, 192 bp, Homo sapiens
aaaactttttgtataaaagcgacagaaagcaaatattttagacactgcactccagcctgggcgacagagtgagactccatctcaaaaaaaaaaattaaataaattaattaaattaaattaaaaggaggaggaaggccgggctcagtggctcatgcctgtaattccaccaccttgggaggccaaggcacgcag

SEQ ID NO: 609510 - DNA, 223 bp, Homo sapiens
  misc_feature (13)..(13): n is a, c, g, or t
  misc_feature (15)..(16): n is a, c, g, or t
  misc_feature (21)..(21): n is a, c, g, or t
  misc_feature (50)..(51): n is a, c, g, or t
  misc_feature (59)..(59): n is a, c, g, or t
  misc_feature (68)..(69): n is a, c, g, or t
  misc_feature (74)..(74): n is a, c, g, or t
  misc_feature (78)..(78): n is a, c, g, or t
  misc_feature (118)..(118): n is a, c, g, or t
  misc_feature (129)..(129): n is a, c, g, or t
  misc_feature (134)..(134): n is a, c, g, or t
  misc_feature (136)..(136): n is a, c, g, or t
  misc_feature (165)..(165): n is a, c, g, or t
  misc_feature (172)..(172): n is a, c, g, or t
  misc_feature (199)..(199): n is a, c, g, or t
  misc_feature (204)..(204): n is a, c, g, or t
  misc_feature (211)..(211): n is a, c, g, or t
  misc_feature (222)..(222): n is a, c, g, or t
ctttcgtgttaantnngtcangccaaatttttttcatcttcgcctttatnnttttttcntttgttttnntttgnatgntgggccttcgtgcccccccttcccccttttttgtcccccnaattgggatanttagngncttttggtctccctgggggtgggtggggncgaccgngctttcctgtccacagccttgggaccngatgnttaaaangcccacatttnt

SEQ ID NO: 609511 - DNA, 124 bp, Homo sapiens
  misc_feature (30)..(30): n is a, c, g, or t
  misc_feature (105)..(105): n is a, c, g, or t
attgattaaattgataactgggtaccttanagttgcaaaacaagtctacaccattctttagtatgaaaagcaacattaaaaaatggagcattaaaatatttattnaatttatttatgccagatc

SEQ ID NO: 609512 - DNA, 354 bp, Homo sapiens
  misc_feature (120)..(120): n is a, c, g, or t
  misc_feature (169)..(169): n is a, c, g, or t
tggcgtgcgttgtagcaaataaaattgcgcgttatgcaaacttagcaaggtgttccactggtgtgaatcggtgatccttccccaccccggctccggcattccctgtgcttgttgcagganaaatatctccgtcagcattgatgcgaggcttaccgcaccggttaatganacattgtcggcgctcaccttgagttccgatggtaatgcctgcgttaatgaacagctttcgtcctgtttctcacgtttaaggcacaagtttgattgcggaaaattaacacccgttccagttcgcgaaacgcccgtttgccgatgcccggtaaatcagcaattgacctcctgccctgctgaagacgc

SEQ ID NO: 609513 - DNA, 296 bp, Homo sapiens
tcgatacgactttttttttttattatatttctttctttctttctttctttctttctttctttctttctttctttctcgctctcgctctctccctccctcgctcgttttctctctctctcgctctctccctcgctcgttttctctctctctctctctctctgtctctcgctctcgccctctctctctctttctctctctctctctctctctctctgtctctcgctctcgccctctctctctctctttctctctgtctctctctctctctctctctctctcccttctgtcgtcttctc

SEQ ID NO: 609514 - DNA, 4434 bp, Homo sapiens
  misc_feature (3720)..(3720): n is a, c, g, or t
tctggcctcttgccctaagaagcgagtgcggagggagtgggagcgagactgcccgaacgcaagtgtctggcttcccggcgaggcccaggcgtccgtcccgccgcccatgaactcgttgccccgcgagcagcgccgtcgttaggccgtccccgtcactctcgctcgcccccatccccgggcagccattcccccctacccacgtctggccggggactggacgtcgtgtcgaagcgccttccccagtccgcgtcgcgctgcgaccctggaagcgggcgccgccgccaacgagaggaggagccccggccgcggggcccagcagccactgagccagcaggcgggatcgaggccggcaacatggcgagcgcttcgtaccacatctccaacttgctggaaaaaatgacatccagcgacaaggacttcaggtttatggctacaaatgatctgatgacagaactgcagaaagactccatcaagctggatgatgacagcgaaaggaaagtcgtaaagatgattctgaagttgctggaggataaaaatggcgaagtgcagaacttagctgtgaaatgtcttggtcctttagtgagtaaagtgaaagagtaccaagttgagacgattgtagacaccctctgtacaaacatgctttctgacaaggagcagcttcgagatatttccagtattggccttaaaacagtaattggagaactccctccagcttccagtggctctgcattagctgctaatgtatgtaaaaagattactggacgccttaccagtgcaatagcaaagcaggaagatgtttctgttcagctagaagctttagatattatggctgatatgttgagcaggcaaggaggactgcttgttaatttccatccttcaattctgacctgtctacttccccagctgactagccctagacttgcagtcaggaaaagaacaattattgctcttggccacctagttatgagctgcggaaacatagtttttgtagaccttattgaacatctgttgtcagagttgtccaaaaatgactccatgtcaacaacaaggacctacatacagtgtattgctgctattagtaggcaagctggccatagaataggtgaataccttgaaaagataattcctttggtggtaaaattttgtaatgtagatgatgatgaattaagagaatactgcattcaagcttttgaatcatttgtgagaagatgccctaaggaagtttatcctcatgtttctaccattataaacatttgtctaaaataccttacctatgatccaaattacaactatgatgatgaagatgaagatgagaatgctatggatgctgatggcggagatgacgatgaccaagggagtgacgatgaatacagtgatgacgatgacatgagttggaaagtgaggcgtgcggctgccaagtgcctggatgccgtagttagcacacggcatgagatgctcccggaattctacaagaccgtctctcctgcactgatatccagatttaaagagcgcgaagagaatgtaaaggcagatgtttttcatgcatacctttctcttttgaagcaaactcgtccagtacaaagttggctgtgcgaccctgatgcaatggagcaaggagaaacacccttaacaatgcttcagagtcaggttcccaacattgttaaagccctacataaacagatgaaagaaaaaagtgtaaagacccgacagtgttgttttaacatgttaactgaactggtaaatgtgttgcctggggcactaacccaacacattcctgtacttgtaccaggaatcattttctcactcaatgataagtccagctcatcgaatctgaagattgatgcattgtcctgtctgtatgtgatcctctgtaaccactctccgcaagttttccacccgcatgttcaggctttggtccctccagtggtggcttgtgttggtgacccattttacaagatcacatcagaagcccttcttgtcactcagcagcttgtcaaagtaatccgtcctctggaccaaccctcctccttcgatgcaacgccttacatcaaagatctcttcacttgtacaattaagcgcttaaaagcagctgacattgatcaggaagtcaaggagagggctatttcctgtatgggacagattatttgcaatcttggagacaatttgggccctgacttatcaaatacacttcagattttcttggagagactcaagaatgaaatcacccggctaacgacagtgaaagcactgaccctgattgctgggtcacctttgaagatagatctgaggcctgtgctgggagagggagtccctatccttgcttcatttctcaggaaaaatcagagagctttgaaactggggaccctctctgccctagatattctcattaaaaactatagtgacagtttgacggccgccatgattgatgcagttctggatgagctccctcctcttatcagcgaaagtgatatgcacgtgtcccagatggctatcagcttccttactaccctggcaaaagtatatccctcctccctttcaaagataagcggatctattctcaatgaactgattggacttgtaaggtcacctctgctgcagggaggagctcttagtgccatgctagacttcttccaagctttggttgtcactggaacaaacaatctaggatacatggatttgctgcgcatgctaacgggtccagtttactctcagagcacagctcttactcataagcagtcttactattccattgccaaatgtgtagctgcccttactcgagcatgccctaaagagggaccggctgtagtaggtcagtttattcaagatgtcaagaactccaggtctacagattccattcgtctcttagcgctcctttctctaggagaagttggacaccatattgacttaagtgggcagttggagctaaaatctgtaatattagaggctttctcctctcctagtgaagaagttaaatcagctgcatcctatgcgttaggcagcatcagtgtaggcaacctccctgagtatctgccatttgtactacaagaaataaccagtcagcccaaaaggcagtacctgctgctgcattccctgaaggaaatcattagctctgcgtcagtggtcggccttaagccgtatgtcgagaacatctgggccttgctgctaaagcactgtgagtgcgcggaggagggcaccagaaacgtcgtcgccgagtgtctagggaagctcactcttattgatcctgaaactctcctcccgaggcttaaagggtatttgatatcagggtcatcctatgccagaagctcagtggttacagctgtgaagttcactatttctgaccaccctcagcccattgatccactgctcaagaactgcataggtgattttctaaaaacgttggaagacccagatttgaatgtaagaagagtggccttggtcacattcaattctgcagcccataacaagccgtcactgatacgggaccttctggattctgttcttccacatctttacaatgagacaaaagttaggaaggaacttataagagaggtagagatgggcccgtttaagcacacggttgatgacggcctggacattagaaaggcagcttttgagtgtatgtacacacttctagacagctgtcttgacagactggatatctttgaatttctaaatcatgtggaagatggtttgaaggaccattatgatattaagatgctnacatttttaatgttggtgagactgtctaccctttgtccaagtgcagtactgcagaggttggaccgacttgttgagccattacgtgcaacatgtacaactaaggtaaaggcaaactcagtaaagcaggagtttgaaaaacaagatgaattaaagcgatctgccatgagagcagtagcagcactactaaccattccagaagcagagaagagtccactgatgagtgaattccagtcacagatcagttctaaccctgagctggcggctatctttgaaagtatccagaaagattcatcatctactaacttggaatcaatggacactagttagatgtttgttcaccatggggaccattacatatgaccatacaatgcactgaattgacaggttaatcataagacatggaaagagaagtgtctaaaagcttcaaaatgttccacttttttttccttcatggagactgtttgtttggctttcttccattgttgtttttgtagcatttatttcagaaatgtgtatttccataatccagaggttgtaaaaccactagtgttttagtggttacagcaacatttgaaatggaaactaaaagttaggattttatggagtatggagatagggtccagtatctatttaccctgtaatgtttaggattaaaatgttaaaattttgtgaccatgaatttctttcttttataaattttctcatttaaaaatc

SEQ ID NO: 609515 - DNA, 811 bp, Homo sapiens
  misc_feature (560)..(560): n is a, c, g, or t
gttcctcccatatgcttagcggcggtggcaaagtgggtgtcgtgcacctggtctttgatgtgaactaaaacggttgtggtcataactactgcttgactgcgccgctctcctggaaccgtcgcatggaatatagctatcaggatcgatacatagaagactgaggtgtaacgttgcccctgccctttagtgtcagtgagttagtgactttattccagagataggtgccgatcgcagatgccaccgaagttttcacattgtaaactctagattatcttcaggatccacatacgatgtctattgcaattaaacttcctcttctcctttttgatgcaggccgtcatcgcgaaataactgggctttgaaaccagaatcttgaaaacatgcctttgagtaccttcttggaacaggtggccaaagcctacttgacgaacatgcacatgagctgtcccgtgtagactcttgactgcgatcaatgtgatctcactttcccgattgggggaagccgtcatcagtgtagtggaattggcatctcccgccaaggttgattgtacgaggattcntcaggtccctagagatacatccccaaaagcaattgaatgtaattcgaatagacgtgcaggaagagaaactcctacattccctgtgtatcaaagcgatctttgctctggcggaaactttcggaaagctccccttggggagatggacaaggtaggtttggctcgggattggaccaccctgagggccatcgcaattggatagagggtagccatgagtggatctcgtgcttacaatccagttgctattgtgcccc

SEQ ID NO: 609516 - DNA, 394 bp, Homo sapiens
acgagctccgagccaggtcaggcttcggaggccacaagctcagcctcaggcccaggcactgattgtggcaaaggggcccctacccaaggtctagctaggcccaagacctagttacccagacagtgaaagccccctggaaggcaaaaaagttgggggcctggcccccccgggaaggggaacctttttcagggaaaaaccatgtatcccatgtcttcagaagcaagtcaggtttcatgtaaccgagtgtcctcttgcgtgtccaaaagtagcccagggctgtagcccaggcttcccagtgattttgtgttcacccgtgagtccccctacatgcccccgtgaagctgggcattggtgacgtccaggttgtccttgagtaataaaaacgtatgttgca

SEQ ID NO: 609517 - DNA, 659 bp, Homo sapiens
ggggaggcggccctcggccctctgggacgatcacctgggaacgcatgactgttttctccctcacctacgagatgaactcttcaagcagaccgtcatccaggaccccatgcccatggagcctcaaggccaaaagcctctcgcctcagcccacctgacttccgctgctggcgacactaggacacctggccatccaccgccccagagattccatctgagctgggggcctgtgactttgagaagccctgagagcccccgagccgcagcagcagctccccaggatcaccagtggcctcaagccccaagcaggctgagccccaaccccgacgggcctacaccttgggtcaggcccacaatgatcctggagccttggtctccccactgtaggtgggccgtgcaactatgactctggccatcatcctcaacctggctcatcgaggacaccctcaccaggtgcccctcctggaacacaccccggcccacagataccatagcccaactctgaggtcaactaaggcaggtcactcaggagatcaggaccagtgcttcccaccaggcatttccttgaaccccacatttgggtgtctgcgggccaccaaagctcttcaggccaagtcagagctggtgttgctgcacttggatggggaccctgaaacaagaga

SEQ ID NO: 609518 - DNA, 174 bp, Homo sapiens
agtgtcccggagatagagggactgtaaaccgaaggcaccccacagactggctcctgcccttcatggggttgccccaggtcacacaaccagcaggcggctcctggttcacggcaaagtagtcacagctcaggctggagaagtaccctgggcctctgcttctccatgggttacccg

SEQ ID NO: 609519 - DNA, 994 bp, Homo sapiens
agcggggtggacgaacaggaacgtgtcctggacagacacgtcgagtcggggaggaatgcgggggtcaaagggagcactatgtctgcggaagtccccgaggcagcctccgcggtaggagcagaatggaaagtggcgaggagaaacccagtgactcagtccacgcacgacacagcaagaagacacgcaaaattaataaaagccagatatgccatcgatctcggggtacgaaacagcctgcgaggtctcagattgcgttaaggaacacggtggactgagagggcaaaaggcatatgatgggaattctcggaggattcactagactatggcttaaacgcgagaagagatgacagacacaaagcgaacgtctcctagctgcaggctccgcgataaagacggagggtcactgtgtgaccacgatgtccctacatccgtcaaagactctctgctcatacgtgaagccagaccctttgttggcataggacacagcctggcttggacatgacttaaaggaaggagcgtgtacaacttggctcttgacatcctggcgtaaaacattcgtcaatgtcacttatgcatcccgtataaaatactggattcacctcttagtgcgtaacagtaaactcgtagttgataccagtgtatccacatatcaacgtgaaggctgcaagtgagtgacgaaacttgcacgcgagcttatgtgcacagggatcaagacaggctaagatgagtgggtgcctaggcatttagttgggatgggaaaataataacggatgtatggcttaggaaaggtaatcacttggaattttacggtgtgtaaacaatgatgagaacagtgtggttgtacaaggaagcggaacaagtggattaaagaggggcaaagtactagaagagttaataacacattagcctccgtgagcaagtgagatgggtagtaattaatgtagaccttaaggcgttacttaggtggtagagatacaatgggttctctaagcag

SEQ ID NO: 609520 - DNA, 191 bp, Homo sapiens
atccattcgcgctctcgttctctctttcttcacgctcccgctgctcgggcaccagctccaacatcctcttagttgttcctgtctttccccttcactcaaagcgggttgccttctccggcagcagaaccagatccttcaaggccgccttgctcctgatggaagatgggctccgcgtcccagtgatatgtcca

SEQ ID NO: 609521 - DNA, 307 bp, Homo sapiens
agcactctgggaagctgagatgattagatcatttgaggtcaggagttcgagatcagcctggccaatatggtgaaagcccgtctctactaaaaatacaaaaagaggccaggcgcaggcagaccacgaggtcaggagttggaggccagcatggccaacatggtgaaaccctgtctttactaaagatacaaaaaattagctgggtgtgatggtgcacacctgtaatcccagctacttgggaggctggggcaggagaatcgcttgaacccaggaggcgaggttgcagtgacgtgagattttgccattgcac

SEQ ID NO: 609522 - DNA, 139 bp, Homo sapiens
cggcgcatatggttggggctcggcgtgtgcatgcacacgcggaggaagcatactgagcagtccataatcgccgatcttcatggaagatcggcgattacgcgctgctcagagtgggccctggcgcagaccaaaatcgccg

SEQ ID NO: 609523 - DNA, 103 bp, Homo sapiens
ggacctgaggagtgatagtcccaagttgtagaaatagagtgcctgtcccgcgggattcagtctcttggattgtttcctcaccgtcactgagttgcgtgcaata

SEQ ID NO: 609524 - DNA, 225 bp, Homo sapiens
ctcagtgatgagacgcacagagctagcaaattatttctatgcataatcacacatttaacttcagactcagccttgtttataattcccaaaaaaaaaaaaaaacgaaggccacgaaatcctgtttgaccagtatacaaggtttgaacatttgggcagccagtggtaaaacagagcctgccttttttaagtcaccattgcgggcttggatagtagtgggtaatcccc

SEQ ID NO: 609525 - DNA, 677 bp, Homo sapiens
gctctcaccccgttgcctctagcgttctgggaacgatggcgaaggtctcaagagctttacgatgtcacttgggaagaacatgagcagatcaaacatgcagaaaatgggagagaaagaaaactccaagaaatgagtgagcaaattggtggaagttggggagcaaggaattcaaattcaatcgaatattgctttctaagcttggggagaatgataattgggatcattattattgaaccaggtgaatgattgcagacacttagactatggctcggaatgacgtttggcacatgggttagggtccttcaagagcctgagaagcacagtttccctgagcagtcacacagagtcaaggcgaattaaacaggccatgccgcatttgaacgcccatggcaacgatattgattgcatgctataacagactactaatgcataggatttgataccaaagaaagaatccaatttaaagcacgtgctgacaaggaaagcgtaaagaattggcccatttcggaaaaaagcccaggggcaaacaatgttggaagggaccaatatcgggagaagcatgaaagttgaagtatctgtgaaacaatttttgtgtggaagaacacaagaagaccttggaaattgaactcttgcaggaaacgtttttacaatacatgtgaaacattgcattatgcaaa

SEQ ID NO: 609526 - DNA, 694 bp, Homo sapiens
  misc_feature (452)..(452): n is a, c, g, or t
aaagcggctgtacggtctgggatttaggatgcggcggggcgcgctcggaggctccttagcggcgggtgcgtcggatccaggcagccttcgggcggcggcgctgcctggtgcgtcgcggcgtggtcctccggcggctgtccggggcggtagtgagttggctgcgggatgtgctcagccggggagctgctgcggggcggcgacggcggggaacgcgacgaggacggggacgcgctggcggagctgggaggcggctagggaccgtagtgggatccctggggctgatgcccgcggctggctgcggacagcgtgcctgaaggagagcgagcaggatgttgaagactcacagaaccacactggtgagccggttggagatgactacaagaaaaatgggaacacttttttggtgaactgaacaaaaaccttatcaacatgggcttcacaaggatgtattntggagaacggaataagtggaaaccagtaatagtcattttcttatgggttatgctgttggttcccttgggcctgcaagcccttggactagttgcttgttctttgccttgcttataatttattgtgcaaacaggttaaaaccattggccgaaatttggaaattggttggaccatttgggtaggcccatattttgttatttggaaggaaaggttataataatttccaccttttttggaacaaacg

SEQ ID NO: 609527 - DNA, 446 bp, Homo sapiens
aaggccaattttaaagaatccctttggtgataccacacaagggggcatttgcttaagaaacatatcatgcgtatggacagtcatggtggctcatgcctgaaaacccaacactttggcacgccaaggtgggaggatcgcttgaggccaggagttccggacaagcctgggaaacacagtgagatctcatctctgaaaaaaaatttttttttaaaaaattaggcatggtagtgcatgcctgtagttctatctactttgaaggctgaggtgggaggattgtttgagcccaggacgagggtttgaggctgcagtaagccacgttcatgccactgtactctagcgtggatgacagagagagatcctgtctttggaagactggagctataagaatatgacctgagcatggccatggccttataatatagaacgggtcacatattaatcgctga

SEQ ID NO: 609528 - DNA, 636 bp, Homo sapiens
  misc_feature (50)..(50): n is a, c, g, or t
  misc_feature (52)..(52): n is a, c, g, or t
  misc_feature (59)..(59): n is a, c, g, or t
  misc_feature (81)..(82): n is a, c, g, or t
  misc_feature (84)..(85): n is a, c, g, or t
  misc_feature (87)..(87): n is a, c, g, or t
  misc_feature (222)..(222): n is a, c, g, or t
  misc_feature (229)..(230): n is a, c, g, or t
agtgggtagtgtgtatttattgatgaagatatgggggtacgggggggggngnggggggntttgaattgactgacatggacnngnncntggggttagtgagcactcccgggtggccggacataaggccccagagccgatcgttttatctaacagtcgcacccttaccaggaggtggtgaagcacacacgtgtggtccaccccgactaccggttgctgggggangggagtnngagtatgtggaatggggtggggggggtgaacgagagagcccggctcggcgcattacggtagctgagaagtgtcaggtgactcaccggtttatataaatgagaggcggatggccatggggggagtgagggcaaggggaggcaacaagagggacctgtgttttcgtgaacaggggtgtgaggaatggcatgtgttctttgggggagaaaaaaggaggactggggcaatgtggggggggtagtatacagggatggtcagggggaagacaggtaagacactgggtggatgttgggagtgggaagggggggatgatccccaaagttgtggggtgtgggcttgggttagggggagggaggggtgagagattattggaattggggtagaggattggggaaaaatgggggggaa

SEQ ID NO: 609529 - DNA, 116 bp, Homo sapiens
atatgaatccccgtagatcggagtactccaggtcggttctatctacttcattattcctccccgtacgaaagtgacaatgagaaataatgcctacttcacaaagcgccttcccccga

SEQ ID NO: 609530 - DNA, 413 bp, Homo sapiens
  misc_feature (91)..(91): n is a, c, g, or t
  misc_feature (365)..(365): n is a, c, g, or t
  misc_feature (407)..(408): n is a, c, g, or t
  misc_feature (411)..(411): n is a, c, g, or t
tgcccttcctgttcaacatcaaccgtgcttgaagggcaagatgaaacctgcaataaccctcgtgtttgtaaaagttgaccttaagaagcanacagtgaagttcctggttgggccctggaggctcaaaagatggctgggcacggtggctcgtgtaatccccagcacttcggggggccgaggagggaggatcacttgaagattgagacgagcctggacaacacaacaacacagcaagaccctgtctctacaaaaataaaaaattagctgggcgaggtggcgtgcacctgtggtcccagctacactggggcctgaggtgggaggatcgcttgagcccaggaggttgaggctgcagtgagttgtgattngccactgcactctggcctggagtgagcaagaccctgcctcannatnat

SEQ ID NO: 609531 - DNA, 108 bp, Homo sapiens
agcagttcatctatcaggagtgcagaggacccccgcaggtgcttggccgcatcactttgaagttctgagttgctttggtctccacagtccgcagctcgcccctgagtt

SEQ ID NO: 609532 - DNA, 410 bp, Homo sapiens
gagggagagtggagggcccttgtggaggaagtaacagagcatataggacagtttgaggttatgtctcttagtgaggtgaatagatggggggaggagaaatagggtgaaggagtaggtatgggggcgcacactgatatggaaggattggtgaagagatgtcagaatttctttggtctgctcttaggggaggacgagcttttgatttttgactatccagtccccttgaaaggaggctccttgctgtatagcaaagctttctcggtgggagagttcttgggtaggattgctgggataacaggaaggagaggggcagaggcagaagaaagggaggcttcttttggctgcctcatcggcctttcctgtttgcctcgaggatttcatcttgaacctgttcgatgtcctcagacagt

SEQ ID NO: 609533 - DNA, 459 bp, Homo sapiens
cggagccattgtggctccggccggttgcgcgggccctcggaccctcaggtaggcgagggttcgagggcacgagttcgaggccaacctggtccacatggggaaaaaaaacaaaaaaacaaaaaaaaaaaaaacacttgtgtgtgggggcgcgcctgggaccctgagaaaagatcttttcaaacacatgtggttgggtgcgcggcggcccagttgtgaactgggaacctttggtgacagaaccgttggtcccagagagaaactcggcgccatgcgcccatgtggggcgtggtggttttcctccacaatatataaaaaaccccgcgggggggcaacccgcgcggcgtcttttggaccaaatcaccagatagggaggttctaaggaggcccacacgcggcttcctatcacaggggctgcaaacgggagggccgaattataaattattacgccggggagtgagc

SEQ ID NO: 609534 - DNA, 415 bp, Homo sapiens
cccagtagctatcacgatggtttttacgtcaggtggatgcgaggcatgtgggacagagcatcctactgggctctcatcttttccaaagacagtactctctctcacacctgcactggacactgatagagacaggacaggtacaatataaccatgctggctcagcccaggcccaccggggttttcagcagcagcctgtttcccatcatggagtgggcccatgcctgagttctgcatgcctggggcagcaatcgctatgactgccgcaatcagcccatctggattcaactttcagggactgagcagctcccactgcaagtggcaaattaattctgtgcatgcctttcaaccccagcagcagggctcatcacaggcatctggcatccagcatcagagcaggactggcattcagcatcag

SEQ ID NO: 609535 - DNA, 1394 bp, Homo sapiens
ggaggacgtgcgacaagcgacggacgcagcgcggttgcggcgcaagggtccgtgctcagctgtttcgccttcgctgtggcgagaggtgtctatgggggcatccccgatgacgagcgtcgtctactcgtgctaccggacaacccggtcagccgccgtccgagatgctgtctcatatggctgaggagagagcgaggagtgagctgctgaagctcaagagatagcaaaggtacgatagtttagaccggattcctatgatttgtgtagtcgaagacgaagactctctacaaagtcgcacagtactaatcgagttttagagtcgctttcgtgcaatgtctagaaactcctccttgttgccgcatctgagcataattggcctatgagctggcgagctcgtggtattgatcgagttaggcccaaaagagataagttctgggtgcgaagagcttttgcgaggctttgggaagactttttggggcttgcaaatggaggattagacaagggaacatactttcgtggtcccacagggtgtagtgcgcggaaaaaaattcattcaattttaacccgtttgggcgtgattggggacaatcctgtgagttttggcctcgggggtagttgcgtctgagaaagaacgcccaattgggagacaaataacaggggacggaagtgcttggatctcaattcgaagtaaccaaactaattatgcgaggtgttatactggtaaggaaactttgcttggatagagaatagatgttcaggagtagggggattggaacggttttagtggaaattggagggcttgaggggagaaaatagcaccttgccaaggtgaaacgttactaatgtaggggcaaggtgttaaatttgttgaaactcttgagcatttcttggagacgggccagcgaacacctgggttacttggccccaaggaggaaccttcgtgacttataaaggtctaccttaagacaaagccatgttcgtgggttacttcccacacgtgtcgtaaggaatcgcacccatttgaccgtgacgtggacagtgcgacagctctggagactcccccacggaagctcttctggcaaggacgcagttccccttattggaaccttgcgcttgtgcacgctggggtacctcctggctgaacagcgtgtgtctaaaactgtgttgtgacgcaacgtgtccaattaagccgggcgttctacgagacctgtcgcgcgcatcactgtacgctctctacaagatcctgtaaacgcacaaatatcgtcgacgtttgggccatgagcgaaccgaacgttgcacctccttgttgacaaatccatatcggcatgggatagacacacctgggctacgcctaggagagcgtgaaaggtaccccatcaggcacagcagcggtacag

SEQ ID NO: 609536 - DNA, 245 bp, Homo sapiens
agcggacattagctgatgtctgggactgaagggctaggtgtatattccagtcttggcagtctgccctggttgtacctgtcattcaaagggctgacgactattacctaattgattctccttataggacgattagatagatagatagatagatagatagatagacagacagacagacagacagacagatagatagatagatagatagatagattttttttttttttcattttttttagtttgggggg

SEQ ID NO: 609537 - DNA, 820 bp, Homo sapiens
gtcgtgcacctgttggttgtgtgatgttcttttggtgttgatgctctgggtttttttcttctcttgtttttgttgttgtgttttgcagttttcgtgtgcatatggttgtttttgttggtgtttttcctgttcttgctgtgcttaggtgtgtgtgtgtcggggggtggggtgttagtttgttttgtgggcccccccccaggagaaaacgggcaccacacgtataaaacaccacctcctggggggtgcaaaccccaccgccgacatttgaggggaccacccatgaggaaactccggagaggagatccccccgcagcggtggcaccacaaagaccagcgcggcgtgggtgaaaagcgccccgccccgccaactcataacgcggctctcaaagggtgtcggggccctcgggtggggcggattttgggccgccgcggacgcaccaggttgtgggtgtttcacctcctggatctctgggtgaggagaagttggggggctcctctgggaaccctcgagtgtcctcgcctattggggaagtgtctcctcctttcggggaccttttctcggccccttttgtgtttcccctgtggggagtggggggggtgggccccctcttcctcggggagaggaccaccctccctcgggggttgtgaaatttcccgcggggccttcccgcgggtgccgaggtaatcttgagaagcacagaatgtctgtggccacgtttttcttttgccccacaatggggccttttttttttttgtttttttttgtaaaggaggaccctttttcttaaggggcgcccaaaaaaaaaataatttgggccca

SEQ ID NO: 609538 - DNA, 383 bp, Homo sapiens
  misc_feature (370)..(371): n is a, c, g, or t
tggtaatgggttaagggataggcatttagatcaagtggaaaagaactgagagtccagggccgggcgcgggggtcacgcctgtaatccgtggaaaagaacttgagagtccagggccgggcgcaagttgtcacgcctgtaatcccagcactttgggaggccgaggcgggcggatcaccaggtcaggagatcgagaccatggtgaaaccccgtctctactaaaaatacaaaaaattagctgggcatggtggcgggcgcctgtggtcccagctactccggaggctgaggcaggagaatggcgtgaacccgggaggtggagcttgcagtgagctgagattgcgccactgcactccagcctgggcgacagagacgnntccgtctcaaaa

SEQ ID NO: 609539 - DNA, 576 bp, Homo sapiens
  misc_feature (278)..(278): n is a, c, g, or t
ggaactctctaaaaaggagccagagtcttacaatgaccacaccatgcagaaggaataaccttcatcaagttttatgctccatggtgtggtcattgtaagactctggctcctacttggaaggaactctctaaaaaggaattccctggatctggacgggggtcaacgatcgccgaagatagactgcactgctgaacggaatatctgcagcaagtattcggtacgaggctaccccacgttattgtcttttccgaggagggaagaaagtcagttagcacagntggaggcagagaaccttgactctgttacaacccttttgtcctgagccaagcgaaagacgaactttagggaacacagttggagggtcacctcttcctgtccagctcccgcaccctgccgtttaggaggttcagtcccacagaaggccacttggttcccagtggtggctgttcagaaagcagaacatactaagcgtgagggatcttctttgtgtgtgtgttttccaagccaacacactctacaagttctttattaagttaagattctctaaggaaatatgtaactcatgggcactgtgtt

SEQ ID NO: 609540 - DNA, 427 bp, Homo sapiens
  misc_feature (50)..(50): n is a, c, g, or t
  misc_feature (78)..(78): n is a, c, g, or t
  misc_feature (89)..(89): n is a, c, g, or t
  misc_feature (117)..(117): n is a, c, g, or t
ctgggctatgggtctccttctgtttattgggctgccccatcttggcctcnttcagggccctcttctgggtggtgtccngcagatggggncagggcatgctccctcctcactgtctcncaggccactgcaccgtctaccctgttggcttcaggacaacgatcacgagcctttgttgagggcctattctgtgtacttagagtgactgctttatagcctgtgggttgtctgacttcatactccagctgtctaggccatgcaagctgccacaaccccatcttctcatgtcttggggactctgtcctccactgcttgatttctatagtcttgggagctattgattcaggtttcacctggtttttcagttttttcaggcaggagggtaaacctggcccctgttaccatcatggtcagagcagaaggtcgacgc

SEQ ID NO: 609541 - DNA, 286 bp, Homo sapiens
tgtgcatcccccttcgtacagggaggaatttgaagtagatagaaaccgacctggattactcccgctgaactcagatcacgtgggagtttaatcgtgaacacacgaacctttaatagcggctgcgccatatggatgtcctgagccaacatcgagggcgtaaaccctattggtgagtatggactctagaataagaatgggctggtattcctaaggtgacttggtccggtgggcaaggtattggatcaattgaatattgtagttcgctttgactggggaagtcttaaca

SEQ ID NO: 609542 - DNA, 754 bp, Homo sapiens
  misc_feature (8)..(8): n is a, c, g, or t
  misc_feature (77)..(77): n is a, c, g, or t
  misc_feature (82)..(85): n is a, c, g, or t
  misc_feature (91)..(91): n is a, c, g, or t
  misc_feature (93)..(93): n is a, c, g, or t
  misc_feature (99)..(99): n is a, c, g, or t
  misc_feature (133)..(133): n is a, c, g, or t
  misc_feature (209)..(209): n is a, c, g, or t
  misc_feature (233)..(233): n is a, c, g, or t
  misc_feature (237)..(237): n is a, c, g, or t
  misc_feature (239)..(239): n is a, c, g, or t
  misc_feature (241)..(241): n is a, c, g, or t
  misc_feature (249)..(249): n is a, c, g, or t
  misc_feature (257)..(257): n is a, c, g, or t
  misc_feature (264)..(264): n is a, c, g, or t
  misc_feature (302)..(302): n is a, c, g, or t
  misc_feature (308)..(309): n is a, c, g, or t
  misc_feature (313)..(313): n is a, c, g, or t
  misc_feature (325)..(325): n is a, c, g, or t
  misc_feature (330)..(330): n is a, c, g, or t
  misc_feature (335)..(335): n is a, c, g, or t
  misc_feature (353)..(353): n is a, c, g, or t
  misc_feature (358)..(358): n is a, c, g, or t
  misc_feature (364)..(365): n is a, c, g, or t
  misc_feature (369)..(369): n is a, c, g, or t
  misc_feature (371)..(371): n is a, c, g, or t
  misc_feature (381)..(381): n is a, c, g, or t
  misc_feature (385)..(385): n is a, c, g, or t
  misc_feature (391)..(391): n is a, c, g, or t
  misc_feature (410)..(410): n is a, c, g, or t
  misc_feature (435)..(435): n is a, c, g, or t
  misc_feature (458)..(458): n is a, c, g, or t
  misc_feature (474)..(474): n is a, c, g, or t
  misc_feature (511)..(511): n is a, c, g, or t
  misc_feature (742)..(742): n is a, c, g, or t
taactacncttcagaaactgaagatggaaacatagctaagcctcaacttccggtcaagcagaaagtaatgaaaaccnccgannnncccccncncacatnccccactgctccttaaatgccacaatcacgcggnccactgctcctttcattctctacagacaacctgagtctcacactgtcatagcaccaagaagaaaacagttactttnacttttcttatagcaacatagggntttntntncataaaanatgttggncaggttntccttcaatcatggtttgtttgttaacagttggtttcntaaaanngggnggggtgggaagnggatnggggntggtctctttacaaaagngaggngaatanntttngntgtaccaggntgtntagggnaggtgagtgactgtgtgtnttatctgcgctatgagtgctaagtnttaatatttagttttttattttnggaaataacctcaganaccatcagtccaaccgcttccattttacagctaaggnaaagggtccggaaacttaggtgaatatcagactgggatgagaacgcaggctttggagttaggctccttagtatatgaagttcatgtatccccatagacaaactcattttctggtaatatgaatacacttctgggatgaaccaacagtttttcagtctaaggtatgtcagaaacgaattcaatttttatgcttaagtttcctctgcacagctttctccatttaggttgtgangatgatgcagac

SEQ ID NO: 609543 - DNA, 732 bp, Homo sapiens
gagcggagcggacgggtggagaggtcccggccgggagccgcggaaagagtagggctccccagacaacggggtccgacgagcagttgggcacgggctgagtccgcctgccggcaggaatggtaagaagacacgacagcggagacaactgccttgaaagaagagcttattatgtacagttcccagggcaagagtgggcgtgccgacacagtgcaaggccacatggggaagtaccagggtcattcaggaggcataaggagcaaggtgaaagcataggccagagctattctttaatggtgtcaagggtgggaaggacactgaagcgtcactggggtgggaaggaatgagcgagacagggtagacgagctgaacagaaccttaggattggaatagtacgaagtaactttgggagaccagagaggtggtctactagctgcactagtacactgggctctgaggagtatatagagtacaggggaacgcattggcttgtgtgtggtggtatgggggtatgcaaccatgggattggtcgcgtttgcatatgagaagcatgctcacagggacaggggtagaggctaaactactaagcaggtacagcgtataccccagaagaagggggacagagactaccacctgggtacccttacagggtcctaaagaccgtcaaacgcatacgttaaacaacaacacaagacaagaatacctcaaaccaacaagaagggcagggggacaatg

SEQ ID NO: 609544 - DNA, 209 bp, Homo sapiens
  misc_feature (46)..(46): n is a, c, g, or t
cattagccaggtctatgtggtatcgtgtacggtgtgcagaatacanctggtagatagtagtaattcgtattgtaagtatcatgtgttccgtgtggttgctaggtaaggtttgagctgattgtggtgttgatgttgtccttttgtcgtgtgattagagggtgaatcatggacggggatgttgatgttatcttactagagtatagaaaggt

SEQ ID NO: 609545 - DNA, 748 bp, Homo sapiens
cttcggttttcttttttgtgttttcttttttgatttctttctttgttcttctcctctattcttttttgtgcttgttttgttgcttacgtggttgtcccttgtctgttgcgtttcctgttgtcactttgttttcttcggtgtcctcttgtgtgttcttttcttcgtgtgaccccttttgttctcttttctttctcttctttttcacttctttttgtttcctttctcatctgtttttctcctcttggctccctcttttcttttctgtttcctgttctttagcattcttttataggttcgcgggccgttcctgtcgtcttctttgtgattctcctcgccgctggttcgtcgatgttctcattgcttcgcttcccacctgtggtcttggctctgcggtggcagtcctgaggccgtcggcctctcgtcttactacgtccgtgtggtgctattatggttctgcggtcgcctccgtgtgtctctggccgtccttccttgtcctagtcctgcctggtgcacctagtcgtgtgtcgcgtgtgtcgatcgtgttcgtggtaatctgcgtgagggacttcctgggccctttgcgctgtcggtccctcggtcccggctgtgcctcagggcagatatagcaagctctttcgaccatagttgatggtaggacattttagactttatttgtcagctctgtactgacaccaaatacacacccccacaaaatcgtcaaattcgaaagtttcactacataacactg

SEQ ID NO: 609546 - DNA, 197 bp, Homo sapiens
ccaaccaggtagcgcgccttcaccgatgccaagcggccctgacccagatccagcgccgcgacgactccatcggcttcctcgtggaagctcgtcaggctggcgcccagccgggtgcggacttcgacgtattgctccacccgctggcgcagggcgcggtccagatccggctggtagaaagtcacgagcttggggtgccc

SEQ ID NO: 609547 - DNA, 194 bp, Homo sapiens
ctgggtccaggttgtgctctcctggaatgacagaggcaacgtgaagatgctgaaaacagctgcagagatcgtttgacaaatgaatctagtagcacaaaagatgatgactatttacccagcaacacatgctgggacggagtcatcctactagtagtcgcatgctgcacgtcatgcacattcttggcagcgtgcgc

SEQ ID NO: 609548 - DNA, 186 bp, Homo sapiens
tgatcggtactagatatccacatggaattaccctcacacatcatgaagatctatgtatgtggccacagccatatacatttaaaacttcctaaagcatatattctcaggttaggaaggcacactcaaatttattaggtccaattcctcataagacaccggtggctgcctttccttcgcactgagaga

SEQ ID NO: 609549 - DNA, 458 bp, Homo sapiens
cacgaggcggcctgaggcagcgcttggtcgccgtcgccgggcagcagctcgggaacggtgagagcaccgccggaggccagcatttccaacagttttcgccggtcgcggtagcgggcccgcagcagcgagcggccgtcgaggtagagcaggtcgaacgcccagaattcgacccgcgcgctcttgccgcggttttgcatctcgtggaagttgggcacgccgcgcttgtccagcaccacggcctcgccgtcgagcaccgcgtggtgctcctcaagagcctttgccagcgagcgtaattcgcggtactcgccggtgacttcgcgaccgcgccgggaccgcacccgcagggtaccgtggtcggcctcgaccagtagccggtagccgtcccatttgccctcgaacgcccactggctcgccttgagcgccgacaccgaaccgtgggtggcgagcatcggcgcgat

SEQ ID NO: 609550 - DNA, 197 bp, Homo sapiens
agaggatcccgttcgggcggtggtcatatctgcgtcgtggtcagcgtgccaccggccttgtgcgatgtcgggcgtctgggtgtcgtccttccacagcaactgcagcaggcggatgttgctgccgcgcgggtccgaagggcggccccggcatgcaggaaatgctgtatccgaccagctacctgaagtcgaagggactg

SEQ ID NO: 609551 - DNA, 103 bp, Homo sapiens
gagtgatctagaggatccctaaaattgatggggttgtcagtttagtacccatgtatactctatattgacaatttatgtgtacccagttctgatacggttttga

SEQ ID NO: 609552 - DNA, 145 bp, Homo sapiens
gactcgagctcggcacctgtaacattcgtgtccatggcacatgcggcgcaagtaggtctacaagacgctacttcccgctatcatagaagagcttatcgaccttgtcatgatcagcgccctcataatgcatttgccttatctgtct

SEQ ID NO: 609553 - DNA, 525 bp, Homo sapiens
catggtggcgcatgcctgtaatcccaactactcaggaggctgaggcacgagaatggcttgaacccgggaagcggaggttgcggtgagccgagatcacgccatgcactccagctgggtaacaagagcgaaactccaccttttaaaaaaaagaaaaggaaaaaaaaaaaaggaaaagataaataattctagctagaaagtgtttcattacaattcacaaacaaatagcgttccggtgaaccggtgtaataatgggccttttccttaaaaccgttcattcttcaaattattacccttgggcaatggcgcacgtttaacctttacacaattacttacaagttacctcgtgcattggttccctctatttaaattaacccggtattaattaaccacaattattattagggtaacataataaatttagtactccaaccggtgttggctggaaatcggggtctctttacctaaattcacgtcccctaaaaacaccatatttacctttttttttattttttttttggagaaagg

SEQ ID NO: 609554 - DNA, 134 bp, Homo sapiens
agtgtgtgacagttcaacagaagggtagggaaaggtggctgcactgccagtggagcaaacaccaggtggagcgaaatgggcatccagtaagcaaacctgagactgactgggtctccctttgacgtcagcatgga

SEQ ID NO: 609555 - DNA, 1227 bp, Homo sapiens
gcttgccgtggcttggggttccgatgtggtccccggagcgggaggccgaggaccccagcacggggtgagaccctggcgggccttctgccccccgagtgggaggcaggacgaggacgcgcatgtccttcctgttctcctgctttcaaagagcgagtcgctgatggtgaacatgcacctgactggcgacatgcaatgatgggctatcttggtgctgctcgtttgtgctgcttgatgccacatgccgcctgcccgggtgtgtgtgtgctgcctgctgtctgctgtggacttgcacgtgaggcctttccggcgcacatgtgggacgcgtccctgctgtgtggcttgtgccacaggctgcttgcatgtgaccatgctgcggtctgacggctggacgcttgccagctggtgaggtcaggacgttcaatgggctccagtgtcagacaggcatgccttggaatctcacgtggtgtcgggtgatcttgtgcggtcattcgcgtgccttgacacggccatattacaaacgcttgcgacgtcttatatgctaaacccatgccttgggaacgataaactaaccgtgttctcgcaggcctagacgtgacgggtaccctatggctcgccttggttgcgacgcgctcgatatcgacacgggacccacatgggactagacgtggacggctcggtactccgctccttgtattccacggaaaaccttcggccccccacttccttgacctaccacctagcacgactggattaggcgatcggtgcccaccattgagatccacagcaagccgcttcgagacacaagacaccagctttcgttgggatggccattacaacgtctcgcttggacaccccgaatgaaattgcagcgacacaggggaacccgttcaccgctaccccatcttgcgctcatgatctattcgccgctggctgctgcctctcgtgccgcaccttcaacatgctggtcacgcacagacagcatgtcggggggttatccacacacagcgctactccccgaatccccgaacttatccccaggctacacaccctgcgttggcgtctacagtgacaacaccggcacttttgcggtcttgtacaccagacgtcaatctgtggtgcctcctcctggcaagcgctgtggcaccccgcacgtgctttgtgcacccccaacaggaggcaatcatctagatactacccaatgatgtcgacaatgtggacgcagtggtt

SEQ ID NO: 609556 - DNA, 360 bp, Homo sapiens
ccacttactggatctttgtgccacaggaaacccattttctggtgggatatgccttccagtgccacagggccactcaccccatgctatctctgatcctgtcccgtgaattgcctgggacggacagtcaagggtcaagcccagtgttctgggcggataggtgggtgggaaacagaagaggggagaatgaccgtcctaagcttctgccttggggatcccccacacgaacctgggtactgcctgggaaaacctgtgcctatgtgaaaactaatggacctcgtcctcgcccaccggcctgcgaagccagcatctccgtgaaaggtggatggaagcgccctttgttgcctcatttttgaagctgca

SEQ ID NO: 609557 - DNA, 2659 bp, Homo sapiens
cacgtttgtaatctcaaagaaaggttgcttgagtggaccccgacctcgtcttaggagaaaggagatttatgcagcaagtttggactagccccggcaaagtcagtgccaccaaggccctactcaaagggaggtgttcacactaaggtatcggcccaccctgattgtgcttcttggtcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatatatatccatttgttacataa

SEQ ID NO: 609558 - DNA, 171 bp, Homo sapiens
  misc_feature (141)..(141): n is a, c, g, or t
  misc_feature (160)..(160): n is a, c, g, or t
catagagatcatggtacacagtatattgaactctgtaacaaattattttgagaaatacagaagtgagaatagtgatttcctcaatttgtttatagtctatcacaaagaggccaagttcagtattaatagatatcctaatanaagttttacaagttttccnagggatacatt

SEQ ID NO: 609559 - DNA, 2286 bp, Homo sapiens
acgccatccctggtacctgaggcagaagacacatcttgtgcttccctagtcatcaggttcatcacttcgaagcatagaagctgtagactgaccccgtcaacagaagggtcatttaagacagtgctgatcactcttaccatggaatattagcttttgctggtgggaacattagcttcctagtcaccaaataactgtatgtgggataaaactgaaccttgaactgcctcataaaatgactttatattttaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatatatatccatttgttacataa

SEQ ID NO: 609560 - DNA, 2418 bp, Homo sapiens
cacgtttgtaatctcaaagaaaggttgcttgagtggaccccgacctcgtcttaggagaaaggagatttatgcagcaagtttggactagccccggcaaagtcagtgccaccaaggccctactcaaagggaggtgttcacactaaggtatcggcccaccctgattgtgcttcttggtcctcggagtactcaacacagattgacatgtggggtgttggttgcattttctttgaaatggcttctggaagacctttatttccaggatcaaccgtggaagatgaactgcacttaattttccgactgctaggaactccatctcaggaaacttggccaggtatttcttcaaatgaggagttcaagaactacaactttccaaaatataaaccacagcctctaattaaccacgcacccaggttagactctgaaggaattgagttgataacaaaatttcttcagtatgaatctaagaaaagggtttcagctgaagaggccatgaaacatgtgtactttcgaagtctgggaccaagaatacatgctttaccagaaagtgtatcaatattcagtttgaaagagattcagttgcaaaaggacccgggttttcgaaattcttcttatccagagacaggacatgggaagaacagaagacagagcatgctcttttaagtctgataacatggtttcaagcccagcccccagcctttcttaccaatcaaggactcagaactgaaggcaattatttcttttggtggacttggaatctccgtttgtctacactgtcctcttcacagtggagtctttttatttcagacctacagattgtttttatatttgttgtcacagtgtgacaattttttgtacagtcggttttaaggtcttctctgccattagagccagtaggttacagctattgatgtaactatagctgcaatttttgtgcaggactgagaaacacagtgcattatttattgcggaatcattgctgctaaataactactgtctgtttatttaacacaacaattgaatgcctgaagaagttgcagtggctttattatatgtgaatgcatctgtttctcctcacgaattgttttactgctgcattttttgtttttaaaattaaactgcagtgtttcctggaatgtaaatttagctttgcttaatagtaaaataagtgagccatcttgaacactttaagtttatactatataatttcttaatgaacattggcaaatagagtagctaagagattgacaagcacattacgtttagataagcatgtgatgcagaagttgattcaagcaagtgaatccctgacattttgaggatctcacattagacaccaacaaattaaagctccaaaattatttattttttatgtgttcctcactttagaaacgtctactgcatattactggatatttgtatactaatacacttacctattttacattgtgttttaaatttagttaaaacttaaccgtagaagtctgttcaaacgcgaaaggtcttgctttgtttgttttaaatacatttattttattagaaaggatgatatttcattggggaatagtttctttcatttgggggctatgtgtttcaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaaaaaaccaaggaaaaaaaacttttggggggttgggccggaaaagttttaaacattggtgggggggggcca

SEQ ID NO: 609561 - DNA, 499 bp, Homo sapiens
gtgtagggttgttggtggggactgggtgtctaattacttcttctacaaactttaaccaacatccctatttttttttttcctttaaaaagaatttttggtcgagcacggtggctcatgcctgtaatcccagcactgtgggaggccgaggcaggcggatcacctgaggccaggagttcgagatcagctggcctacacggcaaaaccccgtctctactaaaaatacaaaaattagcctggcgtggaggcacactcctgcagtcgcagctactcgggaggttgaggcaggagaattgcttgaacccaggaggtggaggttgcagtgagccgagatcgcaccactgcactccagcaagcctcagccacctttaaacatattttttaggccaggtgtggtggcttctgcctgtaaccccagcattttgtgaggcctaggtgggcgaattgcttgagctcaggagtttgagaccagcctgggcaacatgaaaccctatctaccaaa

SEQ ID NO: 609562 - DNA, 492 bp, Homo sapiens
ttatagtggacagcagagttatcctgccgagcatgatatgaacgtccaatgcttaggagtgtcagctgccaggacgaacatcaggcagagacgctgagatcgttctacccagcatggtaccttctatgttattaggctcaaatgtcacactctgcctttgaactcagtcattcgaaactatattagtctgtcctcaccctgctacaaaacagccatcaccgaggcagagcaacatatcatcaaaggaacagaggattcaatagactcaccagaccgtcatggtcagcggcaggctcacaatcatggtggaaggcgaaagaggagcaaagtcatgttttgcatggatgcaggcaagagagcatgtgtagggaaactctcctttataaaaccatcagatctcatgagatgtattcactaccatgagaatgacatgggaaagagccacccccatgattaatttacctctctcttgttccttccatgacatgtgcg

SEQ ID NO: 609563 - DNA, 1126 bp, Homo sapiens
  misc_feature (9)..(9): n is a, c, g, or t
gtcttgctntgttgttttaaacacatagcccccaaatgaaagaaactattccccaatgaaataacattcacttggaatcagctgaaagctgtaatatgtctttgaaatgagccatgataaattacaaacaagagaaatgagaacttacaggattgcttgaaattattgtgggtattatctgtttaccagagatactaaatattagttttaattatgcatctctttgaacatcataaacacactttggtgttggtaacagtattttaagcatttttgttcacttttaaggactatttgtttagtgcatcttacaaactataaatcttaattggtatattttgaaatggtcgtgtaaatttttgccttatatatcatgaaaatagtcataacttaatttcttttcctgaaattcactgtaaaacattcaggggtcctaccatttctgttcaggaaatcttgtagtttattgttgttatttaacagtattaagtggatttttgtatatttcattttaactttatttgtgaatagtgattgtggcatgtttggggtgttattttaatatttcacgatactaaaattttaattttaaaaaattctggaagaaacagattcatgtgtaatggtgaatattggaccactactgcttttcacatttgtaaattggttttatgttaaaccttgtagcctaacaaactgctgttctttctaactgacagacatgtattaatattgtactttgaaggttataaatatgtggaaattccttcattttgttttgaaatttataataacaaaatctccatgttgttaaaatgtggttttattgagtcacagttctttcttggggatgaaggctgtgccgagtggggtccttttcttttatgggtcgttcttaagataatgaagtctcactgtgctagaggtgttattgttttctgtttgtgccaatcatttgcttagtaatttctgctgggttttttttatagcactctcaattataaagtatcaaatttgtcacttcatagaatgtatatttgatttgttgcaaatttgacattatagcttttcataggcttaattcttgcgtataaaagatgaaaatatatatccatttgttacataa

SEQ ID NO: 609564 - DNA, 430 bp, Homo sapiens
  misc_feature (7)..(7): n is a, c, g, or t
  misc_feature (73)..(73): n is a, c, g, or t
  misc_feature (419)..(419): n is a, c, g, or t
ctttttnaaaaataaagactgttttttataaaaggccagtttaactcctagccatatactggatgatttgttnaggtgatgaatagccccaaaatcccttcccgaatgcctcatttttatcagccataatctcttttagcaggttgggcatggtggctcatgccctgtaatcccagcagtttgggaggccttgcttgagctcaggagttcgagaaccagcctgggcaacatgacaaaaccccatgtctgcaaaacatacaaaaaattagccagttacaatgatgtgtcccagctactctggaggctaaggcaggagaatttctggaggctaaggcaggagaattgcttgagcctgggaggcagaggttgcagtgagctgagatagcaccattgcacttaagcctaggtgacaagaatanaaccttgtttc

SEQ ID NO: 609565 - DNA, 291 bp, Homo sapiens
gcctttcactctaaaatatactctgaccatatttccagttcttccacttattgacccttctacctctcttcctggtttccaccaaatccactctttaaagcccccaatatcttgtccctaccctattgagtttatgagcttccttcagatttcactccctgtctattatctagggatctttaggtcagttattttaatatttttgagaaatcagttctctcaacttcttgccttctacccctcttgtcccgccaatcttgctggattaattcactagctgaataatctcaa

SEQ ID NO: 609566 - DNA, 274 bp, Homo sapiens
tcggtcggtaccccctgggcctgacttctcctacggcctgagccctgtggcctctgccctgaaggcctggggctgggaagaaggagaacctgaaggctgcgcagtgaggagtatgtcaatgctgagccctggccaacagccttgcctgtcaaggaaagccactccgagcggtcaggctggtgctgctgccagcgagtccctcttcgtctctaaccatgcctattaagcggaggtgttcccaggctggtctcaaactcctggctcaagaaatctg

SEQ ID NO: 609567 - DNA, 584 bp, Homo sapiens
  misc_feature (92)..(92): n is a, c, g, or t
atctcaacacttagggaggctgaggcaggaggaccacttgagaccaggattggagaccagcctgggtaacataaagactcctgtatctactnaaaaaaaaaaaaacttagctggaagtcaaaccaacgggttcagaatatggggcattttggagaatcagtatacacggggcaaaaccgggatcgctgaaagagttggcaccaaattactgggttggtagctagaatgaagtgggcaagtagaagataagaaagggcctaatctcagacaacgggcttatttacaaaggttggtacaacaaaaagggagtctggcaagtgaggaactatccacaactggggagagcagggaggcgctggggccaggatgtgatgacccaggagtcttcagcccgaggaggaatggagagctcaagtgttctggagcaacaggaagggcagcggtacatgcatttcagaaagatcctgggccggacgtggtgggctcacgccggtaaatcccagacactcgtgggaagaggggctgaagacgactggggcgaaatcacttgagctcaagagttcgaagaccagcctagacaagcg

SEQ ID NO: 609568 - DNA, 247 bp, Homo sapiens
  misc_feature (138)..(138): n is a, c, g, or t
atatatatctattttatactatgaatataactatatacaaggtatgcttgaaataatgctgttaccaagaaaagaagctgcttacccaaggaaccctggtgtaaaggcaaagattaaccaaataatcccacagaaacntatcatggactatgaaatgctgcaaagaaacgatgggaagcggagaggatcccacctggggctggacagggctcaacacagaggtgagggtctccatgcaagagacatg

SEQ ID NO: 609569 - DNA, 93 bp, Homo sapiens
  misc_feature (5)..(5): n is a, c, g, or t
ctgantgggggaagaaaagaagcaagggaataaaaaaaaatgggaaaaaaagagcaggaacaaagagaaaaaataaaaaacaggacaacaatt

SEQ ID NO: 609570 - DNA, 481 bp, Homo sapiens
  misc_feature (111)..(111): n is a, c, g, or t
  misc_feature (117)..(118): n is a, c, g, or t
  misc_feature (127)..(127): n is a, c, g, or t
ggggcggttttttttctgggtatccaaaaaaccaccttttttttttgggggacgggggtgaatccaatggggggtgccttccttttggaaaaaaatttgttcccttccttnttgggnngggccaaangggcccctgaaaaaaaaaccccccctttttttttttttttttaaaccctttccttttatgggggggggaaacccctcaaaaatttgggggcccccgttcccccttttgccaaaatggggggccccaattttggtttgggggaaatttttttttcccagccccccctgggggccatttataataaaagataaccccgggggttttttccccaaacccggggggggttttcccttttccccaaagaagggaaagatttttgggtttttttttcctttttttttaattttgccccaaaaacccctttttttttttttttttttcccttttttttaaaaaaaaaatttttggccccca

SEQ ID NO: 609571 - DNA, 201 bp, Homo sapiens
tcgttaccagctaagatgtgtatgtactttgggtctgcatttgctacagccttccttgttagtaagacagcaactgcttaaaacataaggatagtttcagttcccccatttaacagatataaagagcattttaagaggtgcaggctctggaagtggatcaaactagaactcgaaccccgtgtggaatacgaacccagtgtg

SEQ ID NO: 609572 - DNA, 248 bp, Homo sapiens
gccctgcttttccccagggtggacatcggtagccaaaatgttttacttgtttttcaattgcccatttatgggccttgacggactttcccctcccacccagctgagaatgatgagtcatcgggggcctagctggagcagtacttggggccagggacctcgagacgtttccttcccaccccccagcgtcatctcccagcctgctgttcccgctttcatatagctttggccaggaagcatgcatagacttg

SEQ ID NO: 609573 - DNA, 87 bp, Homo sapiens
  misc_feature (62)..(62): n is a, c, g, or t
gagagagatgaagggtcttactactgtgcctgtgacacggatccttcctacggaggatacgngccctgggacacccgacagatgttt

SEQ ID NO: 609574 - DNA, 501 bp, Homo sapiens
ctcaggcatccacccgcctcgggtctcccaagtgctgggattacaggcgtgagccacctgacatggcaaatcccttttattaataaaacactaaactctcctggagcaagaatgtgagaattttattatttgagcaacctggatttttaccccagtgagcaatgaaacaatccatgagacctggaaaaagctgaagctctccttttttttttttttaaactggtatacggtacagtttcaaacaaattgggggcaacttggtacttcgtaccttataaaaaggggggcgaacacagggtgtggggttggatctggtctgcataggatcttcgggctgataccttctcgggatgagtcctgagaatctctagaatctcgggagagtaagggagggtcgggagccttctctatgtacaaggaattcccagtttggtcaaaaattggccaagggttgggtgatataactccaaagacaaatccagagattccttccaggtactt

SEQ ID NO: 609575 - DNA, 106 bp, Homo sapiens
gcatagagtagtgtatttctttgtatgcaatctcgcacgataaaactgtaatttgtaaaaacccttttttggaaaaggtatttcacccatttaattccttttcatg

SEQ ID NO: 609576 - DNA, 312 bp, Homo sapiens
  misc_feature (10)..(10): n is a, c, g, or t
  misc_feature (16)..(16): n is a, c, g, or t
  misc_feature (19)..(19): n is a, c, g, or t
  misc_feature (60)..(60): n is a, c, g, or t
  misc_feature (94)..(94): n is a, c, g, or t
  misc_feature (146)..(146): n is a, c, g, or t
aagttcaagnaccatnagnaggaggttgttggggagagccaacaatttccacgtacgggnctggccgcagctgttctttcacaaaggatttggnacaagggccaattacctgtcccagggccctccagggcgggcactgtgtgggntcaactgctatgatgtgtttgggagcccagtcaccctttggtgggctacaagatgtcggggagtggccgggagttgggcgagtacgggctgcaggcatacactgaagtgaaaactttcacagtcaaagtgcctcagaagaactcataagaatcatgcaagctttct

SEQ ID NO: 609577 - DNA, 460 bp, Homo sapiens
acgtgtcggcgcttgactacgcgctgcgcttggcatggtggatcgcgacaaggctggtggatgctgaactgacagcgctgtgtgccatggctgtgtgcgcccgggtaacggcggcagtttgcaggtggtggttgggccgatggccgatagcattgccgatgagattcgcttggcgatgccgggatttgttgcagcagtgcctgtagcggtggcacctgtggataagccggtggtggtgaatgtgcaggaggccgagcaatggctgaatgcgctgggtggccgggggaatgtacggcatctggaagcggtggcaatgacccggctgcgggtggagttgggggatgactcgagattgtcagaagctcagctcactgcgctgggttgccaggttgtgagtcaacttgaaagcggtgtttggcacttgttgatgggtgacaaggcgtccgtagcggggtaccga

SEQ ID NO: 609578 - DNA, 965 bp, Homo sapiens
acagtgagaacgcctgagcgcatgctgtatacttccttattgctagtacactcgtagtaggctccctgtcccctgactcatcgcacgtaattgactaccgtcagcaattaccctgagtgcgtcatcgtaataccattctaactactctacatcgtcgacatgctctctagagcaacatattcagatagcatcctgagcggatagcaacatgtcctgtatgatcgtagtctctagcagcaaattagcttgtttactcaggtaaagatatcgctcgtttcacggggtctccgagcttatgacttccctaaagcccatgtcgacagacccacgcagtcgcgtgggctctaatagtacttggccggagtgactgctggaataatggaggcggctatggtataatacgcctcatcagctcattctcaagtcccctgtacataatacacagtatttcctaccgccttccttggtactatcccctatgagtgcagtagttatatcaaagctccatcgtgcctacgggatacagacctaataatcgctcattgtatactctgcaatcagccacatagccctcgtagtaacagccattctcatccaaatccctgaagcttcacgggcagtcattctcataatcgcccacggacttacatctcattactattctgctagcaatcaaactacgaacgcactcacagtcgcatcataatcctctctcaaggacttcgggtctatgccacttatagctttgatgacttctagcaggcttgtaactggcttaccccatattactatggagaatctcggccggaaagcccgtttcccgacaaatttacccctattagggcagataatagcttttcccttttttcacaggcgcccccccttaaaaaccttccagggaacttttttacccttcttctccgaacgggtcttaaaaaaaaggcgcgcaaggcgggaagtagttc

SEQ ID NO: 609579 - DNA, 292 bp, Homo sapiens
  misc_feature (132)..(132): n is a, c, g, or t
  misc_feature (214)..(214): n is a, c, g, or t
gctcactgcaacctccacctcccgggtttgagcgattctcttgcctcagcctcccaagtagcttggatacaggtgcccaccaccacacccagctagtttttgtatttttagtggagacggggtttcaccatnttggccaggctgatattgaactcctgacctcaggtgatccgccctcctcagcctcccaaactgctgggattacaggcgtgancaccacgcctggtcaggaacattcttatgagaccttgaatgcctaaaagtaaccatgcccctcaggcgtaattgattg

SEQ ID NO: 609580 - DNA, 237 bp, Homo sapiens
tctagaggaccctgtgtttggacggcgtagaggtcataatgcagacaaagcgcggaggagcagtacacatcacgtacggtggctggtctcaccgtcttgacagactgctgaatagcaggagtacaattcaaggtctccacaaagcctcccagtcccctcgagaaacatctcccaatgcaaggcagcccgagaacacaggtgtacacctgccgccatcccggtaggagatgacaagac

SEQ ID NO: 609581 - DNA, 381 bp, Homo sapiens
cgatctagcaggatctcaagctttggtcagctctattctgtggaccctgtaatgttatatatagccaaacaactggtttgttttgtttcattttgagacaggatctcgctttgtcgccgagattggagtgcagtagtgcgaacacagctcaccacagccttgacttcctgtgctcaaatgattctcctgcctcatcccctcatcctgtgtaactgggatcacaggaggatgccaccatgcctagctaatttttttgattttttggtagagacacgatttcactttgttgcccaggccggtctcaaatttctgggctcatgcaatcctgccttggcctcccaaaatgctgggattacaggcatgagtcactgtgcctgacca

SEQ ID NO: 609582 - DNA, 427 bp, Homo sapiens
  misc_feature (127)..(127): n is a, c, g, or t
gattcaagaattcctaattgcattttcaaaacataaatagttttcatggttccactgtaactctccatttctcccttccctcccttgttctctccctggctctgacctcacctctgctttccacggngagcaagatgaactgcttgggtgttccatgggggaagctgggtgggggcaaaggttgcagtgagctgagagcaggaaccccttcgcaagtctggcacctggtttgagggaaaggcctgcttggggctgttttcaaaacagctttgcctcaggagccctgtgccagcgaggctgagatcagggcctggcacatcccaatggcagggagagagtaacttgtgaggagcccagacttgtccagcgtagcttggcagagttggagaggtgcgcttaacagggtgatctccgagggggatcctct

SEQ ID NO: 609583 - DNA, 104 bp, Homo sapiens
ctcgctatcgctgggaccataagcacacaccaccacacttggctgattttgtatttttcatagagacggggtctcgctatgtgcccaggctggtcttgaactcg

SEQ ID NO: 609584 - DNA, 253 bp, Homo sapiens
  misc_feature (46)..(46): n is a, c, g, or t
  misc_feature (139)..(139): n is a, c, g, or t
  misc_feature (246)..(246): n is a, c, g, or t
gccttcttgctgcatcatcacatggtggaaggtggaagggcaaaanaggaaggggtacatcacacactggaacctgttgtggggtgggggggagtggggagtgatagcattgcattaggagatatacctaatgtaaatnatgagttaatgggttcagcacaccaacatggcacatgtatacatatgtaacaaacctgcacgttgtgtacatgtaccctaaaacttaaagtataataataataaaanagacttg

SEQ ID NO: 609585 - DNA, 244 bp, Homo sapiens
cgggaatgtaaataataattaagcctactacctctgaatagtttccctgttttagagaggtgagatagaaaaaaaaaaaaaaaaaaagcccaagggaaaacctaaagaggaaggtataatctgaataaaaaccctggccggggaaatgtattcaaattattaaaatttcaatgggacacacagaacccccatctgggtttatacccacgagcctacgggggaaacactggaaacaaacaacaca

SEQ ID NO: 609586 - DNA, 561 bp, Homo sapiens
agcggagtcccgcatgcgcttcaccccacgcggcgggccttggcccttggctgcctactcctaccgcaccagcccaggcggccctgggcctgctgcgggcgcggcgctgcccgaccagagcttcctgtggcacgtcttccagagggtcgataaagacagtgagtggcagtgatactcagacacctgagcttcagcaagctctctccaacggatgtgagaccccatccgcccttcaggatgccagccttggcaacatcgtgagaccctgctttctacatgaactaaacaagtgtagtggtgcacgcctgtattcccagctacttgtgaggctgagatggcgaagatcacttgagcctgggagcgttgaggctgcattgagctgatgatcaaggccacggtactccatgcctgcggagacagagcgaaatcccatctcaaaacaaacaaagaaagtggatgcgtgctgctcctgccattggatcatcgcagcatctttctatctctctgatatgcgccttttgtcctcgatctgtgggggctcatgtttgcgtaattcccgtc

SEQ ID NO: 609587 - DNA, 234 bp, Homo sapiens
tccttatgccttagtatcaaagcgtctacagttaatttataacatcagcaaacaaagtaaacaaaaaaaccctgcagcagatcctgctgaaatactaaagaagaaaaaaaaaaaaaaaaaaaaaagagaccccaaatggggctaatttttaccaaaggttgcgtaggcccaaaggttttaaacccagggtttttttaataccacaacagaggaggggggagggggctatacatg

SEQ ID NO: 609588 - DNA, 288 bp, Homo sapiens
taggatgaggatggatagtaatagggcaacggacgcctcctagttcgtcagggacggatcggcacaattgtgtaggcgaataggaaatatcattcggagcttgactgtgggcgaggggctgtttaacgggcgttgcgctacgggctataacttgctctgggctcgccctacgcaggctcctggctgagcaactagctgcttaactgatcacttaacggacgacgaacggacagacgaagctaacgcccgcaggcgcgctctcttgacttgctgctagctaacgggctg

SEQ ID NO: 609589 - DNA, 134 bp, Homo sapiens
  misc_feature (28)..(28): n is a, c, g, or t
  misc_feature (40)..(40): n is a, c, g, or t
  misc_feature (64)..(64): n is a, c, g, or t
  misc_feature (114)..(114): n is a, c, g, or t
tggttagcatactcaacaattacccacnataggattaatnaatagcagttcgggcgcccaaccnctaacataacaaatcttaatttaactatttatattatcctaactactacncgcattcctactactcaact

SEQ ID NO: 609590 - DNA, 338 bp, Homo sapiens
  misc_feature (156)..(156): n is a, c, g, or t
  misc_feature (172)..(172): n is a, c, g, or t
  misc_feature (202)..(202): n is a, c, g, or t
acctgctctactcattgtctgtagcatacatttggcgcttactgtggaagtatagtactgtgaggtactctttaatgtttccaactggatctcgagatcaagctcatctctgacgctatttctctttgtaatctaaagctactagtacagtatatnacacatctgaggaatngactcttcttatttggttaactttctgttnccgcacacaatgattttaactgccattagtatcaaactgttatttgcagcatttaatataaagagtgtatattagatgatgaatctcttatttttttttggggaaaggggttctggccctgcccccaggggggggg

SEQ ID NO: 609591 - DNA, 84 bp, Homo sapiens
cccgaggacacggctgtgtattactgtgcaagatcctcctatgcttcagggagtgactatgtctttgactactggggccaggga

SEQ ID NO: 609592 - DNA, 272 bp, Homo sapiens
aaccaaacagtgccagtgattttaaaatttttggttaagatatgtgaatactgttacttcagtttaatagtaatctccttttatagattttgctttctaacaaagtcagtgaaaagtaaccgaggttcactccagtaaacatgtatagaaagtaaaattattaaaaggccaaatatttaattcttggtgacattgtaatcctgcttttattatcacagtagttcataaattgccatttccatgaacagtttcctccattcaactaatcttaa

SEQ ID NO: 609593 - DNA, 730 bp, Homo sapiens
gggattacaggcgtgagccaccgcgcctggcacaaaaatactatttagtaatatgtatcttcgtacactttgctagtcacacttttcccttccagtggtgtttgataacagtatatacagtagttttcactgaactattgtttacaactttcttcttcaaagtatattgctacatcatgtttgaatgtctgcatgcatgttatataagtagacaacaattttggctgggtccagtggctcgcgtctgtagtcctagcactttgggaggctaaggcagtgaatcatttgaagctaggagtctaggacaagcctgagcaacatggcagaaccctgtctctacaaaagtacaaagattggcccagtgtggtggcatgtgcctttggtcccacctactcaggaggctgaggtgggaggattgcttgagcctgggaggtcggggctgcagtgagctgagatcaccctactgcatgcacttcagcctgggtgacagagtgagaccctgtctcaaaaaaaaaaattgtatcttaactggttcttcattatgtacatgtcgatgtagatggtgtcagagtttctacggtcggaacaaactctgaggtacacatccttaactatgtacataggctatattcctagagatcacaatcactggaattactatttatatgtataatcatgcaatacagtgttcatcagacatgtcttcactcattcaaacaaaagacacaca

SEQ ID NO: 609594 - DNA, 267 bp, Homo sapiens
cggaggaagaggccagcgtaggtgaccagcgagctctgtctcaacacgcacacgcgcgcgcgcgcacacacacacacacacaaacacaaagatgaaaaacctaactgaaatcgggttcccctcaaaatttcagaggggcttcatggtgccttatgttttacatgtaacctcttacagtatgttacagtgatgtgtagataacacaatgaggccagtatgcacgcagatcgtgagaatctactcactcttctacgcttcaagacatta

SEQ ID NO: 609595 - DNA, 492 bp, Homo sapiens
agagagccctaacaggttagagccacccacggaaaatgatacccagtgaccatttcaactcccgactcagctcccctcaactctcattgtacagatgaagaagctgaaagcctcctatttccatagaactattctggactacctcctcattgccccatgcaactctcaccacagagggaaattcaagcacagcatcccctggcaaaaaaaaagggaacaaaacagaagcaaaaccaaccaaccaattaaccctggggctttacataaagccttaataaatggtctagttgactcccttcctccattaatggctcaaataacctggtcaagttgactcccttcctccattaattcacctactatcccaatggcgaacacaaaaagcactactgtgtatcgcaattaagataggctgcgtgcagtggttcatgcctgtaatctcaacacttcggaaggctgaggcaggagaatcccttgaggccaggagctcga

SEQ ID NO: 609596 - DNA, 329 bp, Homo sapiens
ttttttttaaggggggacccttccccccccggccctgggggtttaaaaaaaaaacttgtttttttgctgggtgggggggggtttttttccgggggtttttttaaaccccagccttcccttagtttttaacttttgtttccacccgggggtttgccggggtttgccttttttgttccctttggggaaatttttttgtttatggcccaaaaaaaaaacggtgccccctttacaatttttttttgggattttttccccccccccccttgtgggtttcccccggggggcttttccccccctttatgggggggaattaaatcccccttttttta

SEQ ID NO: 609597 - DNA, 85 bp, Homo sapiens
taaaatttttttttgggggggggtttcctttgtgagggggttgcagctatccttcctgggtaaacaaaaacagttttttccctga

SEQ ID NO: 609598 - DNA, 724 bp, Homo sapiens
ctgagacagcaggagcccgcctggcctgaagccgtttccaccgcagcaggcagaggggctggacaggcactgtcagccaatgtggtggggtcctgaagacacccccttgtgggcgacaccgatgtgccccttcatcatgggacatcagatctgaacctgatagacacagcgatcactgcgcatcgcatgccgcccactcggggcctgaccatggaagctccgtcgagctccggtccttgatccttagatgctgatgcccaggaccaccgggggatcatggccgagatcctcacacaccacagaggacaaagatgatatacaaggttcatgcacacacatatcagggaaaaacagtgcatgtcaggacatcgggacacatcaccgtatcggggcaacacacagtgaaaatgcagggggggggctccaatgcattccaagaatcgaccaaacacaaaacacataccaaagtgcaacaccaaaaaacacaacacagggaaacgagccaatgcgcagagaagacacaatgagatggcaacacacatacacacacaggcaaggaaaataggacaagacacaggaaaaagaaagagccaaacaaaaaaaagaggacaaaacgccacaagaaacaagaacaacgatgacaaccagccgagccacaaggaggataaaccacagcgccccaggacccaaagccacaccgaagcaaaaaaaacacgagcacaag

SEQ ID NO: 609599 - DNA, 230 bp, Homo sapiens
cgagaagagcggtctatgagaaagaaaatgaaacgggaacagaggaaggtgtctgggttccaagacaggtcaaatgaagagtggaaaagcactgtgagagaaggagaggcagagcgaggtcaatgagccagaggggagagaggacactgagggccagagagagaactaggaggaggaggacaggggctgcgaaccacagaccagcagctgggaaaatggggttgggggac

SEQ ID NO: 609600 - DNA, 421 bp, Homo sapiens
  misc_feature (377)..(377): n is a, c, g, or t
  misc_feature (397)..(397): n is a, c, g, or t
  misc_feature (413)..(413): n is a, c, g, or t
  misc_feature (421)..(421): n is a, c, g, or t
tgaggtggtagctacctgggaagccatcagccatggggaggcagccagtgccgagtacttcaactttgctcatgatgtgttggatgtgtggagtcagctggaaaagacagggcaccggcccccaaatcctgcattctggtgggtgaacggctcaggaacagaagtcaagtggacatttgaggagctggggaagcagtcgaggaaggtggcttttatttcagaacctgccaaagacggtttctggaaagatcctaaggagtaaattgagaaaccaagaagttgggggaagattgaattgcaaccccaagagaagattgcttgccgattgcacttgaaaggttcttgaaaggagaaggaagttggggcaaggcaagctncctcccttggagtacttatnccttcaaagaattggntatccaan

SEQ ID NO: 609601 - DNA, 320 bp, Homo sapiens
cagccctttttgcccccatggggcctttgggggcctttgggccccctttaacagggggtggggggcccccaaaccccatggggttaccccctggttggttggggcccagtccccccggttgtttttgggagggggtttttacccctagtttttgggttggggtttctggggggcccccccccccccttttttcagtaaaagggccttttttatggggttgtccccccccaaaagggctttgggttttggtttcttttcggggtttgccccccccccccccccggttgggctgttttttaatttttttttttttttcctta

SEQ ID NO: 609602 - DNA, 116 bp, Homo sapiens
cgacacgtgcattgtgttgatgttgggctttgctgcagatggctcatccaagggctgcactctacactgagcagagccgagacacaagcctcagaagcatcacagatggcggtcaa

SEQ ID NO: 609603 - DNA, 956 bp, Homo sapiens
  misc_feature (174)..(174): n is a, c, g, or t
  misc_feature (268)..(268): n is a, c, g, or t
  misc_feature (366)..(366): n is a, c, g, or t
  misc_feature (393)..(393): n is a, c, g, or t
  misc_feature (429)..(429): n is a, c, g, or t
  misc_feature (445)..(445): n is a, c, g, or t
  misc_feature (475)..(475): n is a, c, g, or t
  misc_feature (508)..(508): n is a, c, g, or t
gcccaggcaggagggatacggttggtacagggtggagggagaggaggagctggaaggcacggtcttcgacagggctgcgagcgcgcgaagcgaactagcttccaccagaggtggtgcgggccgaggctatgggacacggttgaccaggtgttgccaggatgctcatcgatgggncacgcctgacgtgaacgcgggacagcggatgactctgcgcatgccgagcatccgagggcgtgaccttgtgaaggggaggacgattcgctacaangcttgcgaccctattcgactccatccggttcgtgccgcgaatcgtgtaggactcgacagcgtggacaagagagacgttgcgtgcattcattcccttgntgcaaaagcatatcgcgcttcagcagnacttctctgtcctgctgtggcccacgaaacggcagncgctgggagcattagnacaatcttcaataacgagagcagtggctgntagcggtgggcagccagtgagcaagccagtagnctttggtggatgaacgactgggcctggcgcttgacgacctcctgcgatagactctgttcttgtctgacatcctgagagtccgtgtggccatggggtgtccttagtaccatgtttctgtagacgtgtcgagatgtttcctcagtgctgacacaagttgaagggtcgagttacgcggaaaggggacttgcacccattgaccgaagtgcatggtgaccggttcgaccaacaggcgactagtgagggcccaaggcatggcgctggccctatgatacggaggagacgggatgcctcatcattaaacgccagcgggggcctcacaccctacgtgttacaaggcgatttcggtacgcacgcttgtaacgcctcggtctcttcgcccaatggtttccctacgagttaccgtccgtaaggaaaaggcaacattccgaggtagactgcctgttggggg

SEQ ID NO: 609604 - DNA, 1238 bp, Homo sapiens
actgatggctcatccatccgcagagcagggcagtgggacgagacgccatgaccccatcctcacggtcctgcatctgtctcgggcgtgagtctggtgccccaggactccacgtgcaggctaggggacactcctccgaagctcgcacccatctgggcatgagcgcaggctcctgtgatcatccagggaagtcctgtgaccctcagtgtgtcaggggagccttcaggctgacggagtaccatctatataggcgaacaacaaatcagacatcctgggtataaacgcgactacaagagcctgggaacgaatgtgccagttccccatctccatccatcacctggtcaacagtgcagggccgctatcactgtcagtactacagccacaatcactcatcagagtacagtgaccccctggagctggtggtgacgaggagcctccagggaaaactgacaccatctcagcatctgcccaagaccctgtgcgtgaccctttagcgtaggggaactgtgaccctcacagtgtgtcgtcacaggtgggcactagtgagcgcggctatcagctactggtgtaacgggcacgcgaagaactgatcgaaacagccgaggaaagatcttgaaactcccattagccccattgcacacgtagcgagtgcgtaaccctgggagcccaatatgacctccagataggggcacctgaagcagccccgaacatcagcacccgtggggtccggagcaaagggaggactattgacgttcactgactaccggaacttcttccacgtaatacacgtaggaactaatacccccacggtggaatctaccttggcaggcctcgctcggctaccactaggggtgcttgcactacaagatacgccaagacacctcctcaaccgcacgcgccacgaggacccacttcgcgtgggcccaccctgtggggcaagtaagcccgcattaaagcctctcccaaggctggtgtcctctccgtggagttgtcccgcgccacaaccaaacatcgaatagcagacgaacaagacatacaacgcgtatgcgatggtgaaaaccttgacaatctacctatcacaagcgatcaacatggtgattgagacagaaccccagagcaggtgctatctcctgcatggaccaacgcggtcgacgcactagggcgccagacatgtacgcccatctgcacagcgagttgacgaaaaccgtcaagtagtcaaaagaagacagcaacagcgatcg

SEQ ID NO: 609605 - DNA, 349 bp, Homo sapiens
ccacgagcggcgcgaagttcaggaaaggccattcggcctcgagcagctcgcggaatttcttgaccgcgtctttcgaatcgctctttagctcgtgcgggctgttgtcccacttgttggcgagcacgatgcacgcgcagccggattctcccacgagacgcgcgatacgcgaatcctgcgtggtgatgccctgttcggcgtccaccacgaggagcgcgatgtcggagctctcgaggttacgggtggcgtacatcacgccgagatcctcgacgtcgttctcgcgcttggcgtggcggcggattccggccgtgtccaccagcaggaagcggcggccctggcgttcgatttccac

SEQ ID NO: 609606 - DNA, 252 bp, Homo sapiens
  misc_feature (165)..(165): n is a, c, g, or t
aaatggaaggtcattaatttaagtgaaataagccagggacaaaaagacaaacttcacatgttgttctcacttactagtgggcctaaaatcaaactattaaactcatggagatagagagtcgaaagatggttacgagacttggaaggatagtgggggagttgagtntgggtgtttagtgggtacaaaaaatagaagggatgagtaagacctagtatttgatagcacatagagtactatagtcaattatagtag

SEQ ID NO: 609607 - DNA, 149 bp, Homo sapiens
atagtaaagcaggctgtcaggacctgctgtgcccaaaggaactgcataaaggaacacgctctatatattctttaagtgattagatgcacagatgaaaaacttaacacacaataacagcaagtaggtcgttcaataaatacacatcctag

SEQ ID NO: 609608 - DNA, 210 bp, Homo sapiens
  misc_feature (63)..(63): n is a, c, g, or t
  misc_feature (68)..(68): n is a, c, g, or t
  misc_feature (80)..(81): n is a, c, g, or t
  misc_feature (87)..(87): n is a, c, g, or t
  misc_feature (101)..(101): n is a, c, g, or t
aaaaggcctaatttggtggttttttttttatatcaattagcgtgaaaaattgcatcaactatntaatncatgaggatctnncatatnaaaatttaaccttnagattcaagcgccatgtgcttatataaaggaaacatttttgagagacgtgtgagctcacttatacatggtggtgcctagggccgtaaatgtcagagatacgggtaccga

SEQ ID NO: 609609 - DNA, 282 bp, Homo sapiens
ttctcgccgggagtgtaatagaaacctccactgattcatttgggcccaaaggggaagcttaatccctccttggaggagggcgccaagtgcccttttataggaaattttttgaaggtttgagcaccaaccttcaaagaagggtgggtctaccacccccaggtccaaagggggaattcaggtttaagggcttattacggccatcaggatagttgatgtgcgtcccccctgttgccgcccccccccccccccttttgtttaattaagctccctgtgttttttcca

SEQ ID NO: 609610 - DNA, 600 bp, Homo sapiens
  misc_feature (35)..(35): n is a, c, g, or t
  misc_feature (54)..(54): n is a, c, g, or t
  misc_feature (301)..(301): n is a, c, g, or t
  misc_feature (325)..(325): n is a, c, g, or t
gggcaaaagagcgagtgggcttttgctcagatgantatgcctgccccccacttntacattttggatgaacccacaaaccactgggacatggagaccatttaggctttgggccgtgccctcacaatttcaggggtggtgtgattttggtgtcccaccataagcgctttatcaggctggtgtgccgggaattgtgggtattcaaaaaaggcggggtcccccgtgtggaaggaggattttccacgtcccgcgccctcctccaggaacagttcccccgggaagggttcctttagggcccccaggntgaggactcgcccaggacatgggntggtttttcaaacccctgggcccccatgtaggccccccctccaggccgtgggcttcccccaacttgggggcagccttattcccaaatgtttttatccttttggctggggcattttttgcccaaccttgggggcccctccaagggttggtgaggactggtttcccgggggggggggtttgggggggaccctttggggttataaattccccccctgccccagctttggttgggccccaagggggtgttttgtaaatttaatttttccccgggtttca

SEQ ID NO: 609611 - DNA, 433 bp, Homo sapiens
aatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggca

SEQ ID NO: 609612 - DNA, 958 bp, Homo sapiens
ccgggaccgtgccattgtactccagcctgggtgacagagcgagattccgtctcaaaaaaaaaaaaaaaaagcccacctgaaagcctgtctcttcccactttgttggccctcccagtgggattatcgagcatgttgtttttccatagtgcctttttccttatttcaagggttgcttctgagtggtgtttttttttttttttttaaattggtttggtttacaaataaggttaaagggcagcccagagctttctcagccaattttgtctcctactctgtgtaaatttttttcccctccgggcaggggagccaggttagacgcaaaggagacaagcaggagtggaaggtgaggcgttctcctgcttgtactaacgccaggaggctttaagcccccagcttaaagggttgtgacgccccttgggggtcagggacctgcttgcccaggtgccgtgtgattttgatggccccccgggccaagagggaaggtgaccgcccagttctcccacatcccattggatctggctcacaggggggtcggaagcctgtcctcaccgtctcgggggttgtgggcccccgccccctccatatatgcaccttggaaccagcatgtccagacaaggaacggaggagaatctggggaacgcgctcagttgtaccggttccctattcctatgctgggtacccgggaggagccccctttgccctgtctgcccttagatgggccaggatttcatctggtcccggactgtccgtagttaggcgctcggaacggggttgtgttggtccctcccggggtgtttgggtccccccccccagtgtcgaaaggagatgtgggcgacattaacagcacacgcgcgaatgtgtttcccgtccgtggtggtggtgttccatctccacaagacttcggggtgttcgcggttatcgccgaggggggaaccctctagctagctgcattttgtcg

SEQ ID NO: 609613 - DNA, 932 bp, Homo sapiens
  misc_feature (519)..(519): n is a, c, g, or t
  misc_feature (582)..(582): n is a, c, g, or t
  misc_feature (658)..(658): n is a, c, g, or t
  misc_feature (665)..(665): n is a, c, g, or t
  misc_feature (684)..(684): n is a, c, g, or t
  misc_feature (703)..(703): n is a, c, g, or t
  misc_feature (733)..(733): n is a, c, g, or t
  misc_feature (745)..(745): n is a, c, g, or t
  misc_feature (789)..(789): n is a, c, g, or t
  misc_feature (825)..(825): n is a, c, g, or t
  misc_feature (859)..(859): n is a, c, g, or t
  misc_feature (881)..(881): n is a, c, g, or t
  misc_feature (897)..(897): n is a, c, g, or t
  misc_feature (914)..(914): n is a, c, g, or t
aatccaaatcttccactcctccccctccattgtcccctcccccaccacacaccttccttcttgtccttgtgttgaagagggtatcttggggaatgagtttattatcttctccacgacctcacctatacatcccacacaccatcctccaggtctgggaaatatccatttttctggccagtcttagcatgttttcttaatgtcacattcccacgccaggcccaagagagattctatgacatatattatagagagaattctatatcaatatatataaatattagagattatgtacacaagggcatgggctcaaatgcccactgccagtcccccacccaggcttcagcatctctcttggcctggggaagtgggagggatgtgatgctggagaaggctacaggctgtgttcaatgacactaaacagaatgtggtggcatcctctgactgtgagtgtcttatttgggggatggaggagactgggaacaggggaggcaaaggaggagaatgtcggagcgggggcanaatggtagaattaagaacggcatacgggatggcaggttggggagaaaaaccttgggtacggancaagggtttggggatgctcacagcacctggcctctctttgtagagaaagcacgctaatggaagtgcatagccaggnttcctgntgctgatttggggagggtnaagatttgactctcccaanttccggggcagcactcaagagccctgccancttgacgctcanctcctaactcttccacccctaggaaaaggcatctgaagaacccnttctaagagggggctggtgtttgagtgacccgtganctagctgctctgagccctgaattcttggcaaganaagccctggctaaaagcagctncagggtaaactgaccnttggcaggacaagtcanaacaagagggggatgtgt

SEQ ID NO: 609614 - DNA, 308 bp, Homo sapiens
tagagaagagcaccctcccggtgtcagctgtagtctgatttggcggatctttctgcttctttacttcttctcttcttcttctcttcttcttctcttcttcctctcttcttctcttcttcttttcttcttgtcttctcttctcttttttttttggaggacagggtctatactgtgtaacccagggctggagatacaatgacgcaatcacaggctcactggcagcctcacacctaccaggctccagcaaatcctcccacctcagccccaccctgagtagttgggactgcaggtgcccaccaccacgacag

SEQ ID NO: 609615 - DNA, 118 bp, Homo sapiens
cagtttattctaatcagtgttgaacgttgtgattttaccagaagggcacttccatcctggtgtgcgactccactattggactgatacaaggagaaccccacagtccaaaaaagccaaa

SEQ ID NO: 609616 - DNA, 144 bp, Homo sapiens
ctataagatctgaacttctcatctgcagaggcagaaaactatttgacatgtgacttgactgtggaagatgatggttgcatgtttctacgttgtatatgttcccatctttgtgataagatgatttaataaatctctttaaatact

SEQ ID NO: 609617 - DNA, 291 bp, Homo sapiens
cctagaggatctccgaatcctcctcctcctggggaattctcctcctcctggcgaatcctcctcctcctattcctcctcctcctatatctatatccctcctcaagaagggcacgtaggccaggcacggtggctcacgcctgtaatcccaacacttgtggacggcaaggcgggcagatcacttgaggacaggagttcaagaccagcctggccaacatggtgaaaccccacctctaataaaaatacaaaaaattagctgggtatggtggcacatgtctgtaatcccaactactc

SEQ ID NO: 609618 - DNA, 286 bp, Homo sapiens
caagtgcgttggattcaactcttcactggtgtacatttattcaagtgtgagtgtattatacttatgataatatagcttctaaatgactattgtgagaggctggctttgactcagactggagggagttaggagtaagatgggagaagggtatttggggagtagaagtagaagtgatgaggtgactattacttggttggagggatctccacttggccaatgaatatgtatttggttaccattattacgtgtggtgtacccggagctccgaaattctggtaatccattg

SEQ ID NO: 609619 - DNA, 318 bp, Homo sapiens
tgaaatagaatctcgctgtgtcgcccaggctggagtgcagtgtcatggtaactgaagcctccaactcctgggctcaagaaatcttcccaccttagccccctgagtaactgggattacaggcacgcaatatcaccccagctaatttttgtattttttggagagatggggttttgccatgttctccaggttggtcttgaactcctgggctcaagtgatttgtctgctttggcctccaaaagtgctgaggttacaggtatgagccatcatgcccagccaaaaatttcttcttatagtcaatgtggtgtcgacgcggccgcg

SEQ ID NO: 609620 - DNA, 3065 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaagataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgatttt

SEQ ID NO: 609621 - DNA, 832 bp, Homo sapiens
cgactagaaatattgagcgatacacatgtacaagtttgtcacttaaaaagaatttgaaaaaacttcatagatgcaaaaaaaaaaaaaaacccaccatttatttaaagaaatactaaggatcatgggggaagtgcttggaagagtttaccaaatgggattaggcgaggaaattattcgcagaaccttagaaatgtgactttacaggttacccagtgggtggaacggaggacgctaggggtttcctcattaaaacttccctgtgataagaagacggcactttggactaaaatttcttttttccccggccaaacaaaattccccgtggtctttcttcaacttagttacgtggtctggtccacttaaattaagaggggggtccggtcaactttcttcaagaatgagccaattaacgggctttccaaaaagatatcatttgggtatatcaaacccctttggggccggggtttacttaattggtgaaaattagatcataattaacttaaattccaagagtgttgtgggtgaagacaaacaattgggggggatgtatactaaagtaccgaagtgtttgaccacacactaggggacggataaggggtaaaatccctggttttccctcagtatcaaaaaagatctaattaaggttacattaaaggacaaggtttgaagataagggtgactaacagtgggtactactaacaaaatggtgggggctaaaattgggcataatgggccttgaaaaacacaaaaattttttcattaaattaacaaaaacgctgtgaatccaggaaggaagagatacaaagtgtgggttggatctaaagctaagggg

SEQ ID NO: 609622 - DNA, 302 bp, Homo sapiens
aaaaatagacgtaacataaaatttaccatctcaagcatatatatatattttttttcttgagagagaatcttgctctgtcacccaggctggagtgaagtggcatgatctcggctcactgcaacttctgcctcctgagttcaaggaattctcccacttcagcctcctgagtacctgtagtctctgctacttgggaggctgaggcagggggattgcttgagcccaggaagtcaaggttgcagtgagctgctattgtgctattgccctccagcctgggccacagagtgaaactctgtctttaaaaa

SEQ ID NO: 609623 - DNA, 864 bp, Homo sapiens
  misc_feature (26)..(26): n is a, c, g, or t
  misc_feature (676)..(676): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggagtaagtattaaaatgcattttgtataattgcatatattataaataatatctacggaatgattggtaggtatgaacttgtaaacctctttggcttttttgactagtaaactgaatgtctttggtagcttaattggaaaaataacttcgtgtataccaatttaacacttgtcagtactgttttctgtggttaaaagtgtcaatttttcctggcaaagagcagtagaagaagctgcagttgagaccaggcctagttggaagcattcctgtaggttttagaatgtgcntttttaggtgtcacaagagccatttgaagtagaattctctttgtagtgattcaccattttacgaagcctaatggatcaccccagtttcaggcctaagttcaactttcctttcctatggcatggggggacattggtcccccggttccccagggctgtgcggacgaaaactggaatccctattatcccac

SEQ ID NO: 609624 - DNA, 641 bp, Homo sapiens
tttcagcactaaagaagaatttaaatacaaaatagaatgttatatatcttgtagacagtcaaatatttgatgttttatgggacataatcatttgggaagtttttgttgtaaatgaagagttagtttgttgctattaatttgtttgacacataagttcattcctaaaagttagggatgttacataaagaagggttgaggactttatttcagaagtcatttaattttttctttattttctttcagattttgtatggtttattcagaagtgccaaatttcagtgaacccaacccagattatcgaggacagcagaacaaaggggtaattgtgtagtatacttttatgattaggctaattttgactgtgttataattctatgattaggctagccctgttgatacttagtataaagaagataatttttaaaaggatacttaatttttattgtatgttttgtgaggatatgtatctgaggtgtcatctactagatatatgtgccattttgcactttgtggtgtgctgagtaattatcaggaaataggatgtaacagagctctgaaaggtttgggaaacgtttcttaacattataacctttaatgacctaggaaaaatctttaaaaaatttgttaattaaaaaaaaaaa

SEQ ID NO: 609625 - DNA, 3091 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtggtgatgaatttttgtattcttttttaggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaagataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgatttt

SEQ ID NO: 609626 - DNA, 384 bp, Homo sapiens
cagaggggtccatacggcgttgtctggattcccgtcgtaacttaaagggaaattttcaacaattgtccggagccccttgatgtcctgcaaattgaaggaaggaggatgtcctcaagttccttgcagcaggaacccaacttaaggtggcaccaatccttgactttccagatggaccagtaccatctattaaaaggaaaagtgatggcatctatatcataatcctcaaggagacctgggagaagctcctctggcagctcgtccaatttgttgccattgaaaccctcctgatgtcagtggtatatcctccaggattactgccacaggcctgtctgaagtttcctgctgcactggagcaatcaattctggcgctcatctggacctcac

SEQ ID NO: 609627 - DNA, 2348 bp, Homo sapiens
tttcagcactaaagaagaatttaaatacaaaatagaatgttatatatcttgtagacagtcaaatatttgatgttttatgggacataatcatttgggaagtttttgttgtaaatgaagagttagtttgttgctattaatttgtttgacacataagttcattcctaaaagttagggatgttacataaagaagggttgaggactttatttcagaagtcatttaattttttctttattttctttcagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaagataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgatttt

SEQ ID NO: 609628 - DNA, 2463 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgtaactccctaaacgagaatcctggagt

SEQ ID NO: 609629 - DNA, 111 bp, Homo sapiens
cggtcatctagaggatcttccctggtatcccaccagttcccttatcaatatgatgctcttcctcagcatgtatgtgctctccaatgatgtgatgtctgtgtctccaaattc

SEQ ID NO: 609630 - DNA, 2807 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttaggctcagtgctgtccgggctggtttgcccggtccctgactaacggctttctgccccttctctcgccacccctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaaaaaaaaaaaaaaaaaaaaaaaaaaaaaaaaaaaaaaaaaaaaaaaaaaaaaaaaaaaaaaaaaaaaaaaaccaaaaaaaaaaaaaaaaccaaaaaaaaaaacatgtggcccccttggcccaattaaattttaaactcgacaaagttaagccatgcgcccaaaattcaggttaatttgccaaattcccctaaaggggagccgattaaaaataaatggcccgacgtttaaaaacgtgggaattggaaaaaccttgccgtacccaaattaaatccctttgaaaaaaatccccttttcccaagttgccaaaaaaccaaaaagccccgaacgaatcgcctttccaaaaagttgccaaccttaaaggga

SEQ ID NO: 609631 - DNA, 575 bp, Homo sapiens
aaaccgaggctgcagcagcaagaaacacggccatcgtcacattcttgaagaacatggccatctgcacctgatcactgaactgagtatggaagatcattgccgtcacgatgcagtaccccgccagcagccacgcgacgatacgacttttaaaacccatgaccagcaacaaacccgaaccaatttcaaacaccaccgtaggccagagcaacactgcaggcaggtgcatcgcctccatataaccgcgtatagcttcggggttatcgattttgccaacgccggacaaaataaagagcaaagccatcaacacgcgtgcagcgaccattattagagattgtgtcttagcgttcatacttttgactcacgctcacttgagggtattagtagaagaaaagatatagcgcgcaaaacgccactttccgtcgggctctcgatgcagcaagaacacttcctgattgccttcagcacttcccggttgagcatttactagcggagtgacggttccgttggagcgagtacgcgcgaaggcccagtcccgggataacggtcgaatctcgtcatcgtaaaatgtatcttga

SEQ ID NO: 609632 - DNA, 2601 bp, Homo sapiens
  misc_feature (26)..(26): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaagataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgatttt

SEQ ID NO: 609633 - DNA, 469 bp, Homo sapiens
tgcatgagcatacgagtacctctggtggcctcacatgctacactcccaccagcgctctgacagtttacaaatgccatgggaacattgggaagttaccctatattgtctaaaaaggggaggcattaataatccacaccttgtttagcatatcattaagaaataaccataaaaatgggcaagcagcagccctctgggctgctctaaggagtagccattctttattcctttactttcttaataaacttgctttcactttactctgtggactcaccctgaattctttcttgcacaagatccacagaactcttggggtcaggattggtaccccttttctgtaacatcttcatgccagctataacgtgaataacacaatgcaagaaagtggattagcaaactgcgaatatcttcaaataatattagttttataactcactaatgaatatttcccaaaaaaacccaagggatcctc

SEQ ID NO: 609634 - DNA, 2772 bp, Homo sapiens
  misc_feature (19)..(19): n is a, c, g, or t
  misc_feature (21)..(21): n is a, c, g, or t
  misc_feature (43)..(43): n is a, c, g, or t
gctcggttcccggatctcntngtgagatcgtgcaaagtagcanataaaacgggtagcatcactatttccgtgtgggatgagatcggaggtcttatacagccaggggatattattcggttgaccagagggtatgcatccatgtggaaaggatgtctgcccaaggtcgcccctctgccttcgcccctgtcccgggagggtgggaagctttgaccccgccctgcccactcgcgtctccgcagccgtagccgcgcctgtcccaatatgaatagggtcaacgacccacttatttttataagagatattaagcccggactgaaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggatctaggtgcggtgcaggcagccgcaatgcgagattccatacactactaccctggtaatgatctccaccctgacctggaggagccatcctctctaggggtgtaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaagataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgatttt

SEQ ID NO: 609635 - DNA, 2962 bp, Homo sapiens
  misc_feature (26)..(26): n is a, c, g, or t
  misc_feature (400)..(400): n is a, c, g, or t
  misc_feature (404)..(404): n is a, c, g, or t
  misc_feature (410)..(411): n is a, c, g, or t
  misc_feature (417)..(417): n is a, c, g, or t
  misc_feature (424)..(424): n is a, c, g, or t
  misc_feature (435)..(435): n is a, c, g, or t
  misc_feature (437)..(437): n is a, c, g, or t
  misc_feature (445)..(447): n is a, c, g, or t
  misc_feature (451)..(451): n is a, c, g, or t
  misc_feature (462)..(463): n is a, c, g, or t
  misc_feature (470)..(471): n is a, c, g, or t
  misc_feature (475)..(475): n is a, c, g, or t
  misc_feature (477)..(477): n is a, c, g, or t
  misc_feature (526)..(527): n is a, c, g, or t
  misc_feature (539)..(539): n is a, c, g, or t
  misc_feature (554)..(555): n is a, c, g, or t
  misc_feature (576)..(576): n is a, c, g, or t
  misc_feature (580)..(580): n is a, c, g, or t
  misc_feature (582)..(582): n is a, c, g, or t
  misc_feature (586)..(587): n is a, c, g, or t
  misc_feature (597)..(597): n is a, c, g, or t
agcggcgacgcagcgtgacttcacanggggaggggcgggccgagggtcctgccggcgcgcgggcgtgttcatcggagtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttctttagaacttgtgagcctttttttttttttttttttcttttctttttttggggggggggctgtcgggggggggngggngggggnnggggtngggggtnggggggccttngngggggggnnngggncaggggggggnntgggggnngggncnggggggggggggggggggggggggggcccgggcggggggaggggggggnngggagggggagnggggcgggtggcaanngggatggggggaaggggcagnggtntngagnngggggatganggcggggggggaaaacttaaatgtcgtctttattgtcctggagataggacgcgtgaccaaaaccaaagacggccatgaagtgagatcgtgcaaagtagcagataaaacgggcagcatcactatttccgtgtgggatgagatcggaggtcttatacagccaggggatattattcggttgaccagagggtatgcatccatgtggaaaggatgtctgacactttatactggaaggggtggtgaacttcaaaaaattggggaagattttgtatggtttattcagaagtgccaaatttcagtgaacccaacccagattatcgaggacagcagaacaaaggggcacagagtgaacagaagaataattccatgaatagtaatatgggtacaggtacatttggaccagtgggaaatggtgttcacactggccctgaatcaagggaacaccagttttcacatgctggcagaagcaatggccggggacttataaatccacaactacaaggaacagctagtaatcaaacagtgatgaccacaataagtaatggcagggaccctcggagagcctttaaaagatgacctatgctaaatactcatgtgtagtttttatactacatgccctacttgaacacttattgcacttttatttattgttaactgtgaaaagtacgtcctttattgggtttccttttatattcttggtttgttaagaagaatggtttgtttttatagcaaaactgttaagctgctcgagtctcctgttgaagaatgggaacactgaaaagtaggggcatttatttttagagtaaaaagattattggatagcctttaaaaaacctgcacccatttcatgggtgagttacttaagacatcagctttatagcctctatgagtctatcttctgtataagttttgtaatatttaacataaggcttaatgggagatgttcttttgtcttgtattcagatattgccaactaaagcaataaccatcaaaaaacacaagaacttgtcaatgctagcagtaatttttgagtgtttgtggctctcggaatgattgacttcgttcagtgactactattaagattttccaaggactgactcatcccaaatttttgttgtattaccaaaaaaacagattccttatcagaatttggaatagaatgtgatctctattgcaacaagtaattttaaaagaaagctacatttattttagagtagtgctcctaacatgtattatcaactttgtggattacattggaggaaaatttaaaactggggccttgaatatttattttttgaaactaccatgttaaatactgaagtataatttgggggagttataaagttatgataaacattcatctgattattttaaacaatagttgtggtagataaacatactggaggtgagtcaaattgaattcatatagtaacatgcagtctgaagtcctagttacttaataggtactcagcctggagtgaaaatcctgggtactgactttgagaggagtgagtgtgcatgttgtcaaagtttctgaacacagttcacatagccttattagcaaaagttttaagaaatggctctatcaaagaagcaattgcagctttattcagaaatataaaagtggaatttatgtacatgtcataagtggtacccacttcccctttttactgtagggtggataactcttaggatttaactctttgaatattatctcttgaataaagcatgtgttaatgttaacaaacctacgtaatttttgccctttcaatgacttacagtggagagccagtacatcttaactactgttgtagtgatggtatcaacctcatggttacttagctctgcatttgttgctttgttttttttccacttcaaatcacaaaataagtagattttgttttctgaaaactccatagcatttgaatacaaaaagttgtgccagattgtttgccctaattcactgtgtttaacaaatatttcagtacacactatgtattaggcactgtgtggaaagtgttaaggggtagacaagataccgaataatctccacaagtttatttgtggtctatagtacttttgtaactggggttacaaaaattatagaaatttttttcctttgttcatatgcatattcatgattataatttggctttgtttgtgattaatgttttcttaagattttcacattatagaatacctcaaaagaagttgtctaaggactgggatagagagtatgtttcataaaattgtagatgtttagaatttttaaaaaccctacaaattagtatatgattgttttatataagtaagataggagcaacactttaaattatttgtgggagaatacagcattaaaggtgatttt

SEQ ID NO: 609636 - DNA, 348 bp, Homo sapiens
gccagtgggttcttgagctcctgatctcaggcaatctggcctgccactggtctcccaaagtgtggggattacatggcatgagccaccatgctcagccttgtgtcccttttggaatgatctgactcaatcttccagaatacttcatctggcttctgtccaactgcctttgagattccggacttttggagtctgtatgctatgctcacgggaaatgttatctcaagccttcatagccatgtgctattggccatctccacaaagctgatttcttgtatggcttagaaaggggatctgcagggggctatgtaaggaaatatccatgcattggagaggtgcatactaaagtag

SEQ ID NO: 609637 - DNA, 347 bp, Homo sapiens
ggaccccgacgtcttacaaaatagtcagtgacaggatctgacagctgcacagtgtctgaccctgatctaacctatcttctcagccagagaggtggagcgtgcgccaggacacatggatattagtggcagtgaacactagcacaagtctcagatcacaagctggctctgggtgacctagacaggggccataggctcacaggacacccagagctggctctatcagcacttcaggccatcaggcagagaaaagcaactccataggggctattccctagctgataaacaagaggcaaaccaatttataccacgaaaagtaggattcgggggatgtaagtacttgccaggtc

SEQ ID NO: 609638 - DNA, 740 bp, Homo sapiens
atggactaatgaggctctaacactgctcaggagacccctgccctctagttggttctgggctttgatctcttccaacctgcccagtcacagaaggaggaatgactcaaatgcccaaaagcaagaacagcatggcatgaagtaagacaggatatgtatatttttaaatggttctaacataagacctgtgctctctagccatggatttaccagggctttctgaaagatctagtggttcagacagagagagagagagtactgaaaaagcaagtcctctggttagtcttaataatttactaaaaatggtccaagttttcattagtcttttattgataataaagcctggatgggttttttttatgaagctccttagctctgatgtctggtatagtgtggcagctggaaagaggttaatatttaagtgtttcacatgtagtttggtggtggtaagtggaattcggatttctgtaagtgtggtaatgtggattagcagtatattattcgttgaatatctgaattgatacttaaagagtagtgagcaatataagaggcaactggtggtttgacaagtaagtgtgcatggttattgagttggtacttgtaccttatttggaagggatgaagggaatgaatctgtttttccgaagaaaaaaaagatataaaaagaaatttgtgggggggctgggcccggaaaagattttctggaccctttctggggggggggggggcccatgatgtatatg

SEQ ID NO: 609639 - DNA, 276 bp, Homo sapiens
  misc_feature (261)..(261): n is a, c, g, or t
  misc_feature (269)..(269): n is a, c, g, or t
tcatcccgtaggtgcaaaagcaatcaatctcacttcgggcttttgggtttcctgcagcgctttccgagtctccatatagggttctcggagacttctacaggaccgtcacaggaggatcagagtcagagcttcagacactcaggacacccccccccaaagaccaacccaaccccccggaaggaacgtccgagtcagaagtgtggggaaagccaccgtggtgacccgcagatagtactggtcttcgccttgcgtgaggtttgncaaccggncatcttc

SEQ ID NO: 609640 - DNA, 1116 bp, Homo sapiens
atgagctggacttttctctttgtctggagtgatgctccttctgtttccttgtgcatgtagctccctgtgtgctggctggcaccctgtggcagccctgtgctggacgcagtgagcgatggcaatgtgaccgatatagctctgccagtgtgtggtgaatgggtttgcctgaacttgtccccctggcttggcacatgttgggtgtatttgacatgcttgccttgaccagcttggtgaataatgtccctgtcagccatgggccttcttgcttcaacatcctgtgcgttgggatgagacaggtttggcgcaatgtccaccctcatggaccaaccctgttcaacaccaaattctgaagtgtgtgatgccatgccaaccacacaacagcctgggtgtccatgctccatgtctaatacctattgaccctccaatgagatgcaacctgtgacgtgctacaatgctcacgatcgttagcacagttgtgctttttgtggtgaccaggatcaaccaaagcatggacagctaccaaagcctaatcgtggcaatttcatcgattcgcaccaattccgaggccttaccttgcatggaaacgacgcttacaagatcctgacacgacgttgctaccacagcctacccatttgaactcccctgaagtccattgtctcgcctttgtcacttctccatttggccccccaactgtggtacagttcccctggaacgtctctagagacccttaggttgaactattggaatgacacgtctggcaccacgtacaaggtgttgaaacccagttcaattccccccaaattcaaattggcccacaaatcccatcaatttccccattttccgcacagcattgtgaacctaaacccacaagtttccaaacaatcccacgaacattcaccccatccgaacgcctttggtccagcaaacgtggtgagttcccaggactccaactcaggcgttacacctaaaccagactgacttgaaggtccgcgttgcgacaaagccaccccactgggagtgccacttcaacccggccgccaccattggccggcaaccgctggctcactgggcgcccgccaatcaaaggccccgtgcacggacatcgcccaccaccca

SEQ ID NO: 609641 - DNA, 284 bp, Homo sapiens
  misc_feature (134)..(134): n is a, c, g, or t
ccccccccccggggggggccggggttttttttttggggggggttttttttttcccccccccccccccccccccccccttccgggggtttaaggggggggggggggggcccctttttttttttgggccccctttnaaccaggggttttttttgccccccccaggggggttggggggggttttttccccctttggggcccccccggggggggggcccctttttcccccccccaccttttggggtttttttcccccccttttttttcccgggttgggggggggggga

SEQ ID NO: 609642 - DNA, 1009 bp, Homo sapiens
ttcgggatcactccttcggcggcgacagaagtgcgccctctctatacgattagtcacactcctttgtagtatcgtgcccccctacttcatccatgtttttgcacacgtatgctactaccgacgatccgcctcattaatagcggccccctctacaacggtgcctttacaaacggtgggggtacttcaccctggcgtccaggccttaaactcttgcggcggaatacaacgtgttttttcccccttgcggcaccacacagaatgtcttctcaacccccccctgttctcccttttatctctggggtacacctcaccgcctcctgtcgcctccctttttgtgatataagggtcacctcggcgcaatacagcgtcctcttatgggcccataacgtctcgcgtcctgtctgggtcttcccctggccataacttcgaaggggtcctgctaatatgaacgtcgcttttttgacccgcctgagaggctttccctgggaaccttggcaaacactctaaatgtgcgtctgagaaacctcaaagtagggaaaaggagcctctggtatccaaaaccgtgaacagtggtagtcaataggtaacggttcgtacagaccccttttattacagtgattccgtcctggttccttgcagccaaaatcctctatggacaataggatggtgctgtgttcgcatgccctcttgccctgacagtgtcccatggggccccattctgctaccatgccccgtccggtgctacgtgcatgatgcactcgtcgctctccctgcagcccatggccttccgcagccttcctcctgacccctgtcgcaacagccggtggaactccagctgccaccaccctctgggtcggacactgggacccactggcaccagtcttggctgcatgcttacacgctctagcgcgttgatgcctgccaagggacccacagccccctgcccgttgccctgcagctttaacagagtgaacatgtgtatttacaggccgagttgtcattgcacgaa

SEQ ID NO: 609643 - DNA, 415 bp, Homo sapiens
tgaccaatgtgagaatacaaatcttgtgttgacctgattcatcaccgcataagcggatgtattccaaaccacggatcccataggttgacctcattatttctaacgtccaacaggacgcggtcactagtgaatgcccgaaattcctgatataaactgccattcaagttcaagtgtgtcagacttacaattttgcacaggtttgcctgagcatatattatttaattcatttcccagagacaggtattatagacttatagcttctctatgagctgaattgcctgttggaatcagtgaggtaggctgtgtgtgtgtgtgtgtgtgtgtgtgtgtgtgtgtgtgtgtgtgtatcgctaggacatctctgtttctctgctctctttagagtggggtcccgcgctcgtatgcgtactcatgc

SEQ ID NO: 609644 - DNA, 409 bp, Homo sapiens
tctttgcggtgcctttccccaacttaaacctctttatttataaacttacccagtctcagatatttctttataccaagacaggaatagcctaacacaggaaatggtactgaggaatggggcgtgctacaaagatacctcaaaatgtggatgcaactttggagctgcgtaacaggcagaggttggaaaaatttggagggctccgaagaagaacaagaggatgagggagttgggaacttcgtagagactggttaaatgattgtgacgaaaatgctgatggtgatatggacagtgaagtccaggctgaggaggtctcaagatgcaaatgaggaacttatgggaaactagagcaaagatcacccttattatgccttagcaaagaattgggctgtatttggtcacaccctaggga

SEQ ID NO: 609645 - DNA, 1990 bp, Homo sapiens
ggggcgggcgaggcgcgtgccggccgcaggagctccgggttgccgccgccgccgccgcccgcagcccacgtgcggccgctgctgcacccgagctcacgccccgcggccgctttgttgctcccggccggcctgcacgatgcacacgccggacttcgcaggcccagacgacgcgcgcgcagttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggattttt

SEQ ID NO: 609646 - DNA, 570 bp, Homo sapiens
tcccccgtgggggggtataataaccaggacgcctttttggggaccgctccgggtcgtcctgggggcgcccacccacaccgtgttggtgcccccccgtaggaaggaccaccggggggcccgttgtccatcccctccggtgattttttcccttttagcccggggccgggatggaccacaatttccccccggggagaccaccttgtgcccccttaggcgccttatttagggggcaaccccatgagagccacaagtttgtgcagcagaaaaaccagaggtggtgcccggtgtccgggaattcgccgcgggtttgtcgcggcaccccaggtgcccccggacgccggggggtttgttggaaataaagtggattgcgcccccgggcaggacaaccactgggttttttttttttgtgtttttttgtttttttttgtttttttttttaagtttgaagcacagttaaatatttttggacttggatagggttgattgtttaatgggtagataagggttcctaaggacatttttttgtagccgtcctgggttgtaaaaaaaaattgggcgtcccaaagccca

SEQ ID NO: 609647 - DNA, 181 bp, Homo sapiens
gttacataatgctataatctgccttggcagttttaaagcatcgtgttcatgcccactgacacaatgggactccacaaatatagtcaataatcatgataaaaaattataatatgattatcaagtgcagcaggtattgacgaaatccaaagttctcacttgctcactgtacaacggcctggga

SEQ ID NO: 609648 - DNA, 749 bp, Homo sapiens
cccagccactttttggcttgaacctcaggagttaattttattaatcatttacccaagaaaaatatgaacttagtagccctttttaagagtcaggatttttggtggcaacgcttgccagcttagttctgtctgtgaaatgttggcttaaaagccgaattgtcatgagcattccttgaatgtcttttactacacctcggtgtttgttgctatagactattgcatgtgcattacatgcctactgtaggcttctgatatgcatatccacatgcccatcatgggtggcctctgtatttcccctgcactgagaagccgttgtgttgtgtcgcctttaggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctggtaagaggaggtgggagggaggagcgttttgtgcacatgactagagtagctgaactcagtgtgttgaagaacttgtgcagaagattccctgggatgctggcaaataagttgcgtatcctctctgtgtgggtctgacggagtacgaac

SEQ ID NO: 609649 - DNA, 4002 bp, Homo sapiens
ggggcgggcgaggcgcgtgccggccgcaggagctccgggttgccgccgccgccgccgcccgcagcccacgtgcggccgctgctgcacccgagctcacgccccgcggccgctttgttgctcccggccggcctgcacgatgcacacgccggacttcgcaggcccagacgacgcgcgcgcagttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacccgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttctgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttac

SEQ ID NO: 609650 - DNA, 395 bp, Homo sapiens
tagaaattgaaacctggcgcaatagatatagtaccgcaaaaaaaaaaaaaaaaaaaaaaaaaaaaatttgttcggcggcctctgggccctctcgagaaaactttttataacaccaattccggtggggcgcgcgggggccccaagtatgggtataggtgaaacagtgtggccaaatagcgtgtgttcccataagaaaacccggggccaagaaacaaagggcgggggattctcacaccaaatataacaaaacccccggggggaacaaccgggcggtttggaaacaaattccacaaaggggagctgcggagaggccattaggggggaactcatatcaagcggggagtcccaggggggacccgcaaaattctaattaagccccccacccggggggcgga

SEQ ID NO: 609651 - DNA, 3946 bp, Homo sapiens
ggggcgggcgaggcgcgtgccggccgcaggagctccgggttgccgccgccgccgccgcccgcagcccacgtgcggccgctgctgcacccgagctcacgccccgcggccgctttgttgctcccggccggcctgcacgatgcacacgccggacttcgcaggcccagacgacgcgcgcgcagttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggggagaagcctttcaactgcagctgggatggctgtgataaaaaggtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacccgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttctgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttac

SEQ ID NO: 609652 - DNA, 928 bp, Homo sapiens
  misc_feature (37)..(37): n is a, c, g, or t
  misc_feature (79)..(79): n is a, c, g, or t
  misc_feature (91)..(91): n is a, c, g, or t
  misc_feature (96)..(96): n is a, c, g, or t
  misc_feature (165)..(165): n is a, c, g, or t
  misc_feature (168)..(168): n is a, c, g, or t
  misc_feature (173)..(173): n is a, c, g, or t
  misc_feature (177)..(177): n is a, c, g, or t
  misc_feature (191)..(191): n is a, c, g, or t
  misc_feature (193)..(193): n is a, c, g, or t
  misc_feature (209)..(209): n is a, c, g, or t
  misc_feature (211)..(212): n is a, c, g, or t
  misc_feature (221)..(221): n is a, c, g, or t
  misc_feature (223)..(223): n is a, c, g, or t
  misc_feature (247)..(247): n is a, c, g, or t
  misc_feature (259)..(259): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (314)..(314): n is a, c, g, or t
  misc_feature (318)..(318): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (331)..(331): n is a, c, g, or t
  misc_feature (347)..(347): n is a, c, g, or t
  misc_feature (369)..(369): n is a, c, g, or t
  misc_feature (380)..(380): n is a, c, g, or t
  misc_feature (389)..(390): n is a, c, g, or t
  misc_feature (396)..(396): n is a, c, g, or t
  misc_feature (411)..(411): n is a, c, g, or t
  misc_feature (415)..(415): n is a, c, g, or t
  misc_feature (429)..(429): n is a, c, g, or t
  misc_feature (442)..(442): n is a, c, g, or t
  misc_feature (451)..(451): n is a, c, g, or t
  misc_feature (453)..(454): n is a, c, g, or t
  misc_feature (457)..(457): n is a, c, g, or t
  misc_feature (491)..(491): n is a, c, g, or t
  misc_feature (516)..(517): n is a, c, g, or t
  misc_feature (528)..(528): n is a, c, g, or t
  misc_feature (537)..(537): n is a, c, g, or t
  misc_feature (539)..(539): n is a, c, g, or t
  misc_feature (541)..(548): n is a, c, g, or t
  misc_feature (576)..(576): n is a, c, g, or t
  misc_feature (581)..(581): n is a, c, g, or t
  misc_feature (584)..(584): n is a, c, g, or t
  misc_feature (587)..(588): n is a, c, g, or t
  misc_feature (592)..(592): n is a, c, g, or t
  misc_feature (601)..(601): n is a, c, g, or t
  misc_feature (605)..(605): n is a, c, g, or t
  misc_feature (607)..(607): n is a, c, g, or t
  misc_feature (609)..(609): n is a, c, g, or t
  misc_feature (613)..(613): n is a, c, g, or t
  misc_feature (622)..(622): n is a, c, g, or t
  misc_feature (624)..(624): n is a, c, g, or t
  misc_feature (626)..(626): n is a, c, g, or t
  misc_feature (629)..(629): n is a, c, g, or t
  misc_feature (641)..(642): n is a, c, g, or t
  misc_feature (670)..(670): n is a, c, g, or t
  misc_feature (673)..(674): n is a, c, g, or t
  misc_feature (681)..(681): n is a, c, g, or t
  misc_feature (694)..(694): n is a, c, g, or t
  misc_feature (700)..(700): n is a, c, g, or t
  misc_feature (703)..(704): n is a, c, g, or t
  misc_feature (710)..(710): n is a, c, g, or t
  misc_feature (726)..(726): n is a, c, g, or t
  misc_feature (730)..(730): n is a, c, g, or t
  misc_feature (741)..(741): n is a, c, g, or t
  misc_feature (761)..(761): n is a, c, g, or t
  misc_feature (771)..(772): n is a, c, g, or t
  misc_feature (782)..(782): n is a, c, g, or t
  misc_feature (784)..(784): n is a, c, g, or t
  misc_feature (853)..(853): n is a, c, g, or t
  misc_feature (926)..(926): n is a, c, g, or t
aaacaagagaaagagggaaggacttctgacgccaaancatgcaagtaataacaaaggaacagagaaaaagaggaagaanaaaaagaaaatnagganaaagaaagagagaagcaaaggacggcacgagggcacagcagggcgtgggcagtactggcaagcatttcnggncaacngcgnccaacagcaggaanangaagaaacccccagancnnagcaaaagngnaacaacattttctccctgacagcntacattccaagncattccataccataccgctccactccacagttttataaaccnganctnaagaggnaacnaggnacnangngngcgcacaataaaaacnaactaaaaacaaatcagagggnagcagaaaagnaaacaaagnntccagnaaggcatcaggagancacngcgggggggccccncactttaccagcntaaagaagngnnganttttatttctcagcaaactcaatattcagaagcnttaccagcagactcaagtgaaaggnnttaaatacagnttacctcantntnnnnnnnngggaaatatttcatataaaacatgaacncaagngcnacnncatngaaaaaacngaanangngaanaggaaaaananangtngagagggcgctnnggaaaaagacatggaagaacaagacttnatnngactgtntttaactccgccncccacncgnnccccancccccaccacaagttnttcnggcagagatanattaaggcaaaggctcctgnagaggtacgnncacctgggcngngggcgggagactcaaggtgaacacactctgctccttgcagggtcaacagaaaggcttctccctcatgtncactgagccatcctgcatcccaaagtagactctctcagccatgtggatgaataggcctgtgttcaccacaccngg

SEQ ID NO: 609653 - DNA, 4110 bp, Homo sapiens
gagcggacgcggccgtcgggcgggttaagagcgtgctagcggtagtgccgctcgggcctgggtggcggggcaaggtctaggggccggggcaacgacgggaggcgggagcgccgcactgccttggaggcggggcaacgcttggaggcgggaacgcggcacgcgagcgttgggggccctaagcgtcgcgacctgggggcttcggggaggtagccgtggacgtgggcagagcgcgggcctcgtggtgtgcgggcactgtgggccgggcgagccccttcccgcccgtgtggttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacccgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttctgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttac

SEQ ID NO: 609654 - DNA, 115 bp, Homo sapiens
  misc_feature (35)..(35): n is a, c, g, or t
  misc_feature (77)..(77): n is a, c, g, or t
gacatgcgcaggcaggtgatggcggcgctggtcgnatccggggctttggagcagggcggacgaaaaggcccgtggcngagggggtgtccctcggggccgcggggtctttcagttt

SEQ ID NO: 609655 - DNA, 3775 bp, Homo sapiens
  misc_feature (23)..(23): n is a, c, g, or t
  misc_feature (31)..(31): n is a, c, g, or t
aaaatgagaggtaggtacagagnacttcccnttacatcctgccccacacatacatagcctcctgcaccgggtgtgttcatgcagcctgaaacccacggggatgtgaaaacagggttaactgagtgtctagatgattctgtgtaaaggtatggggagcatggtgatgaattaaatcccttttaaaatttaaagcaaccttttaacatggtacttttttttagtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacccgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttctgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttac

SEQ ID NO: 609656 - DNA, 2975 bp, Homo sapiens
agattgggttttactttgttgcccaggctagtctggaactcctgtgctcaactgattgtctccagcctcccaaagtgctgcgattataggtttgagccgctgtacttgtacttcgcctgatttatttttaaatatattttgaaagattagcttgaaatctttgggtgctaacatagctgcatcttaagtgtgggaggaataaatgccttttggaggatttcttgacccaaatcatccaattccagagtaataagataccactttcttctgagtttgatgaacacgattttaaaatgacatgaattaccccttgaataaggtgcttagcgtttcctttctctttaatatgtattttctcacctcacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacccgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttctgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttac

SEQ ID NO: 609657 - DNA, 4100 bp, Homo sapiens
ggggcgggcgaggcgcgtgccggccgcaggagctccgggttgccgccgccgccgccgcccgcagcccacgtgcggccgctgctgcacccgagctcacgccccgcggccgctttgttgctcccggccggcctgcacgatgcacacgccggacttcgcaggcccagacgacgcgcgcgcagttgacatcatggacatatgtgagtccatcctggagaggaagcggcatgacagcgaaaggtctacttgcagcatcttggagcagacagacatggaagctgtcgaggctcttgtttgtatgagctcctggggtcaaagatcccagaaaggtgacctgttgcggataagacccctcacgcctgtctctgactctggggatgtcaccaccactgtgcatatggatgcagccacacctgaactaccaaaagacttccattctttatcgactctgtgcataactcctcctcagagccctgatctcgtggagccatcgacaaggacacctgtttctccccaagtaacagattccaaagcatgtacagccacggatgttctccagtcctctgccgtagtggccagagctctgagcgggggcgcggagaggggcttgctgggtttggagccagtgcccagctctccctgcagggccaaggggactagcgtgatccgacacactggggagagccctgctgcctgctttcccaccatccagactccagattgccggctttctgacagcagagaaggagaagagcagcttctgggacactttgaaactttgcaggacacacacctcacggacagtttactcagcactaacttggtgtcctgtcagccctgcttgcacaagtctggtggcctgctgctcactgacaaaggccagcaggcagggtggcctggtgcagttcagacttgctcaccaaagaattatgaaaatgacctgcccaggaaaaccacccctctgatttctgtctctgtccctgctccccctgtcctttgccagatgatccctgtgactggacaaagtagcatgttaccagcttttttgaagccccctccccagttgtctgtggggactgtgagacccatcctagctcaggctgctccagcgcctcaacctgtgttcgtgggacctgctgtgcctcagggagctgtgatgttggtcctgccccagggagccctccctccgcctgccccctgtgcagccaatgtcatggctgccgggaataccaagttgttgccccttgcccctgctccagtgttcatcacctctagccaaaactgtgtccctcaggtagacttttcccgaaggaggaactatgtttgcagcttcccaggttgccggaagacctacttcaaaagttcccaccttaaggcccatcttcgcactcacacaggggagaagcctttcaactgcagctgggatggctgtgataaaaagtttgctcgttcggatgagctgtcacgccaccgcagaactcacacaggggagaagaagtttgtgtgcccggtgtgtgaccgacgtttcatgcgcagtgaccacctgacgaagcatgcccggcgccacatgacgaccaagaagatcccaggctggcaggcagaggttggcaagctgaacagaatcgcctctgcagagagcccggggagcccactggtgagcatgccagcctctgcctgaaaggtccattaggacatcactcatgggatttttaaaaagcctctttccaggaatggaactgatggattcctctcccactgcctcacccaaaaaaaacggtcttggcggcctaggggaagatcggggagctggttttgatgaaagtatgttaacttttcttttccacttgggaccctgttcagtatcttttgtagtttcagaagtttttttgttttggttttttttttttaaagaaatggtagaaaatttgataatctgaatcaccagcattcaaacaaatatttcggcaataaagtttacaaaatctggatttttacaaccttttctattgatgttttgtagaaataagacagggtactaatttttatactggtttttagaaaaatatttatattgttggtgctcaaatcaccaatttctagctagatcattttgcagccttcttttcagtgtttaataacaaagtttttcctaatggcccttcttttagtaaactggacatgttattccactacaaaaaccacaagttatctggccttttagatctttttggaatcggacctggttgagtaaggacctcttaaaagggaaaaataaattttgccgtcagcttcttcataacgttttcaaggaaattctaggcaatcattcctgtcaccaaagaactaaaattttggttgactggaactagtgagctgtgtccatggtgtgtcatgaaggatgtaccccagagagtaacatgagccactgggcagatcccagggaccagtacttgctgcaggatctagtctgtaatagtcttggccatggctctgctgaaagcaagccattcagtttcttgtttgtacctaaaacaccaaaaaagaaacactcaaatccagctgctttgtcaattgtcagttctgactccttttgctgtggccttatccgtactatattgtgggtagagtaacttctcagaaaaaaaggaaatgtctgtattggttggatgaaactccaccagagcacagcttagctggggcgagatgcatgtgaaggcaggcagtgccaagattccgcttcctttgtttgccaaatactagaaacacaaggaaatgcaagttacgctaaatggcagtaatactacccaactgcctttctgttcattttgtttgaaggaaattgttttgaccaaacagaaaattacttggaatggtgtgttttacagtctacctagaaaatagatggacaatatttttcaactgtatgagcacgtagataaccgagagaatgtggccacctgtgttcaagaagccactgatactggtttttgttaaacattggaagttcaggcaatggaataaatgtaggaacatacagaatgttgcactaatttggtagcctgggaattttttttattgtgcagtatgtatttaaattttgtctatgttaattaccagcatttacctttatttaaatgatggtaaggtggaatattgaataaaattaggttttgtgttttgttctttgtagtctgataaaatctccacctggtcattcattgtgtgtgacttgatacccgttaacttgccccttagtatcagctgttacttgacacaaatgtgtgtgttattcagaggttttcagtctggacactccataggtgagtgtcgtgtcttcgtgagacagcacagttgtctcatgttgtgcatagttcatgtttcctcaccacccagtcctttctcctgctcatcaaaatcagcatacacatttttgactgtacacactataaatggcatcaaatttggatatttttcttaattatgacatgcaaagtaatgtgagtcctgccagtattctggtggataaggtcttctgagtatttggttgcttgtcacaacattctccaagcagtgatatttctaaagaggagatacatgttgaaaacggttttaatttacacttccatttcctgattacatttggaaatactttgtgtaaaccatcccccttccacctccatttgtctgttgaaagattttaagttggaaacagttcctgtctgaaaactcttctgagaaccacaaaccttgtgtatggattcggcatggagccctcagctggcggctctgggtgctgacggccgctggagaggtgggctcccctcgtgcactttattgcctgggcagttttgcttgatcttttgtgactttgagccttttaagtagtttgaatgataagacttaaaatgtttcataattatgttttatgtaacagactttgacattatttaaacgagcatgtgtaatgtaacttttctctttgaatcatataaaacttgattttacattggatgtgtgtcctgtgtcatttaactgtacctggtggcctaagtatacctagagactttttggaagaatctataaaattcattgtgtattggctc

SEQ ID NO: 609658 - DNA, 299 bp, Homo sapiens
ccggcatggtgtggtgttatgtgtcttttatagataattatccacgagtcaaatgcaaccggtctcatacaatatggtggtcgaatcgaccttcaaatcgtaattataccaataatgctataatttttgttcgagttataagtttgtgaaattgaaaagatagaagtgatctcttggagaaaatgaacgttttttttggtttagggagccatcagctaaagatgcatgtagcgaaaaatcgtgttttcggctaccctcccatgaccgggcataacaccacacaattccgggtaccgagc

SEQ ID NO: 609659 - DNA, 226 bp, Homo sapiens
gcattcgaaaaactgttttctgtgaaattggattgtttacaatcgaaggagaagttggacccagggtcccattcattcgttttgcgtggagtttctgtgattctctttggggttgtttattcctagtcttattggccaattcctcctccgcatcgaatcttgaccagatcgagtttgaccatttcctgttatgacttctaatctcaaacatcacctcgcgaaacac

SEQ ID NO: 609660 - DNA, 370 bp, Homo sapiens
ttggccacttgtctctaggctatgggacaatcatcccattcaccacttgacatccttggcattcttgactttcattcccccaaccttcagcaggttgggcccaatcctctttacctatgagttttcttctagaagaagcaatttgggtctgagaggagcattttgctggaaggccatcttttaaggcccctgcttgctgtcataacgcagagcagaaacttgcacactatttaaaggagctcctttccacctttcttcccaagcttgataccttacttctgctatgggcatggctgggaaggccccaccagctcccggttttggtgtttcggcaaccacttccggggacttgtgactggagattcttaac

SEQ ID NO: 609661 - DNA, 402 bp, Homo sapiens
  misc_feature (92)..(92): n is a, c, g, or t
cttcttcatccatggattcaactaaccttgatggaaaatattttttacacaatacaacatggcacaggcatggtgcctacatgcctgttaantcactgcctcaacctcccaaagggctgggattacaggcatgaggcaccatgcctgtaatcccagccctttgggaggttgaggcaggtggaccatttgatgttaggagtttgtagccagcctggccaatatgatgaaacctgtctgtactggaatacaaagattggccggtgtggtggtgcgcctgtaatcccagctacacttgggaggctgaggcaggagaatctcttgagcctgcaagacagaggttgcagtgagccgagagcgcatcactgcactccagcctgggtgtctcaaaaagatcctgtctca

SEQ ID NO: 609662 - DNA, 956 bp, Homo sapiens
aacagtgtatagcttgaaatctaggattactagcaggaacggagcactttacagcaactgagggatttatacatgaaaaatggacaaggattatgcattagtttattccatcacagcacagtccacatttaacgcataatacaagcacctgcagcagcaacagcattctatcgcagttaacagcacactagcatgatgtctccacatgcattcgtgcttggtcacatacagtgtgcacttggccagcatgaacagcagtcgtcagcggacaggcaacaaggtccagacatctcagccaagcaccaatggcaacaactagtgccatttcttcagcacatcttcctgccacaaatcaaacacatacacatgtataatagcagcatcttctttcatgaccctagtgcggcaccatttacacagacacaaactaccaggtagccctagggccacacgggctccgcaagacaacagctacaatcaatggtacacaggctaggctaaaaaatcttacgtaacactgcatcaggcaggcatctagagcccagggacagcaacagcaacccggaggcccacaaatccaacaggagcccaggccaatttcccacaccttgcgtagtcacaaacctaacgccaatccatacctttacaactaggaccttattccctggtggacatgggtaccccttttcaagacgggcgcgtatgaccgagctacttatactcaggtacggaacgatgactaataacatgttcaggtattcacacagcgcagacatactcacctcaatcatagctcgcaccctacaacctcaggcgaatgggtaaaagaagaagggcatccatccaagaacgtacactggaaaaaaacactcggcacccacccacggtagaaacctgactaaaaacggagaacggcacaccaaaacatggcccccaactgcggatggcgaccaccc

SEQ ID NO: 609663 - DNA, 306 bp, Homo sapiens
ggatcgacggcatggtggtgcatacctgtggtcccagctactagggaggctgaggcaggagaatcacttgaacctgggaggcggaggttgcagtgagccaagatcgtgctactgcactccagcctgggcaacagagcgagactctgtcaaaaaaaaaaaaaaaaaatggaaatcggctgggcatggtggttcactcctttaattccaattccatcactttgggaggccgaggcaggtggatcacttgaggtcaggagttcgagaccagcctggccaacatggcgaaaaccagcctctactaaaaat

SEQ ID NO: 609664 - DNA, 1061 bp, Homo sapiens
cgcccgccatcacgcccagctaattttctgtattttttagtagagacggggtttcaccatgttagccaggatggtttcgatctcctgaccttgtggtcctgccaccttggactcccaaagtgctgggattacaggcataagccactgcgcctggacctatccttccttcttgagtgaagactgaaggctattggatttaccttcggtgatatatgctctcgactagtgatcccacgacagtcctgcacatgcagttcagtatcttcgagatgcatatgaactgtattacttctcgtcttccaaattagagaaaatggtgaggttctccagctacctggtgtggccccaagggttgggaaagtgagcacgtaagagtggagagattctacagaagactccacttgtgcgcaactctttctgggcgctaccataaaagggtccgagagtgagataactgccttgcgaccatcacaaagtgtctatccctatatcccgagaatatacacgcgtgggggcacccataccggggagggcccaacaggttgaccaccacagaccgaagaggtctgccagagggcaataaccatctcttcaacagcagctaatattctcgcacaagcgggagaggacagaacagggggcgatactaagtggccacgaagtcggccgatgcgcaccaaacaaggagagtggagacatatcgagccaccgaggggggaaagccattcccgtgggagcaccccaaaaagggaggtacgaccacccgcgggaaccaccccggcacaaacaatgaaggagacccctacacagcagaaaacaagagaagacacattagggacacatctacacccacagggcgacggcgacaagaacaaccccaagcacacacaccacagacgcccgagagacagagacgcccccaacacgataaacaacgaacgaggcgcagaagacgcaacaccacatggagcgcgggagcaaacctgagcaaaaaccacacaaccatagagaaggaagcgcacccaagcgacaaagagagctcacggagagacacaaccaaa

SEQ ID NO: 609665 - DNA, 110 bp, Homo sapiens
tacagtggcctgtctatatatattctttacagcatgtacctaactatatactaagttataaccaaatgacttcagaatacacgaggacatcaagatgatacaaagtagtg

SEQ ID NO: 609666 - DNA, 469 bp, Homo sapiens
  misc_feature (469)..(469): n is a, c, g, or t
attacactcttgtatccaaagctggagagtgttcacttgacctgggaccacagtatcctacggctaaaggccacaagcgagtttccttcctaagcctaacgtgttgttggggatacagccatgctccaccaagctggataactttgcattgtgaggaaagagggggtttcttcctgatgaaaaagctgatcgtgacctcctgacctaatgtgaccagcccgactcttcctcccaaagtgctagaactaacagacgagagcaaccgggccctggcggaatgaacattcacatgattttctactgtcacgtacatatcaaaggtgcttgatatggaccacttaatcgtatcatcttttgcaagatacacccaaaacagactcagtgagagtactatacgataaaattacaccaaacacagcggacccaatggtatgacatgagccgatgtaggacattgaagaccacccan

SEQ ID NO: 609667 - DNA, 142 bp, Homo sapiens
tctgcatttcagtcccacagctcatcagctctcttcatctgtttttatactattttctccccacccccagctatcccatagtgtgtgctgcagagttatatgccccaaacatggtcatgctccaataaaaatgattctacct

SEQ ID NO: 609668 - DNA, 283 bp, Homo sapiens
ccgaggacccatctcgtgacggcgacttatccgcctgctggcctctccacgtgcgggattacacggcgtgagccatcgcgctcggcctgtctgtcattttaacattatatctctcagcactggactactgccacagactggtcacatgctaaataaatatttgtagaatgaatgaataagccttgaagatggacttttactttggacaagtctggtatcgttttgcaactccacacagtgttgtacttttttttaactacccatactcgccggtcaccgagat

SEQ ID NO: 609669 - DNA, 604 bp, Homo sapiens
aaaggagtgcggcgaggtctcattgcgctcccgaacagacctgacgtagatccgaagtggccctgtgccatctcaactatgaggtggacacccgtagtgcggcgtggagagtggacgccgctgaggagccaataaatgctcctgcaaccgtgaagtgtcttctgggagtgggtctgtacccggaagtgtggcagctccctgggccgcaccctggaagtgtgatgccacctgacgctacggggaagtaatggtatccggccaatttgagattcggagttaacaacatgggatgtgcagatggacggtcgcgacggagacactgctgtcccggacccctggggtgcgctggagtgacttggagtgacaactgcaggtacccaggtgatggaagctaagagacacgtggaggaggtacaccgcggaaccccagacacggaattcgccgaacggaaccgaagcggggccctagtgaagggaacacgaggtggacgtcccaaaaggaaccaaagggaacccaaggcgcatccacgaaggccgcaatcgacgcgaggcagaccccaagcatcgagaagagccacatgggacaagaggccgaccctccatc

SEQ ID NO: 609670 - DNA, 107 bp, Homo sapiens
aacccgtctctactagaatactacaaactagcttggcgtgatggcgcgcacctatagtcccagctactacaagcagctgaggcagcggaatcgctatgaaccccgga

SEQ ID NO: 609671 - DNA, 228 bp, Homo sapiens
  misc_feature (43)..(43): n is a, c, g, or t
  misc_feature (45)..(45): n is a, c, g, or t
  misc_feature (200)..(200): n is a, c, g, or t
  misc_feature (205)..(205): n is a, c, g, or t
gggcgtggtggtgggcacctgtagtcccagctactcgggaggntnaggcaggagaattgctcggacccaggaggcagaggggcggaggttgcagtgagccgagattgtgccactgcatttcagcctgagaggcagaacaagactctgtctcaataaacaaacaaacaaacaaactgtccaggtgtggtggcacagccctntagtngacgctaataaagaagctgaggt

SEQ ID NO: 609672 - DNA, 437 bp, Homo sapiens
  misc_feature (14)..(14): n is a, c, g, or t
  misc_feature (76)..(76): n is a, c, g, or t
  misc_feature (161)..(161): n is a, c, g, or t
  misc_feature (164)..(164): n is a, c, g, or t
  misc_feature (171)..(172): n is a, c, g, or t
  misc_feature (174)..(174): n is a, c, g, or t
  misc_feature (182)..(182): n is a, c, g, or t
  misc_feature (192)..(192): n is a, c, g, or t
  misc_feature (194)..(194): n is a, c, g, or t
  misc_feature (202)..(202): n is a, c, g, or t
  misc_feature (221)..(221): n is a, c, g, or t
  misc_feature (225)..(225): n is a, c, g, or t
  misc_feature (277)..(277): n is a, c, g, or t
  misc_feature (293)..(293): n is a, c, g, or t
  misc_feature (297)..(297): n is a, c, g, or t
  misc_feature (299)..(299): n is a, c, g, or t
  misc_feature (380)..(380): n is a, c, g, or t
tcacccccggttanctttgtgtattttgtcattaagacttacattatgtttgggtcaaacaaaaaacccaaagagnttttataaaagtttacaaccattaaacagtattgtttaatcccacaaatggataaagcaaactactatagctcaacaatacacanacnaggtctnnanatagtcantctatgtttntngctagctnccatacaatagatattgantatnctgagtctttacaaaggcattggctattttagacgagcaggttccagaaatncacttgtttgtttccnatgngnactaactgtagtgccatttcagttgaagactatgcactcctcagtgtcagacgtgagggtaagcaaactaggggaaggcanaggagggtttggagggtgacctgagcgggctctttggacagctcagcattactttct

SEQ ID NO: 609673 - DNA, 259 bp, Homo sapiens
gatgcttacggtatgtgctaccaaataggggggtgaacaacaaagaaagattaccacagatgacacgaataattttatttttggcattttcccatttaatataatctgggatacgagagtaaatacggaatttctctctcttattcttttacactagagctgatgggtcagatggtggtatcctgaccttccccagatcttcctgtcttgggcccttatacacatgcactgaattcaccaggataaatacttgacagat

SEQ ID NO: 609674 - DNA, 166 bp, Homo sapiens
gcgagtcccgactcaggtaatccaatccgctcagcctcccaaagtgctgggattacagacatgagccaccgcgcccggccatatttttctatacaaaccacatatatgtgtgtgtgtgtgtgtgtgtgtgtgtgtgtgtacactgctcttttaaaaacaacaacac

SEQ ID NO: 609675 - DNA, 242 bp, Homo sapiens
atctaggaatcgtgaggagatctgaggatatctattaagactctcttgagtagactcttggcgtacgatcctgtagagtaaattgaggcgcatgtactggataaactgatattcccactgtgcctagcatactatccagagtaaagcacagactacagggaacgggcttggcggaatcagcggggaaagaagaccctgtttgagcttgactctagtctggcacggtgaagagacatgagagg

SEQ ID NO: 609676 - DNA, 663 bp, Homo sapiens
agaccagaaccgggggccgtgttgtcatccgaccagagagagtacaaagtgggctgcccttcagtgccaagcgggctggagagctagacgtgccgagagctcatgaggatgggaagagattcggtgctgtcctggaggccctggagaaggggcagcccgtggatctgagtgccatgcccccggacctgaggatctgaagccccagcaggcttcctcaggctcccacagcacctcagtcattcccccagccgtggagcgagtgcagcagtgatggcactgacgtcccagacaaccccagtggccatacagagtcacagacagtgctggatgcctgcagagaggctgaacaagtaccggaggcgggacatccaggccggagtggtggggacgagcgcaaggtccggatgcatgagcgcattgccgagcgaatatcaaagatgctattcgagcacagcgagcaaggacggaaagtcacacttggctgacattgcctggttccctccaggattaccccccatcctggcttggattccactatgggtgtggacggaggacgcagtgggcgaggacatttggcggtggcagaagaaaatggcctctgcagaggattcagaccggctgctcacgacgaggacgcgggtagcccccagcaaggccacagtg

SEQ ID NO: 609677 - DNA, 579 bp, Homo sapiens
  misc_feature (81)..(81): n is a, c, g, or t
  misc_feature (566)..(566): n is a, c, g, or t
tagccaggatggtctcgatctcctgacctcatgatccgcctgcctcggctcccaaagtgctgggattacaggcgtgcaccnacgcccggccccaaagttctaaagtaacattctattgctaaagaaatcctaacctactatgtaacatttttctcttagttaaaaatgtgaacttattattaacctcaattttttagaggcctccaatctttttaaaatataaatatttttgattgacaaatcataattatacacttatgggggtataaacctcaatttttgtaaccctattttggcattttcctgtccttacatctcagcttaaatgctccctcttttgggaggcctttttctgccttcaacatagtagagccttttcccccacccctctgtaacataatgccctgttttatttttactgcttttattttcatgctttgtgggtgtccccactggagtgtaagccctatgggagcaagggctgacctgtgactgttttatctccagggccaacagcagtgttactgtatagtatgtactcaataaatatttgttggctttatctnttattttttaaaa

SEQ ID NO: 609678 - DNA, 851 bp, Homo sapiens
  misc_feature (120)..(120): n is a, c, g, or t
  misc_feature (176)..(176): n is a, c, g, or t
  misc_feature (206)..(206): n is a, c, g, or t
  misc_feature (296)..(296): n is a, c, g, or t
  misc_feature (334)..(334): n is a, c, g, or t
  misc_feature (358)..(358): n is a, c, g, or t
  misc_feature (437)..(437): n is a, c, g, or t
  misc_feature (448)..(448): n is a, c, g, or t
  misc_feature (470)..(470): n is a, c, g, or t
  misc_feature (546)..(546): n is a, c, g, or t
  misc_feature (563)..(563): n is a, c, g, or t
  misc_feature (571)..(571): n is a, c, g, or t
  misc_feature (631)..(631): n is a, c, g, or t
  misc_feature (695)..(695): n is a, c, g, or t
  misc_feature (816)..(816): n is a, c, g, or t
  misc_feature (837)..(837): n is a, c, g, or t
atagcccgggcgcccgcgggccccacggtttgaccgggtcgtggcagccggagtcgtcttcgggacgcgcctgctcttcgcctttcgctgcagtccgtcgatttctttctccaggaaganaaatggcatccgttgcagttgatccacaaccgagtgtggtgactcgggtggtcaanctgcccttggtgagctccacgtatgacctnatgtcctcagcctatctcagtacaaaggaccagtatccctacctgaagtctgtgtgtgagatggcagagaacggtgtgaagaccatcacntccgtggccatgaccagtgctctgcccatcatccagangctagagccgcaaattgcagttgncaatacctatgcctgtaaggggctagacaggattgaggagagactgcctattctgaatcagccatcaactcagattgtngccaatgccanaggcgctgtgactggggcaaangatgctgtgacgactactgtgactggggccaaggattctgtggccagcacgatcacaggggtgatggacaagaccnaaggggcagtgactggnagtgtggngaagaccaagtctgtgaaaaagaagcaaaaaaagttgaaggctcagctccattctactgntcacctgattgaatttgccaggaagaatgtgtatagtgccaatcagaaaattcaggatgctcangataagctctacctctcatgggtagagtggaaaaggacattggatatgatgatactgatgagtccacttgtgctgagcacattgagtcacgtacttttgcaattggcccgcaacctgactnacagcttcagacacgtgccanaccttcttgtccaa

SEQ ID NO: 609679 - DNA, 105 bp, Homo sapiens
gccagcaccaaccagacatctatgtacctctgtgccaccaccgcggcgggaggtccctcgggggacaatgagcagttcttcgggccagggacacggctcaccgtg

SEQ ID NO: 609680 - DNA, 118 bp, Homo sapiens
gcttaggatcataacaggggcgcatgtagggctggtgccggcatgtggtgcataatgcgggccgcctgagtcatctggcggcatgcctgggacaggcccctggacagcccccaccagg

SEQ ID NO: 609681 - DNA, 201 bp, Homo sapiens
  misc_feature (113)..(113): n is a, c, g, or t
atgtggagtgagacatcaacattgatgcagtcgtttaataatgtctgcagaagactagatatatgacctgcaggagatagtagggaaactgtacctggctcctcataaaactncctgccttctatctccgggaggatcgcagggcatttccgccaagacaggtgagactgcggttctgacctgcgggcctcaatgaatatg

SEQ ID NO: 609682 - DNA, 744 bp, Homo sapiens
gcaggttctgagaaacagacaaggctggtttgtggagagagaatgtagaagatgccttggctgaatgcttccttttagttttgtaattctcaggctctttcacttcctaaggtcatgtgtctttctaccttcaggtcctccagacctttgagactctgcacagtatcacactaaagtcccctctcttgggagcttgagttgttctagttgtatttttgttgtttgcaactaaagaactttaacacacttttccttgtgctgagctcagttaaaccaaaaccttatttataccaacaaatgacttaattaagctgagtgggtaacagcatcaagaggaacttggataatcatgggtagctgatagtagttactttaaagcaaaagagaacagtggtgactacacatggagtcgtaaagccccaatctataatctgtgcacatcagactgccagtgtgaagtgctggtgctttatatgagagcagaatcagaagcagttatgccctcagttaatgaacagtgtgaacaaaggaagggggacttttacagcttgcgtggagcagctgagcatttagaggcgaagggagtacacgagagaaaaagttttcacttcaaacacaggaggttttgtagtgcttattattttaggctgacaggctgcctgctttcatgtatcgatatactggctttgtaacacaacacatcatttaccacaatacagttcgatcacaaaaaacaaaacaaca

SEQ ID NO: 609683 - DNA, 1225 bp, Homo sapiens
gcccagacttcaggagatgttctgtctggcgtctcagttgacatgatcctggtgtgcgtcctttgtctgtcagcgtcactctatcgccttggcgagccgacgatcacagcctcatttttatcacattcatgctagtatctagttgggagcagaccagtcagtatagaagaaccagtatctgaagataggctagggagagcgcatggttgtactgtgctaatattgggctgctcagaagtggcaggaagagcgtctggagcccagacttcatactcatgcatgggtaagcttacccttagtaggtcacttatgggggactcttgcgggtataacgatcgatgcgtaaaccaagggaggtccagttcagctgcgatgtgtgtcaaccgcacaccactaaaatagaacatgtccatgtttgatgacgttcagaagagcccttgactttgggtcagccaaatccatatccttgattggccggccatgttcaagctaggaagtccctgttgtgcccacaaggatagtagttgttggagtacagtggagttcaaggatcccctatgcagtcagatgcggcaactgtttaagtgtcacgggttatcgaaaggacaccggaagtacgtgcacaaaaccagtggctagcaccctagctagtaatcaatctcccttggaccgtgtataggaacatgtagggccaccaaacgtacacttgtctcgactcaccttggaagaaagacgtttgtcggcatgcaagaccatggcgacatagttagtcctacttcaaaggcacgttcgcagtactccgttaacacatagttaagagccaggggggaagagcgccccaccttcccgccaatcttggaagcttgaagaaattcccacaaggtttgccgtacaaagggcgttcgccatacagacacttgtccactgggcgtgggctcaagaggacaaccctcttaaccattgcgtggtgccccttgtgagtcttacattatggaaggctacaaattttgtgactctcttggagtaacgactgggagcatctggatcaagagacgcgtaccccccgagggacttggggacccgtaaggcctcggataagggcacacacagggataactggacagcggaaatccttacaggctttgaccggctttgggggcaccacacaattaaggatccctgggacccctaggggagtaggcattgttggtccccccatttggtg

SEQ ID NO: 609684 - DNA, 374 bp, Homo sapiens
catatagtcactccaggtttatggagggttcttctactattagcgaacttttcgcttcgtagcgacggcttctcaaatcatgaatattattaatattactgctgttcgagaaatgaatgagcctacaagataataggatgtttcatgtggctgtcatgcatcgcggatataccgagtaacgtcgaggcattacaggataagccgagaaagtgttgtagggaagaaagtcagatttacgccgatgaatatgatagtagaaatggattaagacgtaagtatgagctcaggtgtaccctgagaatcggggacatcagtgaatgaagactcctctgatggcaaatacagcacctcttgataggacatagtggacataa

SEQ ID NO: 609685 - DNA, 102 bp, Homo sapiens
gggagactagtttaggaggaaacaggagtcggaagcaggaaaagcagttaggacaggctgcttctctagggccactgcgagagtccccctatggtacaatcc

SEQ ID NO: 609686 - DNA, 361 bp, Homo sapiens
cggtccccggcccgccaggccccggaagacgccgcggcgatctgcgagggcggatgccaggggcgggcggggtacggaagcccgaccacggcgcccgtccagcggcctcctgaacacgccaggtgtgagcgggcggtcttggtgccctatgccgtgcaggcctggacgaggatcactccgagctcagtctaggctctctggagcacctacgatggctcacgagcctatgatgagtctctgctgcatgcccgagcactagcgcctttctacaagggctctctgctcaccggcgttgtccgcagtttgtgactggtatgggtacatacagctgaggcccacttgtctgctacttgcttgcctg

SEQ ID NO: 609687 - DNA, 493 bp, Homo sapiens
ggcatccgcgtcaggaactgccatctcggcaggaatgcaaaatgcagcgtccctatgcttgtaggtgtgcaggtcatggtgggcttcacgagtaggaaagggtaagtgcggcccagtgtgcagggagaggaggaaggggtagctgagtccaggaagggggtggagcgtggacatggataatcgggcttcctactggaccatggtatatgatgagtgacccagtgcctccatccctccttctgcctccaccagttcctgtaacccgagatccggacgtgccagttctgcctcggtagaagacccttctgtaggattgcatttcaggctcagagaagtgtaccatcagcagctcatccctgtgcaatggagatcccatctatttatgatgtccaggttcgcctcatcgtacgaggctgtggacagtacataacctaacggtgcaagaaaaacgcaaaactactttgcagagtactggtatcaggcccagtgctgc

SEQ ID NO: 609688 - DNA, 297 bp, Homo sapiens
tgtaccccgctggccacatggcagctgtgtcacgctacctgtacccctcttctgcagacgcatcggggtgaggatctcctcgaacttggggtgcttgtcaaggtgcgccagttcaatgcatgcttccaggcagcccagtgcccagtttgattgggcagttgagcacttagcccagttgctgtttccacatgaagggttggccagctttcttaaagatctcctcaatcttcggcagccctacgcagaaggggggaaaaacctccttcagtgtggccccctcttctccagggagatgac

SEQ ID NO: 609689 - DNA, 364 bp, Homo sapiens
gccacgtcacctgtggtcctgaccccagtcttacaacttctccttccctcaggagcttctacattccacccaacacacactgctgcagcagatccagaccctggtcaatgagtgagatgggtgccgggcgcagtggctcatgcctgtaatcccagcattttgggaggctgaggtgggaggatcgcttgcaacccaggaggtgcgacaatcgcttgaaacccaggaggcgggagttgcagtgagccgagaacatgccactatactccagcctgactggcagagcaaaactccatttcaaaaaaacaacacaacaacgacacaaaactgtggcccttgatgttcaagtcgaccattccagcctctg

SEQ ID NO: 609690 - DNA, 428 bp, Homo sapiens
  misc_feature (50)..(50): n is a, c, g, or t
  misc_feature (72)..(72): n is a, c, g, or t
  misc_feature (332)..(332): n is a, c, g, or t
  misc_feature (370)..(370): n is a, c, g, or t
  misc_feature (378)..(378): n is a, c, g, or t
  misc_feature (415)..(415): n is a, c, g, or t
aggcccagaagcctagtgggtaagaatggttttgggggccaagcctgggncctgctgctctctgtagccttnggacactgctacctgcatctggctgatccagctccacccatggctcaaagtgccccagatacagttcaggccactgccttggaggacacaagctataagacttggtggcttccccatggtgttatgtctgcaggagaacagaatgcaagagtgaaaaaggcttgacagcttccacctaggtttcagagggtgtatgtgttgaaaagcctgagtgcccaggggaaaagcctgccacaagggtcgagctcctacagagagantctactagaacagtgctcatgggaaaatgtgggggttnggagcccntgcacagagttcatcatgggtactgcttgagttgggnttgtgggggaagg

SEQ ID NO: 609691 - DNA, 198 bp, Homo sapiens
gactctagacggatcccagacccagcttatgggcttactccaggtgacgacactgctggggaccatgtgtgcgacggttaccggtctaccaggacaggggacgacagggtgtcaggggacccagccccacaacctaggagaggattcggagggtccagcccttggggcagggaccagccctgaggcttaaatgaactt

SEQ ID NO: 609692 - DNA, 671 bp, Homo sapiens
  misc_feature (1)..(1): n is a, c, g, or t
  misc_feature (123)..(123): n is a, c, g, or t
  misc_feature (171)..(171): n is a, c, g, or t
  misc_feature (190)..(190): n is a, c, g, or t
  misc_feature (197)..(197): n is a, c, g, or t
  misc_feature (273)..(274): n is a, c, g, or t
  misc_feature (280)..(280): n is a, c, g, or t
  misc_feature (341)..(341): n is a, c, g, or t
  misc_feature (447)..(447): n is a, c, g, or t
  misc_feature (515)..(515): n is a, c, g, or t
  misc_feature (517)..(517): n is a, c, g, or t
  misc_feature (544)..(544): n is a, c, g, or t
  misc_feature (550)..(550): n is a, c, g, or t
  misc_feature (554)..(554): n is a, c, g, or t
  misc_feature (629)..(629): n is a, c, g, or t
naactggtaacttacacactttataatagaacaacaaaaataatgttcaatatatacagccttcgcatggactatctgactatacacaggcagagtgataacacaatctaatcttcatcatantctgtgcacaaaaagacaccaaacagacaacagtgctgcacaatacanggtgaaaatgacaacacanggtccangtgaaaacttcagcataatacaaaattggactgctctattgcaaatgacatctttctaaagtgcccacgcctcctnncctcangtggtatttacccagagtctgaagcagagattggttgtgtggctataagtctcttggagtnagacaaccatctgcagataagtttgctatcccctgcttcaaattacaatgttctctgggtcaagaaactttgtaagccactgtctttcatttcaacaactccagtnttgaaactattctgagttttgccactcagttctttttgatgccagttctccgatttgagagaccaatncnttgaagtgtaggtacattgcacgtganaaaggngtanaaaaagaatgacccttaacttggggactatgcttttcgagttgcgaaatgtcttttagatgtcatgtcaataggntgaggaaagtttttgcgtggcctcaaattcattatcaaaggg

SEQ ID NO: 609693 - DNA, 654 bp, Homo sapiens
tataaaccccggttctggggtgggtgtgggttttatactaagttgaaatgatatcatttacgggggaaaggcgcttggtgtgaaagttaggccttattctctcttgggtcctttctcgtacgaggggaggaaattgtgaagtagaatagaaacacgcgaccgtggaattacctccggctctgaacctcagaatcacgttaggaactttaatcgttgtgaacaaagcgaaaccttataatagcggggtgtgcaccattcgggaattgttccgtgattccaaacatcgaggtcgataaaccctattgtggtggatagtggactctaaaactaggatttgcggctgtttctcccataggggataacttgggtaccgatgaggaccaaagtttagtggggactcaatgtgagatattagatagatacgcattgtgacgtgggtaaaagatcatatagacagtgataccggacactcgcgcagactagaggaagatatacgagagactacccgaagagatacagacccaaaacagcgacaaaaataaagacaaatggccaagggataacgggccacagaaaaaagggcacacatgagagggatacgggaacaaggataaacagtggtaagggcaataaaaaaaacaataaaaagaacac

SEQ ID NO: 609694 - DNA, 524 bp, Homo sapiens
tgacacgccgagcacccacactgcacacgccgaatcgccacactgttttccacaatggttgaagtcagtctgcatatattgaaattgatgtctttagaataatgaattttctaatttatgaatactgtatatcccttcattaatttagcttacctgtactttctcttaatatcattgtgtagttttcagtgtaaagatggcatccttcattagatttatttctaggaagtagacttttaaattatactttggtatcttttaaaatttttgctttccaattgttgctaacataaaaatataatggatttttatatgctgacttagtatacagcatccttgacaaacttccttgttattcctgttagtgtgtctgacttaagcatgttaactgtgaatagtgaccgttttctttatgcctttccaattcttacgcttttcatttatttatttttgccttaaggtactggataggacctctagtacatgttgaatggaagtggtagtagtggtcttcttgcctcatt

SEQ ID NO: 609695 - DNA, 255 bp, Homo sapiens
gggggttgcccggggtaattcccttttttttaagacccgccccgggggggggggtttgggcccccgcaataccgggcccgccccccttcccgtgggggatgccaaattaagcctgggtttagttggaaggggggctttcccccctccccttccttaattttggggttgtgccctttggggtttttttacccccttgttttgggccccttttaaatttccggggggcttttaaattaaattctttttttgggccca

SEQ ID NO: 609696 - DNA, 348 bp, Homo sapiens
tcaaagtatgggagtttcaccacacagtttctgggacacaaaactaacgggaattctactagttgtgatcagtccttaggctctcctggacagactatctctcacagtgtcctattctcatgttgaggaccttgaagtccccttgttttaaaattttattccgaaaagttatgtgtgtaggagaaccagcttaatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaaga

SEQ ID NO: 609697 - DNA, 197 bp, Homo sapiens
tggaattcaccatgtgtccaggatggtcttaactcctaaactcaagtgattgtcccacctcagcctcccacagtgctaggattacaggtgtaagccacagcacccggcccagaatattttaaaataaacttgaagtgggcatttacagtgtttcttggagatataattttactcacagatgttgttattcatgagga

SEQ ID NO: 609698 - DNA, 790 bp, Homo sapiens
cgcagggccggcaccagctgcagagactgcagtctggctgccagtgatctcgcttccactcctcctttctgcagtctgatagttagaaaggcagcgaggaaggaatattcaaacatagacacacccgctgtagtttcctgcttctccgttttcactgagtgttcctgtggtcgtctgcggcctcctttctgtcccccgtgccagtagggctctcacgagatggccggcccatggtctcgagtggtgcgacccagctgttgttcatgagcatcttcagtcctcgtgattgtggtcatctggctgatgttatacgctcttctctgggaggctggcgaacctcactgaccgtgcccaaactgagaatcggcttctataacttctgcctgtggcaatgagcgacagccagtcaccctacagtgtcaccagcttccctgatgctggaagccctgggggtgcctcgggttggcctggtggcctggaccaggcttggctgtgtacgggtccctggtcctcacgcctctttgccccgccagcctctcctcctagcccatctgcaagcatgtgatgagcagagcgtggcggtctggcagtagtggcttcctggctgtgtcctctgtgcgtgctggcaggcggcctgggcctcttcctctcctatgtgtggaagtgggtcacgctctccctcccggggcctgggttgctagctctgggcagcgcccaggcttactcatcctcttgcttatagccatgctgtgtcccctctgaagggctggagggtgagagcaacttgaga

SEQ ID NO: 609699 - DNA, 311 bp, Homo sapiens
ggatttttttacaagatactgaggtaacggggtggtgctccaggaatcattggctcagcctgaagtgaccatcctctacctgagtcgggggacttagatccaggggaactcagagatattgttatgtgtatttcttgaggagaaaccaagaccccatcccaaggctgcaccattgtttcttgactcttcctcctttgtttctgcattccccacctactctgattagcaaatgtttgaatctgccctctggaactcagggaaggtcaaagaggctgaatgaagcccatttcctacaaaccagaaaatagagg

SEQ ID NO: 609700 - DNA, 378 bp, Homo sapiens
ggcggcgctcggcctcgcggctggcgtgccgggcttggcagcggccagcagttggcggcgagctgcgtctgcgcctgcgcggcgggcccgtgcccctcctccccccctgggcgcccccggcggcgtgtgaatggcggcctccagcggtgaggtgcgatgccctctgcgcatgctattgcgggccgtcgtgcccgcctctgtgcagccctgcggcccaggcgcgagtggctcctgctcggcgtgtgaataatgctgcttccgaccgcccgcttctggctcgcagccgtcgtgccctctgcctccacgcctgctggctgtcttcgccccgcggtggaggcggtgcccgattgctgcctgtgagctcgcatgtgatacttg

SEQ ID NO: 609701 - DNA, 664 bp, Homo sapiens
ggaaacagtggttgcctggtctaggactggatgtgccgggtgtggaggtggacaaacaatttaagtgggccatcgggatctggagggggccctcagaattatggaaatggccctggtagcttaggcggtcccccggggttgcaagtggccctcctggtcttgcgaagtgcccctgggcatttgggtgggccaccagcttttgggcctggcccggcccggcccggcctggccaatccatattggtggtccccctggctttgcatctagttctggaaaaccaggaccgacagtaattaaagtgcaaaacatgccctttactggtgtctatgatgagattttagattcttttatggctatcaagtacatcccaggctcagtgtgtccacaatacacgtgccaacaggtatgcccaacaggtgaagccatggtggccttttgagtctcggggatgaagccacagctgctgtcattgacttaggatgacaggcctataggttccacagaaaggtaaaaccttgtatcagggtagcattcacatcatttttataggggtagatcgtgcatattgctgtggcttactggatccagactggtacctagtatttcaggttagaactgtggtttgtttcattgatatggttgcttgcataacgtacatcttggg

SEQ ID NO: 609702 - DNA, 412 bp, Homo sapiens
  misc_feature (277)..(277): n is a, c, g, or t
agctagcaccatgagcttcaataccctgcccccatctgactggaccagtgatgggcacctggagcaaaggcagccagcccaacagggacttatgttgggaatctgaatgagaaatatggaagttccaaagaactggcaataggagtagaagcctaaagcttgcaagatagtaagaggcgtaaagaaccatgatgggccaaagttccaagggcgcaatagctataagaccaggaagccaactgcactgttggtgcaacaccctcaggactttgtgtgngtgtgtgtgtgtcctttttctctccagcttcatcactgatagaagatttcaccagcactcccccaggattgcctattttccagccatcttgttaaaaagttgttccttgtgttaaactaaatttgtctttgaata

SEQ ID NO: 609703 - DNA, 421 bp, Homo sapiens
  misc_feature (104)..(104): n is a, c, g, or t
  misc_feature (187)..(187): n is a, c, g, or t
  misc_feature (196)..(196): n is a, c, g, or t
gtatgcaacggaccatgcaagtacattgcagcgagaatgaccagcgtcaagaatggagctgctgttcacggaggcatgttggatttcggaatgctgaaatcccntcggaggaagagaacaggagcctgaaggctgacctgcagaagctaaaggacgagctggccagcactaagcaaaaactagaganagctgaaanccaggttctggccatgcggaagcagtctgagggcctcaccaaggagtacgaccgcttgctggaggagcacgcaaagctgcaggctgcagtagatggtcccatggacaagaaggaagagtaagggcctccttcctcccctgcctgcagctggcttccacctggcacgtgcctgctgcttcctgagagcccggcctctccctccagtacttctgtttgtgcccttct

SEQ ID NO: 609704 - DNA, 434 bp, Homo sapiens
  misc_feature (299)..(299): n is a, c, g, or t
catcagctcggacctcttattctcttcaggggataggggtccctggtggaaccccatctgactggaccagtgatgggcacctggagcaaaggcagccagcccaacagggacttatgttgggaatctgaatgagaaatatggaagttccaaagaactggcaataggagtagaagcctaaagcttgcaagatagtaagaggcgtaaagaaccatgatgggccaaagttccaagggcgcaatagctataagaccaggaagccaactgcactgttggtgcaacaccctcaggactttgtgtgngtgtgtgtgtgtcctttttctctccagcttcatcactgatagaagatttcaccagcactcccccaggattgcctattttccagccatcttgttaaaaagttgttccttgtgttaaactaaatttgtctttgaata

SEQ ID NO: 609705 - DNA, 878 bp, Homo sapiens
tggtgacgtagccgggcgctgggaccctcagggtcccacgggtattggtggtttctctcagggagccctcggcatcgttcattagttcgcctccaacaggtgggcccggaatgataaccgtgtggaaacgaagtaaagcccaacgggtcgactgttagtcaacgctggatcgtctccgtcccaccgggaatcacatcaggagcgacatgaagggtccaacgtccatcagttcactgaggccctgtcaggccctccctccggaacgtcaccaacggttggccgtgtgagtaagaccgattaccctgcattcatcggggtaggagcccccaagcctctgaccccctacaggactctggcaccccgtacgcccaaggagataacctcggagcgacggctgctgaaagagactgtccacctgccggaaccaccggagcccggaggcttgggcggctccgccctgggctggcattcacgtctcctccagtggagcgagaagttggggccccatgactggggtagagctggggacgccacgtgccattcccatgggccagtgagggacctggggcactctgttctagctgtaggcctgagctcctccagagtcctcgaggagggagcgccagttcgccacctcgctcacagacctacacagcccaagccctgctctgggaccagcccatgagggcccttcagaccccagctgtctgcgcgtctgactctttgtggctctcagcaggacaggccccgggcactgcctcacagccaaggctggaactgggttggctgcagtgtggtgtttagtggataccacatcgtgaagtgattttctaaattggatttgaattcggctcataactctattggtcatgaaacac

SEQ ID NO: 609706 - DNA, 597 bp, Homo sapiens
aaggaaaagcagtatgtgtcgtttctatgaaatgaagccagaccgagatgtcaatctcacccaccaactaaatcccaaagtcaaaagcttcagccagtttatctcagagaaccagggagccttcaagggcatgtagaaaatcagctgttcagataggcctctgcaccacacagcctctttcctctctgatccttttcctctttacggcacaacattcatgttgacagaacatgctggaatgcaattgtttgcaacaccgaagaatttcctgcggtcgcctcttcagtaggaagcactgcattggtgataggacacggtaatttgattcacatttaacttgctagttagtgataagggtggtacactgtttggtaaaatgagaagcctcggaacttggagcttctctcctaccactaatgggagggcagattatactgggatttctcctgggtgagtaatttcaagccctaatgctgaaattcccctaggcagctccagttttctcaactgcattgcaaaattcccagtgaacttttaagtacttttaacttaaaaaaatgacatctttgtagagaatttcgtggaaacatgggaaac

SEQ ID NO: 609707 - DNA, 964 bp, Homo sapiens
gtacacagctaatagagcacacccgtctatgctctcaatcatattgggaatattcatacggtagaggcagactaatacctaccgtagcctggtgatagctggattggttccaaagcataagacatcttagctcttccaacttctaagattcttgtccctaccacgtaatccctctaaacactccccttgttacacactttaccttgtttacgattcccacaacgtaggtaacacgacctcctttgagcacaccttagggactcacctccttgttgcatgagtagtccacatacatttatgcacccatagttaagcctacatcccgtcaggcaccaattatgatatcgttcaacgtcttcaaaactcacgacttatccataagataaatcccacacatcatatacagcgtgatcctccccataacccaacttggacgcacatcttttcaacctattaaaagaacgtaatctgttagatataaatgtcacatgtaacatcatattacatccttccgcgagttaagtccgtgctatctaggagttatcaacactcgaatctgaaaacttaatgagcccaatatctacaatcacacctaccatggtcattattacccatcagtggttaatccatacacaaggctctgctctgtcatggaacggttcaagaacctagtaatccggtacactcggctaacatcttaccccgagcctgtttaccccctagatattactcgtagaccattacactagtaatatagcaggcgaccgctcttgcccaagttggacgacatgtcttcaatcggggtccgcgcgataggccattatacccgtgctccatggtctgcttcttgccctttgttccttcaatttaggggacctggtatgcaatggctgccctcgaagggttccaccgctgaactgctaaataaaaaccagtgcacaattgacctggccgtgaagaagcg

SEQ ID NO: 609708 - DNA, 664 bp, Homo sapiens
agcggtccttccgtcggtgtcgcgcggtcgcctcatggaagccccgggagggcggcggaggggtggcctgcagtgcgggggcccggaggggcagtcggcgcccgaagccaggttgcacttccgagtggcgaggttcgagtcatggaggcagggtgtcaatgcatagggatgcaggtccattcccattgccactgcttgcaccatttaccatagagttcttttgcgagaccaagctggacgcctatgatccttacctgattgccatgtcttcaatttacttggtcggcaaagtggaaagagctaggcaccatgcggatcgtacgtgacatcgatcgaatgtgtaccaatcaggtactttaacgccagagaggtgagcccctggaattggactcccgcgttctgggaactccgggacagcatcgtgcagtgtgagcgttctcatgctgagagttctgcgcttccaggtctccttccagtattgcacagcaagtagcctgctaccagtacctggtgtccctccagaagctgggctgaaccgccagcagctggcagacggacctccatgttgccgtcaccgtctgggccctgctgcgggacagttaccatggggcgctgtgcctccgacttccaggcccagtacattgccgtggacggtagctctacc

SEQ ID NO: 609709 - DNA, 635 bp, Homo sapiens
ggaaggcaggggcttgaggtctgcagggcgagaactgatgacatggggcaagcggacagaagccacactgggcaaatccaggccaaggcagctggacaagtggacagcgggcaccgagtaggggagacaagccctaagcctcccgtgggcctagaagcatgtggacagccgggagcagcaggagcagggaggcagggccaggagatgcctctccaggcagagatgggagcgcccaggagggtcacaggtgaggcaggcacagccaggtgagatgcgctgctgttctccggatgccctccgtggagccagtctgcttggacccccatgctctgccctcttctgggacgctggagccctggaaggtctggttctgaacattagaattcaggagaagtaaccgggaatctctcgggaggtgtatatctctaagagtcgtggcagcatctactcgggagctgtctgggaaagctgctccttgccactcctccttgggacacagcaccatgctgtgagaagcccaagccccgtcgggggcccctgtcaggaaaccaggcagccctaggacgtgccaccccaacaggactgcaggtcacgcggcccacggatgttggaccacaattaaaaccaatcaagag

SEQ ID NO: 609710 - DNA, 310 bp, Homo sapiens
gcccacctgctcgtagtgagcaccggaggggcggcaaggtcgtgctcttcctcctctcgaccgagcactccagagagctggagctgggcattcccggttgggtggtgaccctggctgtgtggcctgcacgtgatgcaccatgtatgtcacacagatgctgtgccaagctcctgcgaacttgtactagagtgagtgagatcagacggatgcttccaggcctgcacacggggcagcatgagcagcacgtgaccagccgtggccctcagccctttgcaggctgctgcagtgaggcagggaacacactggactc

SEQ ID NO: 609711 - DNA, 394 bp, Homo sapiens
aggtatgttcagaaagagggagaactagcagtcttggtgtcacctggggtcacgaggccgggaaggaggcagtgcagtttggcctaggtagttcaccatacccttgaacaggcctgggaaggaagcagacaaagcgtgccaaggtgttccacactggggtccaccaggctgggaaggaagcagagaaacttggccaaggggtcaaccatgctgctgaccaggctggaaaggaagtggagaagcttggccaaggtgcccaccatgctgctggccaggccgggaaggagctgcagaatgctcataatggggtcaaccaagccagcaaggaggccaaccagctgctgaatggcaaccatcaaagcggatcttccagccatcaaggaggggccacaac

SEQ ID NO: 609712 - DNA, 125 bp, Homo sapiens
tcctcaaagactttgagcatcaccacacctgaccaatttgtttatattattttttttggtagagacaggttctctctgtgttgcccaggctggtctcaaattgccgggctctagagactgtccag

SEQ ID NO: 609713 - DNA, 182 bp, Homo sapiens
gggtcgatgagcagatgcttaacgtgcagaacaagaacagcagctactttgtggaatggatcccaacaatgtcaagacagccgtctgtgacaatccacctcgtgccctaagatgcagtcacctcattgcaatagcacagccatcaagagctttcaagcgcatctggagcagttcactccaat

SEQ ID NO: 609714 - DNA, 499 bp, Homo sapiens
tgagacggagtctcgccctgtcacccaggctggggggcaggggcgcaatttgggttcactgaaacctccacctgggggttaaaacaattttccggcctaagcctcccgggcagttgggattacaggccccccccataatgcccagctaattttttttttttagtagaaacggggttttcccctgttgccagctgggttccaacccctggcctcagggaaatttgcccacctaaccttccaaagggggggggttaacagggggggcgcccccccccgggcgagtttttttttttttttttttttggaaaaagatttattttttcccccagcctggggggcaggggcaaaacttgggttacgggaagcctttgccccccaggttaaaactattttttggctaagcctccggggtagctgggacttcgaggcccccccccacccccccggatattttttttttttttttttaaaaaaaaaatttcttttttgcccaaatgag

SEQ ID NO: 609715 - DNA, 697 bp, Homo sapiens
  misc_feature (490)..(490): n is a, c, g, or t
aaacctccactcctaaactcggtgtgtgtgtccgtgtcctaaattttcctgtcgcgtgacaatgaaccccagggtatataccccagacaacgtagtcacttcataatggggacctcatccgagataccaaggtgcaacattcaccgaaacgatgaatagatgaggggactccaactctgtcctttcatttcgaggctcttggcttccattttagaaccaaatcaaaccaaatactgggcccccttcagccatttaaaaacgattagtgtggctgccagccttcatgggttgctgggcatattggccatgtttgaaccagcttcctttcacggaagacttagccatcaggtggggctggaagaagtcctgaggcagctgaggatttctgaccagggctagctcccagtgttatccaaaggcttctggactggccccagcctccaattgcctcgatggggtgtcggcaacaggatctccaactttccttttngtaattcctcctttcctgtctgcgaccgccatatctcttatcctctctgtatacaatgtgtgggaagctttacagttcagggaagtaatcttgtttggcagaccaggaatgtcatagtccatgtaaaccgtatacctgatcaaacaatctgggagcccatgtaatcagacaccctcctaaacctggctataaatctgcacatgggcc

SEQ ID NO: 609716 - DNA, 313 bp, Homo sapiens
cctgggttaccatatctttgatcatcctcagtatcagatcaggttcttcagcctccaccattccctagctgaggtctgatcaacctggctatcctcagtgagaatgtttaggttggcttagccaaatcctccttacccctaatgtttcctcttagtaattttccatccactgacccccacctgcctatgctgtattcagagctgagcccatctctctccccagtgcagaatctcactgcagtggtctggtccctacatctttaatccatgtctgagttaatgtctgtactaggtgtcagataggcgttcccca

SEQ ID NO: 609717 - DNA, 531 bp, Homo sapiens
tttttggagggttttcggttttaaaaaaaagggggaacaatattaataaggggggaagggggaaaattaaattcaccccattttctcttggctttttgagaagggggcattttgaagaagattgaaaccgaactggttaacccacccttgatttccggggaaaatccctttgggcgttgaataaaaaaccttttaaaagggggtggacaataggggggtaatattccaacaaaggaggctgaaaccttattggtgaaatgatctttacaataggatcgcgctgtattccctaggaaaattggtcggaggctcaagtaatagaaccaatggagtatatgcatccgtttaactgggaaaaattaacacaaacgtttagagagagggatctgcttgcagtatcacacaacgatattctaaaggcaaggttcataatctcggacactccgaaacattagaaaagatatttcatctaataaaggcacatacggttatatccgcccttctggcgaaaacaaagattatataaccacc

SEQ ID NO: 609718 - DNA, 1091 bp, Homo sapiens
tactcccccagcggagagcatggggggtgccctgtgttggtgacttacgactctgggacaagtaagtcaatgtgagacgagttcagtcgtctgggtttttgccccttttctgttcatgttcatctggctcacgagcatctggtcatggaccgccagcaaccatccgagacgtcgtccgagttgtgaactggcagcagcagatccgtcaacaatcatggggcatccgatgcaccatcatgaaccggcacctcgttacacatcgacccaagcatgacgaagaagcacgaaaaaatacgaacagaaagacgggagcaacacaggtgaagccgcagacgcacagcactacgcgcacccaacaagagagcaacccagcacaagcgacagcaaccacacaacaccacaaccaagcagccccgcgcaccggagacacgcgacacacacagcgcaccgagcacagacacacgcacacacacagacgcgcaggccacacacacacagcaccacacagacacatcaacagaagatagacactcggcagcgcagctcagccacatcagcacgcacgacaccacacacgaatcaatcaagcgcatccagccgcgcaccaacaaaccagacagacccaacactccccgcagcacaaccgcctccgcgacacacgacaacacaacccccagaacacgagaacacaaacgcacacgacagccggaccacaacaaaccaagacaccacacggagacgaagcacgaagcaaaccgacgcgagagagcacgacagaagaacaaagccacaaaacgaaagagagcgagagcgacaagacaagagcagaaaaagacaagaacaagaacagcgaggcaagacgaaaacacagagcggatcgatacgagagcacaaatgagagcagacagagaaaacagaagcgaggagaacaaagacaagagaagcccgcgacaggaagaacaagtagacaacagaaaacaacaaacagtccaaccgaccgaccaacccacagcggcgccaaggacgagacagagcagacacgcaacgcccgaagccccgcccacggacgcaaagagtcgaatagagtaaaa

SEQ ID NO: 609719 - DNA, 823 bp, Homo sapiens
gataaaggggagcgcagagggttgcggtgggactaggagcgcggcggggccggcggcagagctgtccggactgcgtcgtgtggcccggggggcccgggcggtggataagcagcgcgtgcctcgagtctatgcgattcggtgtgctgccggtggcggttctgcctggagaggttcgattgagtgataagagacttcagagagtttatggcataagagatgaggttaacttctaaagtatggaaggcagatatgaagtcatattgtacaagcgtttggagggcaaagtactcagatcttaaactctaatgatgtaactgggcctaagagagtctgatagaaaaactaaagtagcaacagcaggagtctgcagagctaggtaaaacatcctttgttaatgcggactatgctaacgcgacatggaatcgaggatgaatgctgagaggtgtaggctagctcaatagtccaggtacctcagagcgaatgtccatgctagcccgagctgttgcccaactgaagaatcaacaattggtagaccccagcgatcaacttgtttttcctaaaatatgacaacggtgaactggaaacagatctaaagacaaactggatacaagcccaaaatgaactgagtgcctggaagtttacgcctgataggtaaacaaatcatactccccagtcaagacttcccctgacagtcccactacgagaaagctgtggtgggacagccaagtactcgtttccacaccaagactcaagactttttggggcaaaaaaaagccaccatttcttacactgtccagctgtaatggttaatgtaaaacttacg

SEQ ID NO: 609720 - DNA, 416 bp, Homo sapiens
tttagtatctccattaattattctccaaaattcaggtcctctcataggaacttttatatccatgacaactgtgtaggctggattgctccaattactccaatatcccagtccatctagcctcttacagcgcacctgaacagcatagactgcacacaagtctggaactgggagactgacagattttgattttgcatcataaacctcatacatcttccattgtacttcttttccacttaaaccatagcgaatctggaattgaaggttattctctgggaaagactgggcttttcccaaggatattttcaataatccaatgtttatagtaatttctggctttcacactgggatgggagggcagtggcttcaccacaggaatccgggaagggacacatgttgggtgggagagtccaagtgtt

SEQ ID NO: 609721 - DNA, 783 bp, Homo sapiens
gacgccggtgcacgcgggggggcccgggggccctggtggtccctgggtatgtgttgaaccgctggtggtcttccgcggaggtttcggcacgtggcatccggggccgctggtcgcggccgtgtgacggggccgcgtggcctgagtgccgcggatgctcgcggagcgcaaggcctggagcgataatggagtggatgccccgtcaccgaagttgtggccgcttggtccaaggacatgaagatctaagtccctggagtggtgatctatctcttctccctgcccattcaatggatatcatagcatcattgatttcttcctgggggcctcatgtcaaggattgaggttttgaagattatagccagtcgtcaagtaagctagacccgtagccaggtccagctggctacctacggttgcaatggccatttgttagctattcggcggcactacaatggcacagcagtcaggtactgggtgttgaagtgctccaaggaggtggccaccgtcatccgtgggggccatcatcctggccaagctctccatcgtccccgtgcgcatgaggctactgggggaacagagatcgtgcaatgcgcccacatctgtcccttgcgaggtgactaggccgcgtgcggctctgtgctggtacgcctcatccctgtcaccaggtgcactggcatcgtctccgcactgtgtctaagaagctgctcatgatggctggttcgatgactgctacactcaacccgggcttgactgcacctggacttgcaaggacttggtgcctttagactg

SEQ ID NO: 609722 - DNA, 584 bp, Homo sapiens
acgccggacctttgctatgggggtgccaccggacgcccatcaatccggagaacagggccccacttttaaatgtcctcccaccctgttttggcggattattcaaaatagcaccgcgccataggaccaaaaattttgaatacccctccactcgggtgggagtcaaacacgcacttgctaaggttggtaaacagtggtaagtattcgaacagcctgacattcttgttgtgacgatgccacccctcggtttgagggctctaagttctgtgtatgcaaaaaaacccttctgtgtgttattatattcgaggcttgcatgctcccaaggtatcgcaaagctagacggtcccctccgaggacaccacatagggttcaggtagtagatctcacgcggccagatgtttcaaggtgggatgtttgaaagctaagtccgtggggcgaaatgtccatcgatgtcctcccccttgatagagattcccacgggaactgaaagtaatcattggcgccacttacaaagaaaataaaaaaaagctttccgagcgtgtgtcttagggggacataaaaaaaggaccattttgccaacaaaatca

SEQ ID NO: 609723 - DNA, 292 bp, Homo sapiens
  misc_feature (170)..(170): n is a, c, g, or t
ctggtatagggagggcgcctctggaatgagggtcccctgacctgcttcagggtaaggtcagagagtccttccgaggttttatggcctatgctaaagaagaaccatgagggtaaggtgaaagtgaccttcttacttaaattgttttctcaaatgccacagttccatatttnggtggaatgttttctgaaccccatcagggcgcaatgagagaacaatctggggggacaagacaaggagatatcagatgggggaggtttgtggttgactacatcactcttggaggcattcgccg

SEQ ID NO: 609724 - DNA, 656 bp, Homo sapiens
ggagaactactcagtgaggctgaggcaggaaaatcacttgaacccaggaggtggaggttgcagtgaactgagaccgtgccactgcactccagcctgggtggcagagcgagactctgtctcaaaaaaaaaaaaagaaagttgtgaatttgatgtaagcttaggaaattgaattaaaatttataggcatctgtattaattgtacaatttgacacgggattttcttttatccttagtttctttcacgggactctagaaactttttatcagaattatactggtaaaacattggggggagggatcctgagtaggtgatgggtcagaaagatgccttcagtttggtcagtgtctaaaagttaagtctgtttaggccaagcatggtggctcacgccttgaaatcccagcacttgtgggaggccgaggcacgtggattcacaaggtcaggagatgagaccatcttagccaacatggtgaaaccccgtctctactaaaatacaaaaaatttagccaggcgtggtggtgcgtgcctataatcccagctacttgggaggctgaggcagggcgaatcgcttgaacccgggaggcacgaggtcacgccattgcactccagccttggcaacagagcaagaactccgtctcaaaaacaacaaaaaaaaaac

SEQ ID NO: 609725 - DNA, 525 bp, Homo sapiens
  misc_feature (421)..(421): n is a, c, g, or t
  misc_feature (448)..(449): n is a, c, g, or t
tttttttttgggcagcagaatcaggtttattggagggatttgacattgctgaatcgggacactggatagagcagctggacaggagttggtggcagtcctggaaccctggatcttaagaaatagagaaactttccattcttggagtgcataatggctctcttaataaactctacaacagattgacagcggtcctcaaacttgggatgacaccacaggctgaaggttcctctgtagtgctccattctagtgtggtgggtgataccctgtgatcggaaactgaggctcaggatgtaacgaggatcagaactgtctcgtaccaggaaagaaccatctggtttccctttcagcttcatctctgcatcttcccaattcattggcccccaataccaaccacacttctccaactctcgaaggctggctncaaagctgctcgagtcaggccgtagannggacactggagtgctgtgggggttggctgtgcagggattcagctgctcggatgggagcagctgaggaccatcgttg

SEQ ID NO: 609726 - DNA, 1733 bp, Homo sapiens
cttttattatatttatttattgtttattattaaataaaacccaagagagcattattgttgtggtacaattgttgtgtgttcttatacgctctcgccaatgaaaaaacaaagactccacggaggatatgctccctctcgcttgggtgtgtgtgtatttgctcgtcgtgagtcaattgatctagagagcgatcaccgtatactgccgcagcgagtggagggtgagctcaggaaacaagacatggaaacaccacaatagtggtgcggtggagtgcgaaaatgcacacatatataatatcgtgcgtacactatgttgtctccgcgcgtgcgtcgtatgtgcgatatgtgaggcgcgcgtatacaacatatgcgtgagtgggcgcgtgctatctgtcgcccaccacactagtgtgtgtgtattactagcgcgcgtgcgcgcgtgtgtggagtgtttactcaaacaacacatatatgtctcacccacgagcgcgcgtcgtgcgtgggagccccactacacaccatgggattatacagcacaatatgtgcgcgcacacatgagtgtgagacaccgcacgtgccgggtccacaccacacacacacacgaaaagagaagttacacatcaagacagcgcgcacacacgtaggggagcacgccgcacatcgcaaaaagaaaaataactccccccggagggaggggggacgccccaccagagacgtaaaatcagcgcgcgataatcagccccccgcagggctttcctctgtagtggagaacaccacacgagtgggtgggcctcccccacataaaaaataatgagcggcgcgacctcgggaaaaattaataatataccaaggcaacgaggcagccgcacggagggacggccggcggcaggtgttataaaaaacacgcgtgggcggaagataactggtgtgaaaccaacagcggggcaatggctcagtggaggggagcaccactatgtgcgagcagcaaaggcgacacccctatgcaccactcctggggggggggtgggagacccccaacaaggtttgagaaccaacaacataccaccccaacaacgggaggaactaacaaacacgcctacaacgaggggaaaacaaataatataaaagcattccacacgcgggtgctaaaaacccggggtggttcacacccacacaccgcggccgaaaaaattcggattaggcgcgcggcatcagagcaaatatagatggaaaccaacacggggagatatacaatgcgcaagcagcatacttataacccgagacggggcacaggaacaagacaacacaacgagaccaacacagaagcgagaaaaacaaaacaaaacacgaacagcagagcacaagcacagacaggcacctacacaacgcggaggacaacgaagcgtcggacaaaacgcgccgacgggcgacacacgtagctcgacacagagaagccagcgcgtgagaaaatcacacgccggcgcgaaagcaaacaaataaacaaagcacagctcacgaaaccaacgcagacgaacaaacacaagaagcgagacaaaacaaacaatcaaaaaaaacgacaaacaacacagcagaaggaggcaggagccaaccaacaacacacagcaaccccgacgacaaagacaatccacgacatgaagcaacaacatgagcacaacatagagaaccacgaagacagagacaaagcagccatacacacgatataaacaacaacgaat

SEQ ID NO: 609727 - DNA, 507 bp, Homo sapiens
cggtcccatctaatactcaacaatagaaaacaaagaacctactttaagaacaggacagtgaccttaacggacacctcactaaagaagatataagatggcgagtatgcattgaaaaaaagtcacataatcaggaaaatgcaaattaaaacaataccactacacacctattagaatggccaaaacccattaacagtgacaatatcaaatgctggtgagaatgtgaacagaaactcccattcattactggtgggaatataaaatggtaccatcactttgaaagacagtttagaggtttcttgcaaaactaaaggtattcttaccatatgatccagcaactgtgttccttgctatttacccaaacgaactgaaaacttatgtccacacaaaagacacgcacacagatgtttgatgtttatagcagctttattcacgattgccaaaactagggagcaaccaagatgtccttcagtaagtaaatggacaaataaacccgggtatatccagatt

SEQ ID NO: 609728 - DNA, 181 bp, Homo sapiens
gtatcactaagctcgctttcttgctagtccaacttatctatatacaggttcctattgttccctacagtccaactatctaaactagggggatattatgcaagggccttgagcatctaagatatctagcctaaataaaaatcatttaatttatcattgcaaataaaacaaacacacaacaaaa

SEQ ID NO: 609729 - DNA, 827 bp, Homo sapiens
gaacggaagtcgctgtgggacgctgaggaagccaggatgggactccgagcaagaagacgtcaactccaagcccccagccttccaagagagctctcccgagagacccttcgtcggaggtcccgagcaagaggaagaattcggccccgcagttgccgctgtgtgcagtcgtccgggcctttcgtggaaggctctatcgtccgcatctcgatggagaacttcctaacatatgatattgtgaagtatctcctggaccccactgtgaaatatgatcgtgggagccaatggaaccagggaagtcgagcatgtgtgtgtgccattgtgcctgtggttaagctggaaaaaccgtgctttccatgggacgagcaagataaggtgcgggtttttggtcgaagagaggatgtctagaggcatggtggaaattggaatgggttcagggctttcttggaaaatctgggtaatcaccgggtgagattggatgtggcaaaaaaatcaagtcctttgtggttcatcaacaaaaaatctaaaaccagaaaataggggaaagagacaagtggcagccttaaatattcaaggtgggggaatcttgtggcagtttctccctcaggaccacagtgggagacttgtgtaaaactcagcaaaatggaattcctcgaagccattgaaaagtcaatggtcccccagaaatggccaaatttcactgtggactcaaaacttagggggaacgaaacagtcgagaactcatgaagagaactggttttcacgcacaggttccaggaggagtttaacaggtgtgggggcatgacaggcgctttgtttacaaacacaag

SEQ ID NO: 609730 - DNA, 780 bp, Homo sapiens
aaacactctagtcttcccctcaaatcatgcatgcaaaataggaggacagaggtggtgactcaactggatacaggtgctcaatagatcgaaggcttgatgagtgagtgtcagcgacgcattacaagcatgtaagcacgatacctgactgagccattggcaccataccttgagctaacgcttcctctgttttcctctacgtgtgacctatgtgtgaagatggcgaatagcagttcacctgtgcgtatttcgcagtcgctcacggcaagtgggacgcttaagctttgagaggtgcttgtcttgatcttagactctcgctagcgtttagcctctacgaacgtagactttcgagcaagctatagctgcactgacacatacatgtcgtagttctctaaagattcgtgttcttccagagtccccggcctgtccccaggctagagcaatacgtagcatacttgtccatcttatgtcagtctcttcgtgtagacctggtgctgctttgatgtcctcactcacctcacgatcggacatcaagtggagtgggccccgagaggatacattttaattccagtaatggtaggtagatttgtcctgctttctaaaacatctcctcatttcatattgccactccatatggattccataacgggaaaactgactgggtgtctcctcctttagggagggtaactgcaatagagtggtggccatcttctaaatctgtgaggaacagtagtcgatttcccttgaaggcgcgttacatatgtgactgtgtctcacaataac

SEQ ID NO: 609731 - DNA, 125 bp, Homo sapiens
agggtggtgtctgagaactctgtgtatctgttcagcaggggatctgtatatatctagtctattaatctaaacttagcggggtccacctagtgctgtccagctagcaaagatgtctgtcttttggg

SEQ ID NO: 609732 - DNA, 883 bp, Homo sapiens
ttcctggccggctgcgagggccgtccggcgacgtgcgctcccgcctgctgggccacctggcagcctgcctgcgccagctgggaccctcccgccgcccggctcgctgtccccggctgcccccgagaggccccaggcccgaggtctactgccgggcctgccctgcttgctgccatcgctcggcggccccctttccctctcgctctgcgtgccgccgcttgctgcctggggtctgaccctgggcggctgccccgcctgcccccatgggcggggggccggagggggcccgggggtgggggcccctgggaagggcccggtgggtttgcgctggaatggctttgttgcgccccttgagaaactgtggcaatttcgtggcgagggcgggggctgcggccccccggggatttccataagggcgtcgccgtggtgggcgccgtttttatgtcggcccggggaggaaccttgttggtaacggccaagggagcgacaaagacaaccccggtttagttttatagttataaagttttctcccccaagcggaagactcacacgccaacacacgaactccggagtacagagacataacacaagaacaccacaaacaaaccagaaagagggacggacggcagccggcgagccttaaaaagaaaggaatattcccacgccatgacgagggggcgggccgccacacaaagaagctattaacacgagacgagttagaaccctcccaggaggagtagttatactgctgtgggcaacacccaagaagggggggggcgcgcgcccccataatatataggaggcgcgagaggaccgtacagacagaagtaagtacataataaacacagagcgagcgcataatagcgccgacaagcaatgagtagcg

SEQ ID NO: 609733 - DNA, 1253 bp, Homo sapiens
cacccacgttctccttggcagccaggaagcgggcaggctccctgcacattgtctggccagcaggaaggcgccctcctccaggacgtcgaggagcatggatggccgatgtgcacctgctccgaggcattacatgtccttccaggactccagaagcttctggccggagcagattgtccactgtctccaccacggcactgcacagtgcagagggcatggtgctgtgagccccccaacaccactctaattccatgggggtgggcatctgcatgccctctatctcaatcctccacccctaatccaccccatcagcatggagcccacggtcctatacactggagacacccctgggtctcaccttgatactaatccattacaacgttctactctcgctctgtgcaatctagcaaagagatggagagtgatgtcaggccaggacatctggcgtgccggataccctcaaccctaatacatgccacatcatggactaactctctcgctcatgcgcgctaccactgaccccagggcctgcgctatcagaccacaccatcctcagggatcccccaaccctcaggaccactccgcgggcagcacaggcgatgaggaacccgcgcaaaacccctggccggaccaaggcgcagccggctccgacacccctacagcagagaacaggccactggcccggatgaccagccctggacacgaggaagcgacccaacgaccacaaacaacccaaagaaccactcaacgcacaccacaccaccaagcaaataacgaggcccaggacaacaacacgacacaaccacaaccgctggaacgcagacaaaggcagcgcaaaccaaagaacagagcgcggcacagaaggcaccgccgaaaggggcatcacagaatacaaaccacgaagcacatacgccaacccaaacaacgaacacaccgaccacgagacagcagcaaccgcatctaagcgggagcgccaatgccgggaactagcgacagagttaccaccatcaaaacatacacaccgcgacgacggcagcgcgaaacccggcgtacagcacatagagccccacacccccacacagacgccgccacagccaaccgcacccgagcaacgccggccacagagccacccgccgcgcaccgcccacaccaagaagcacaacagcaaccacagcacgccgcgacacgaccaccgcccaagcacagacaccggccaggcgagagccacccgcgccgatctatgccgcagcgcgagt

SEQ ID NO: 609734 - DNA, 619 bp, Homo sapiens
tggccatagagggaccccgcagggcagaccgacgttgcactgaggcgatctgagctgagcacaggggtaaggatatattcctggactgtgtgctgctgtcaccgagaacatttgcaaatctgctgacacattacagtgggaatatcccctggacgcatggaaggcccagtgccctgtcatttgagcagtgcaggcacgtcaccagcccatggggatgtcagtattcatgctgctctttgatataaagttcgcatcttctatatggtttgatgatgtttagtgggatcagtgatgcctgtttgttaattgcttacagaagatttgggcttaaaaataaaatcttggatcaggtaacattctctgttttaaattttattgatatttctgaattccaaggaaattacttacatatcagatggtctttgaaaccttatttttttctattatttttagtattctctgcactctgtcttatatttctgccgctttctcctgcataagtaaaacaggaagatttagttagcatttgaggatgaaaattatcaagcctatattctcaaaaacaatctgggattggagttaattttaatgtccactttgtgtccgtcttgccccttta

SEQ ID NO: 609735 - DNA, 137 bp, Homo sapiens
cgctcctcgtgtggttgccaagccaagccgctgctacttcatcaccaaattgcaatcgctccttcctggaatccttttgcctagcttcaccaccaaatcgttagcgctccttccttcttcctagacttccttcacca

SEQ ID NO: 609736 - DNA, 1159 bp, Homo sapiens
  misc_feature (285)..(285): n is a, c, g, or t
ggtcaatgggtatcgaggcagaggcctttgccacctggtggtgttcgcgctgcgtctggctgtcatccggaccaggtctcgtagaccggacggtaggtggcccggggagacaggtggacctcggagactggagcgtcccgaactgggctggagcctgaggggggtccgtgtcgcagtagagagagcgtgcagtgaggtctgcatgtggagaaggcgaggccctgaacaggctgcggaagtacccagagcatgctggtccatctggacaggttggcagagtacttncagtactgatgcatagttggctagaataccagaacctacgggtgggactggacagagtggcactagaagcaggctcaacgcaggttgattcccctcgatagatatggcgctcagggaggcaactatatcgttgggacactgtacaattgctgccacgtgagcacggctaatccagtgtgagataacaggctgtggcaggcacggggagagtgggcggtaataatgagtatcattgggggcacaggcgagccgtgacggtaaatgaacagtgcccattttccacaagcaccagaaattcttgggggaagaattagacttgagtaccttagccccaggaagcaggattgggaactgggaacgtggggttacctttgtggggaccatgggcatgatgcgacacaaaggtatactcgccttggaaacgttaataacgcggttttcagggtaacacatcgagagaggacttaagcaggccaatttccagctcgaatagggtgaacgccttggggcaaagatccacggacagacgtacaaagaaggagcaacacgggaacaaacaccgaaggcaaggtaacagtatgcgcaaggaagaagacgcaacggacaaagacaggaagatcggaacacagaagggaacagacctagtgggtaacacgaggcacccacctctgacagaaaccaacagagcaaagcaagagaaaagaagaggcggggcgcaaaaaccagaagaaggcttgcggcgcgggaagaaattcaagacagggaatacaaaacaaagaaaccagtagagatagaggcgaatgaggcagaagagtcctggcagaaagaagggaagagacaacacacggtgacaacaggcaaggaaaaacatgac

SEQ ID NO: 609737 - DNA, 329 bp, Homo sapiens
  misc_feature (88)..(88): n is a, c, g, or t
  misc_feature (176)..(176): n is a, c, g, or t
  misc_feature (201)..(201): n is a, c, g, or t
  misc_feature (217)..(217): n is a, c, g, or t
atccgccccggtccccgtccccttccctcccccctgccctaagccacctccacctctgtcctggccgcctcagggcaccctgaaaggntcatgacatgcggctgcgcttttggctcctcatttggctcctgctgggatttatcagccatcagcccacccctgttatcaatagtctngctgtctatcgtcatcgtgagactnactttggtgtaggagntcgagaccaccctgggcaacatggcaaaaccccatcttcacaaaaattgggtaatttgataattatcattattggggtttcttgagacggtacaacatttaacattctcttt

SEQ ID NO: 609738 - DNA, 115 bp, Homo sapiens
gagcatacacatagactctataaggtcttattcaacatgatatgcttgtcaatctactgctacatgagtgacgatgtattgatgtgtgacatcatctgcaggctgtgaaggtcac

SEQ ID NO: 609739 - DNA, 940 bp, Homo sapiens
aatatgatactaagcatgtaccaactcacttctaggaatactagtatatcgctcacagctcatgatcgctccctactatgcctagtagggactaatactatcgctgttcgtgatagctactctcatgaacccgtcaacatgcactcgctctgtagcacaatagggtgcgcttatagccgatgactagttcttggcgcgctgggaaagcaggtcggtgggacctagcgcctacatagttctcgaaatcatcgcaagcacatagtggcactagacatagggtacatatacctaaacgtactccaatgcttgccactaatcggcccaagaattatatgactagcactgacctgactgtgccagaagggccgcgcttaattatgaactcaagcgagagaggcagggccacgggccgtaatctatacaggcatcatgcccctcctactatttgtattaacacccaaatcaaagaacaaatcctattgaagcatgattcgacagaagcttatggcgcgcgacccccagtaacaagctcacatccttaggtacagtaggtaggatgatacgtacacattcgacaagtcatgtgaagccaaggcggccagttgaatccaggtgaaccccaagtagtcacgcaggacaataaagacgaatctggaccaccacaaataggattgagagctgcgacgagacaagcgggacggactacaagggcacactccgagtgcggggctgcagcacatcgagatcgtaagcaggaaaggtaacgccagtcaccaggcaagaacggagcagaagatgggtggccggaaacaactcgcagaacacacgcgccaacaacagagcaaggaaaagacaagagcgggacacagaactagacacaacacgcggcgcccgacacgagcaaacagcgcgcagagggaaaagccagagcaaacaggcc

SEQ ID NO: 609740 - DNA, 261 bp, Homo sapiens
  misc_feature (137)..(137): n is a, c, g, or t
  misc_feature (235)..(235): n is a, c, g, or t
actgagtatgggcaatgcactttttatgaacgttgagagcatccttaaaacctcagagagtttgacctgcaggtggacaacagaaaagcagaaagctgaagaagccatgaagagactctcctacatcaagccagaanggtttcagatgccagtgacaagacccagcaacgcacgaaagagccctggggagcgctgctgctgatgcacagagggcaaaagaactggggccggggancatgagaaaactctccagtcgagatt

SEQ ID NO: 609741 - DNA, 371 bp, Homo sapiens
tcagaggattaactacaggcacgcacaccatgccagtaaatttttgtatttttggtggagacagggttttgccatgttggccaggctggtcttgaactcctgacctcaggtgatctgcccgcctcggcctcccaaagtgctgagattacaggcatgagccactgcgcccaggcaaaaaatttaaaattgtaaaaatcagccaaacatggtggcattcatctgtagtcccagcaacttgggaggctgaggtgggaggatttcttgagcccaggaggtcaaggttgcagtgacctatgactgcaccactgcactccagcctggacaacagagtgaggccctgtctcaaaaaataaataaataggagtttgagg

SEQ ID NO: 609742 - DNA, 846 bp, Homo sapiens
cgtggttgagacgcgcagagaagttttctgctcgtgaaagagaggaggaatacagcctctgtatatagtacgtccctacgggctcaagagatgcgtacccgcgcagttttcaacgtgactttatgacgcgcaatgtttagcgaaacttagactcttataagcctctcctggggaaggaaacaattaacgggttctttaccccaccccggggttaaaacgaacctctcctctccagggcggccagaacatcgttcgtataaccaacgctgttggtaggcagcggtcccgcgcctcccctgtttatcccccccacaaggcgcacacagcgttagagacgaacaggaagggaaccttaccccgtgctagaattagttgtcaaaagtgttgagtgtattaacatattctttaggggaggttttttaaaaaagaggctgtaaaccccaggtgggctctaaaagcccttaaatcccctgcccagcgggaatgattgccgcctcattaaacccctctgtgacacgtcttttcttaccccccatcgaatcggtgcaagccatgactagcggggtggtgatgtcgagtcagaagccaccttgtgggagagtcattaaagatttttgagagtgacaacttgggacagccaccaactccgccgaggaggtcgctagtaaacaataaaataacgaaaaaatatatggggaagtatgttaagagttaatactccaattctttttcttaagagaaaaaagagtttatttttcaaccccgcccacaatgatggagcccccgaagcaacaagcacacacgcttgggacccaaaacttagggcccaaaactgcccacaaaaca

SEQ ID NO: 609743 - DNA, 755 bp, Homo sapiens
ggcagtgagcggagatcacgccactggtctccagcctgggtgacgagagcgaaactccatctcaaaagaacaacatgcaagcaaaagatgaggagcctccatgcattgaagctgggacctcggaaagttgataaaatataataaaggcaaaattgtactggcttgggataggtttgcctaatatcatgaaatgcctccagatattattcttcagaccggatgtctaccctggaaagtgcgtgggcttttccaggttcccaggtcataccctaagtcaagcttgctacgaagatcataccaagctgctgttagcatggagcacatctcagagaaggtgtctcctgtcaggaaatatgtccagtgcaagcctaaggaatgtgtctggtcgtgatgttcagaggtatatgtgcgaggtgtagttatgagcaggcgtggcatcgacaaaaataatgtgaaggcagaagagatttggcgctagagtcagtttatatattagaaaacaggaaccaccgttctaaatcattggagactcgcagacatggagtttctgaatgattgattgtgtgtgaaacttaatatctttagcaactggggacacccgaagtatactgttgatgtcgatgtcaggctccagggcacagcaggcaaggacatctagaagagtgggtacagaagggcatgcccacgtgtccagaactatgcaagaatgccttattctcttggatgataccgcacccataggcacttgagaactg

SEQ ID NO: 609744 - DNA, 313 bp, Homo sapiens
tatatgttgtgttcccttcttccccgtcccccccccgctggacaatatcggatgtgttccgcggtcacttgtgcgaagaagtaaacgaactgttaaaagagcattatgtgtcggcgtgtttttccccccccccaaaaaagaatttttaagtatatatggggggttttatagtgctcgcgtttgcgtcttttgtgtttgtatgtcaggtgccgctaagttagtttagcgctcgagggagaggttgtgtggttgctttctatcccacttgtaattgtagtacgtggcatttttttaggccctaatataccggctg

SEQ ID NO: 609745 - DNA, 278 bp, Homo sapiens
  misc_feature (45)..(45): n is a, c, g, or t
aacgatcgagctcggtcctggagctggttttctcctgtctcagcnctccccagttgctgggattacaggcatgcaccaccatgcccgactagtttttttacttttagtagtgatggggtttcaccatgttagccaggctggtctcgaacccctgacttcaggtgattcgcctacctcggcctctcaaagtgctgggattacaggcatgagccactgcgcccggccagttttgggtcatatattaactaatctattttgggtcgatttttgtttatggt

SEQ ID NO: 609746 - DNA, 268 bp, Homo sapiens
ggacatgcctccgccggggggctatgggcccatcgacaacaaacggaacttgccgcgtcgaggactgtcggcgctacagcttgctcgtccatatgagatttggaagcctctcgtctacggaacctgacatcctccgtcgaggtgctatcggcccatcgccaagcaactaaactttccgcgtacttcactgtctcgctatcgcatgtttgccctagggattggaagcctgatctcagagccactggacctatatgatgtgtacccgtca

SEQ ID NO: 609747 - DNA, 195 bp, Homo sapiens
caatttttttggggcccaagcctagaaaagagaaatgtggtttgaatccttattttaatccttgtttgatagaagaggggaagttttggggccctaatttttcccttccctggggttgggctttaatccgtttaaatgtttttttgggcccccattttcgcttccataaaagttttattgtttagtgcccttcca

SEQ ID NO: 609748 - DNA, 538 bp, Homo sapiens
  misc_feature (45)..(45): n is a, c, g, or t
  misc_feature (58)..(58): n is a, c, g, or t
atattttatacagaaggtttccgccaagcagattaaattcagcanatccttaccagcncagggtttagtggccaacggggccgttccatggacataaaagactttctccgattggtccatgggttcaacgccaaagggattccttttttcttggggtttgggaaaccaaaattttccagggccaaaaaaaaaatggattttggtttttttggtttttagaaaaaaaaggctttggttttctgagaccatatttacttggccatttttgggtccaaaccaaccccgggggccccccttaagatttttgatttttaaggtgggaaggttttagggaccaaaggtttttatataaaggtgggcccatctatttctaaaaattttccaggtcaggggccgcaaaaacggcccccttttcccttttccttttttaccggtttttggaaaaaaaaggtactttttttttttctgttttaaaccggaaggccctttttagggccttaggtttggttcccccggaataaaaaagtttaaaatttga

SEQ ID NO: 609749 - DNA, 559 bp, Homo sapiens
  misc_feature (77)..(77): n is a, c, g, or t
ggcgtcttctcgcgcggatggtgaagctgaatttggtacgctggaccctcggacagacagcaagagagagacaagcncgaggcctgacttctagcactcctgagtttgagccctatgagcagtggaacctagggaccaccaaggtatccagatataattctttcctcagtaatagaaaaaagaatctgggatctaagaagatacctactcagttttctaagtgactggcgcatgtcattgtcccacttataccgggatgggcgaaggccgcattgagtgatgatgagtgacgagcgggcagaacttctggagatcactgcactggcgatctcgcagaactgagttcaacccctaaccgatcagcgaccacgtggcgagaccaagggaagaaggccaccttacggggatgtgcggcagagcggagactcggaatgatagagaggcccaggcttgtggaggcaatacgggcccgtagactacgtctgcgccaggacaacgtgacatcaagcgcagggcgtcaagaacaggggcagcggcaggaggcagagtcggaagcatc

SEQ ID NO: 609750 - DNA, 151 bp, Homo sapiens
ccaagataaagggcagacagagaggaattagagagattgaggacagaggacacggcaggaaacttaacaaggggggtcagagaattaaaggagaggacagaagggacacaggagcttcccaagggccaattccaggaggatcagagcatca

SEQ ID NO: 609751 - DNA, 187 bp, Homo sapiens
  misc_feature (123)..(123): n is a, c, g, or t
  misc_feature (127)..(127): n is a, c, g, or t
gggttgtggtgctggagtttagttgagtagtaggaatgcggtagtagttaggtaatataaatagttaaattaaaatggctatgttagggttgtacgggagaactgctattattcatcctatgngggncgtaacttcgaggagtatgccaagattttgcgtagctgggtttggtttaatccacctcaa

SEQ ID NO: 609752 - DNA, 1115 bp, Homo sapiens
tctttccattttaaatttaatttttaaaaaaagacatggaggttagggtaagaaattatggaaggttacatttttaaatctgggcaatggctaacagtaaggggaataaaataaataagtttttaaaagttacaaggtttatagactatactttataaaaaatatgacctggaattagaagactatttaaaataaggtggaatacaacacccaggaaggggactttaaggcaagggaaagggcaacattcatatttaccaccaaggaaattaaaggacccaatagtgggagggttaacgggaccggcccagaaaacttttagaactctgggtggatcagggttctcccagccctcgtgggagggcctccatatagtgggtgcaaaacgttctcttttattaagataccgtggggccgtgggaatttaaatataacattagccaggtcgcggcaagcgcaaatttcacactctttgggggtcacacgggggtcaaacttatcacgtggctcaacaaaaacacaaacacaaaagagggggcggcgcacggctaccaaaaaagaagagtttaccgccctctcggagggggggcgcccccaagagcttacaacgcgcggttatacccccacacgggctatatccccgtgggtgccccaccacagggtgggggtccccccctataatacgagcggcggaagaactccgacataactacaccaatgaaagcgcattaaaggggccccacgcgtgggggcccccggagaacaggatctaatcacacaccaacaagggggcagcgagagtggaaaacgcgtgagggaaaaaacaaacgcggcgcgcacacacacccccgtggggcgcgaacaccccccctccagggggagtaagcaacggcggaaccaccccgattacaaccctatccacgtgtggagcggcggcggcgtcacccccccactcacctgctggggggccgcaacaacaacaatacgacccctatccaccagcgagagcagatctttcccacgaacggggcccctaaaagcgggggcacacaccacttccaccacaacacagcgcgcccacaacagcgctggcaaccaacatggcgcttgtccaa

SEQ ID NO: 609753 - DNA, 811 bp, Homo sapiens
  misc_feature (23)..(23): n is a, c, g, or t
  misc_feature (71)..(71): n is a, c, g, or t
  misc_feature (76)..(76): n is a, c, g, or t
  misc_feature (78)..(78): n is a, c, g, or t
  misc_feature (88)..(88): n is a, c, g, or t
  misc_feature (90)..(90): n is a, c, g, or t
  misc_feature (98)..(98): n is a, c, g, or t
  misc_feature (112)..(113): n is a, c, g, or t
  misc_feature (117)..(117): n is a, c, g, or t
  misc_feature (125)..(125): n is a, c, g, or t
  misc_feature (133)..(133): n is a, c, g, or t
  misc_feature (139)..(139): n is a, c, g, or t
  misc_feature (195)..(195): n is a, c, g, or t
  misc_feature (200)..(200): n is a, c, g, or t
  misc_feature (236)..(236): n is a, c, g, or t
  misc_feature (243)..(243): n is a, c, g, or t
  misc_feature (256)..(256): n is a, c, g, or t
  misc_feature (264)..(264): n is a, c, g, or t
  misc_feature (281)..(281): n is a, c, g, or t
  misc_feature (289)..(289): n is a, c, g, or t
  misc_feature (295)..(295): n is a, c, g, or t
  misc_feature (304)..(304): n is a, c, g, or t
  misc_feature (315)..(315): n is a, c, g, or t
  misc_feature (326)..(326): n is a, c, g, or t
  misc_feature (341)..(341): n is a, c, g, or t
  misc_feature (362)..(362): n is a, c, g, or t
  misc_feature (374)..(374): n is a, c, g, or t
  misc_feature (380)..(380): n is a, c, g, or t
  misc_feature (396)..(396): n is a, c, g, or t
  misc_feature (404)..(404): n is a, c, g, or t
  misc_feature (428)..(428): n is a, c, g, or t
  misc_feature (432)..(432): n is a, c, g, or t
  misc_feature (453)..(453): n is a, c, g, or t
  misc_feature (469)..(469): n is a, c, g, or t
  misc_feature (480)..(480): n is a, c, g, or t
  misc_feature (498)..(499): n is a, c, g, or t
  misc_feature (510)..(510): n is a, c, g, or t
  misc_feature (515)..(515): n is a, c, g, or t
  misc_feature (526)..(526): n is a, c, g, or t
  misc_feature (550)..(550): n is a, c, g, or t
  misc_feature (795)..(795): n is a, c, g, or t
gcgatatcgacactctgcacgtnctcctcaaacttggagatctcctcctccagcaagtatgtacccacctngtagnantccaccaaanantgaatctntagcttccggatanngtancccacccncaccagcntggccnccccccagaccagcccgtccagctggatagagcgcacacaggcctccagctgagcnatgtncgtctcatcatcccaaggattgaaatccagcagganggagganttggccaccagtncaggcttnttggacttcttctccgngtactgcngtagcngctcctccnggagctgtgcngcctccttgtnctcctcctcattgtnactgccaaacaggtcaatgtnatcatcctcgtnatcctntgctggtgtgggtggntttttggntggggggtccatttggcgcatggntgtnttgtgttgggtttgtggggtngtggtaagtggcaggngagttcttttncagcacgttcagttgggnntccagcttggngatgntttgttggagntcctgttccacgccacgcagattntggttctccacttccagactggcaatccggacgacgagctcaccatggtctccgctggtgccgctggaggccccggggcctgagcttccagccagggatttctggatgttctctctggctctcgcaatgtcacggaggatcacgctggcgccgttctcctggggggaggcacctgccacaggcccgttcatctgctcgtagaatctcctttctgcgtcgtcatatttgaacttgtcgaaccagancttctcatgtgctagg

SEQ ID NO: 609754 - DNA, 153 bp, Homo sapiens
tagtcaggatcttcgtcccactcagattctacaggaaacgttctgaccaggaagcaatcgggtggcagaggtagctggtgtaccagtcccacagccttataaccattctaagttattggcattgacttcgtcattgttgttagcgcgtgctgt

SEQ ID NO: 609755 - DNA, 581 bp, Homo sapiens
  misc_feature (57)..(57): n is a, c, g, or t
tctcatgcagagagctgggatcttcttggccattaaagtatattgttcacccccacnccgcgagaaccaagctcaggagttgcctgcctctgcacacatgctgagtgtgctgtttgtgtatatggcaggaccgtccctatggggcatgtgtgagctccgcagctgggtcaggctcctcggtccaggtttacttcatcccgcctggacgtgatttggctttgaactgtctcgcatgcagccacaaagcaacttccatccctgtggtatgctgatagctgtactcattgaaacagtggcctctccaagatttaaggatattgaacaaagaaactgggactgagtgacttgttacatgaacaagttcagaagggcagagaggcacatcatgtacagacttgtggagcacctttcgtttcacctgcgatgcatgcttactcagcataacgtccctccctcattggatgtgatgtactcaggccttacagggcttatccaccagattatattacacctgtacttcccaaccgcacactcgcttggcgtttaagtgtggatattagaaatataatatttcttaaaca

SEQ ID NO: 609756 - DNA, 282 bp, Homo sapiens
cagatcgcccgtggtaatgccgatcgggtggcggtgctctcagccttctactttggccagaccaagactggcgacggcgacgtcccgacgcccaccgagggccatgaggggctggatcagcttgtcactgagcttggtgacatcgacgccagcacgaactgcaccttcccgctcgacgactctgacgtcgttgtccgggtgggccgctacggcacctacgttgaggatccggtgggcaatcgagctaatggcgacgacgctctgcctcctgaagagctcacc

SEQ ID NO: 609757 - DNA, 250 bp, Homo sapiens
aactggacagaggaaaaaaatatggatggaacgacgcacgcatggacggaggaaatgaagccccaccacaatggatcacagagttttagggaggcttcacatagagcacatgaaggggttcctgtggccctgctaccagaaggagagggaagaaggatgctgagatggcccagatgggacaggatggacctgcagggccagataccaaagccctgacctgcctaagcatatgttgttcccaccctaccct

SEQ ID NO: 609758 - DNA, 190 bp, Homo sapiens
aaacaatgcacatctatcatctagacactgggatccaccctcagctgagatgccaaggtgtctgtgctgattacagccaacctccctcagtctccgtgtgcacgctgctctcaggcagaggccatgagaaaaggatgatgacccagtgagaagctgggactctgtgaggctaactctcggggatcctcta

SEQ ID NO: 609759 - DNA, 265 bp, Homo sapiens
ctcagtttaccctccgcttgaatagatacggggaataaactaaacacgagggtgacacaccttctcccaccttgtcagctgaagcaggagagccttccctgcccaccccatggtacattatctccagcatctccaggccacagctttcaccctttagcctagtggaaaagagctgggaaacgtggctttgccatcaagggagaaggggccattatgtttaccacaaagacccgattgttactgaaaccaaactgggctgcttttc

SEQ ID NO: 609760 - DNA, 189 bp, Homo sapiens
  misc_feature (6)..(6): n is a, c, g, or t
ttggtngctctcgacgagctacccctccctaggtgggcgaggggtctgggtgggtgtttgggctcctaccacgggggctccctcctagcaagggttggctggccctcctttccatctggcccccaaggccaggcatctcacttttcctcccacttttctgggggtcacggcagctcgcacttcgtcact

SEQ ID NO: 609761 - DNA, 898 bp, Homo sapiens
  misc_feature (251)..(252): n is a, c, g, or t
  misc_feature (258)..(258): n is a, c, g, or t
  misc_feature (264)..(267): n is a, c, g, or t
  misc_feature (269)..(269): n is a, c, g, or t
  misc_feature (272)..(272): n is a, c, g, or t
  misc_feature (669)..(670): n is a, c, g, or t
  misc_feature (718)..(718): n is a, c, g, or t
  misc_feature (720)..(720): n is a, c, g, or t
  misc_feature (724)..(724): n is a, c, g, or t
  misc_feature (735)..(736): n is a, c, g, or t
  misc_feature (748)..(748): n is a, c, g, or t
  misc_feature (759)..(760): n is a, c, g, or t
gtattgtgtttaaataaacttgaaccaaatttgatacttttttttttttgagatggactgtcactttatcgcccaggctggagtgcagtggcgtaatcttgactcactgcaaactccacctcccagattcaagcgattctcctgcatcagcctcccgagtaactgggactacaggcacgcgtcaccatgcccggctaattttgtacttttagtagagacagggtttcaccatgtaggccatactggtgtcnnactccngacctnnnntnatntgtccgccttggcctcccaaagtgttgggattacaggcgtgagccaccgcacctggccaatactcctttctaagctccgagcatgttggcacatttgatttggtttgctctttctttatctgtaggccatttgatattgggccatcattgaaagaggcctgtctttcttcttcttttctaaaaagcaatctaattgaatgacatgggctctttttttgagagatgatccgtagttccctaacatatttgtgtgtgaagtttaggacaattagctgaggtgtctgagcactagtacctacatttctgatattttgataagatgaactcgcttaatgattttggagatagaaatgaaagaaaaaatagagctctataggagttagattaaaatatcagnnttggaacatcatgaattattgtgatctccgtaaggattttaggctggntntaanggctatgtgcnntttgtatgtatngaaaaaggaannttctcattgaaactgacttgtcaaatatttctctccaaaattgtttgcagcattagtgccagcagtagttcccaagggctgtctcagccatcccacccagacgactccgtatctgagagccagtgatgccccacctgg

SEQ ID NO: 609762 - DNA, 1310 bp, Homo sapiens
  misc_feature (1310)..(1310): n is a, c, g, or t
gccaaaggagagtgcatggaggacaagtcctgatagttcggtgatccaggtagagttccatcacacgcgcggtcaaggcttcttcactatatgttaccatgacacgtgcaagaagaacgtggtaagggtcttggctttgaagtgtcgtatatagagaaatatgcgttgtggtagtcaagataggctcagaagcaccagcgtttccatgcaacactgacagtttgctgaggagtgtatacgatgggcattacgacgcgtgtgacaaatacacattgtgaattagcctttatacggtaactagggtacactctgccgttctgaatagactatggatcctctggaccttcctcacaaagcatgtcgtgggggagctttttctcgatcgtggactgacaaggctgcaatttcatacgctagctctcccgagtttccgcaggcgtgcacagaggggcgtgactttatgccaatgaatgcaggacacacacacagttacgcaggctgtctgccagagtcctgggggcttcctttgtcccgtgcataccccagacggggcagccctgtggcctgatgaaccacctaactgccgtatgtgaggttgtcagacagttcgtgtatacggcatctattccagtctttactgtgcaactttgggggtcactcccattgatggagctccccagcgatcactacagtgagtgctacctgtgctgctggacggtgtcatggtttggctgggtggactaagggtcttggtcgcagggcatcggcagaatcgctgatacgacactttcacgcggtgctctagcagagagacacagacattcctccccgtggatgtggacctgtggtcccttattaccacgagatacggggacacgccaacgtctgtcaccccggcgtatgtgcccattctaacaccacccctgtgacctgggcacggcctttggaaaaacataagaggttgggcccacaacaaacgccaatctgggcgacttcgggagacgacacagctcccagaacaggggcgacaccaccttccgacaaagagcagaccaagcaggacgagataacctaacaaccaggaaggagactccacccaacagcgtgtagtacagagagagaaccaacaaaccacccgctagagtcaaaccaaccacagccccgaagggaaatcgccataaaaggaaacacaacagagtggcagacgccaatcagacaagagaagaagagaagaagacaagccagcgaggcagcgccacaaccaaacaagcaaacgacgcccgctgacacaaagaccaaacgaacagagn

SEQ ID NO: 609763 - DNA, 616 bp, Homo sapiens
attccatctttcactccgggatgaattgggaaaagttgacttggtcacagaactccgtggatgttgagcactggtgctccagaatgaccagttggtaatattgcgaaggggtgggtgatacttctggcttctcctgatgcctgtttccggtctggttatgacttggttgggtaactattaagggactaaaagtgagtaatgtgtaccgggtccctttggcataaaactggttatgacttgatcccagtggttaaccaattggggctggtcagtctgacccatacattactgggtcatagcaatgtgggcgtttttcaaggggtgaagcataccaggtcttaaacccgaggggttaccttaccaggttccctttaacaaaacacagtaaaccctggccggctattgcaatacacctagtggccttatattatcgcctattttactataattggaggaatccacactttttaaacttccactggttttacctttccccaagtgggtggggggcctcctggtcacctaacgggggtgtggttactttcagaaggtccccggttgggaatttccatctgaaccggggccttgggttcttccgatagtcacaggcttggcg

SEQ ID NO: 609764 - DNA, 230 bp, Homo sapiens
  misc_feature (195)..(195): n is a, c, g, or t
  misc_feature (214)..(214): n is a, c, g, or t
taatgctcggtgagctctgaggatcccccgcgtacagttgcggagccagcgagagtctctgcggtctcccgtgcgctcaagcacaagcccccaactaaaagccttgtgtggaaaatctgcttggtgcataacagattatctggtgagccagtgtaggagcacaaggcagtaatttccctcctctgcaggggaggncttgtgagccttgcgagcncggagggaggccccac

SEQ ID NO: 609765 - DNA, 117 bp, Homo sapiens
ggccggaccgtctatcttctgaatcctcgaatcttctttctcgtttctctacagcggcacaaactcattaacaaggcttctcggtctttcatcttttcaattgctttgaatcttgaa

SEQ ID NO: 609766 - DNA, 882 bp, Homo sapiens
gctactcgggaggctgaggcaggagaatggtgtgaacccgggaggcagagcttgcagtgagccgagatctcgccactgcactccagcctgggcaacagagcaagactctgtctcaaaaaaaaaaaaaaaaatgagaataccgaaaacttgggaagcaatattggcacatagttcttgatatagtcaaatctactgtgttactcataagagggtagcgcgtttattcatctgtgaaacggcagacataatacttatcttacacaggttgcaagacgctcaaggcacaccatgtatgtaacagttcctgctgtaactatgaactcccatcctaatacccttttacctctctgtgggtttgtcttgacctggaaattggggctaaaacttagaaaaaaattcttacatgataactcagtgatgctaactcatagtttagggtgttcgctcatagataagactataacatcagctgggcgcgggaggctcatgcctgtaatcccagcacttgtgggaggccgaggcgggcagatcacctgaggtcgggaggtcgagaccagcctgaccaggcttggagaaagccccgctctctactagaagatacacacaattagactggggcgtggtgggctcaatgcctggtaaatccccagctactggggaggcatgaagggcaggagaatcgctttgaaacccaagggaggcggaagttgttggtgaaccgcagaatcggtgccattgcaactccaaggctggggcaacaagagcaaaaactctgtgttcaaagaacaaaacaggtttaattcccgacaaaacactagcgccaacaacagtgttaaccgcggtggagggaagtccataatgcagacaatctgggacaggaga

SEQ ID NO: 609767 - DNA, 579 bp, Homo sapiens
ccaagacggtcggggctgctgctaactccaggaaccaggtgtacagttgttgaaacatgaagtaggtctacacagtaggaactcatgtcatttctgctaagtaaaccagagcgaagtcgaggcggagggtctcggaaaagttcattgtagagggctctagagagattgggaactattaggagaccaactgatgcgagctcagagtcaagtagcatccttctctaagagcaggaggtcatgagtagctttctgccagagggagggtgtcacgagctgctcactgtgataggcaaaggatttgaggacctgatgactgtgaatctagcaaggtacagagcaacaggagaggtacgtgactgtacggaggagcaagcctagaagctggtgccattgagatggtaacattcttggcagggcgaggctgcatgtctccaaactctgtcaaccatcccaatatcgtgccatatcgagccgcttttatggcagacaatgagctgtgggttgtcacatcattcatggcatacggttctgcaaaagatctcatctgtgcacacttcatggatggcatgaatgagctgg

SEQ ID NO: 609768 - DNA, 139 bp, Homo sapiens
tgagcaagtgtgtatctcgtggttctacccgcccagttccaggcggctctgggatgaatatgaggagctcaagggtctgggcaggtcaaggcttcccggacacggatcactttggtctgattcctgccagctggctcag

SEQ ID NO: 609769 - DNA, 344 bp, Homo sapiens
aaattaaacttacaaatagttctcaaatcagcttttagcattacagccttaagttcttacttttaaagagacattttcttcctaatgtctaaccattggtaccattttgctgcctacactgtttcatatagagagtgtcgtgttaactgttaaatttactgaaacaatttttccccagggtcttattttgtggtagatagcaacgatcgtgaaagaattcaggaagtagcagatgagctgagagagagagagtgagccgagatcgcgccactgtactccagcctgggcaacagaatgagactctgtctcaaaaataataataataattaatataaccatttttg

SEQ ID NO: 609770 - DNA, 386 bp, Homo sapiens
aaattaaacttacaaatagttctcaaatcagcttttagcattacagccttaagttcttacttttaaagagacattttcttcctaatgtctaaccattggtaccattttgctgcctacactgtttcatatagagagtgtcgtgttaactgttaaatttactgaaacaatttttccccagggtcttattttgtggtagatagcaacgatcgtgaaagaattcaggaagtagcagatgagctgcagaaaatggtaagaaatatactttaaattcatcattttcaaggtgtgcttttctggattaaactggtggtggtttagtacattttgactatgattagattacacaaatggattgggggggctagaaataaacttaagaaacgata

SEQ ID NO: 609771 - DNA, 2243 bp, Homo sapiens
  misc_feature (973)..(973): n is a, c, g, or t
  misc_feature (1984)..(1984): n is a, c, g, or t
  misc_feature (2016)..(2016): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 609772 - DNA, 1370 bp, Homo sapiens
  misc_feature (84)..(84): n is a, c, g, or t
  misc_feature (103)..(103): n is a, c, g, or t
  misc_feature (131)..(131): n is a, c, g, or t
  misc_feature (135)..(135): n is a, c, g, or t
  misc_feature (139)..(139): n is a, c, g, or t
gaagggttgcaggctccccagtcacacccctgcccgaacaggaggcgtctccagcaaggcctgcaggccccacggaggagtcancccccagtgcgcctctgcngtccccagaaccacctgctgggccgccngggnagcntgcttctagttgtattctgattgaagacgagatatccggcgcgactggagcgagcacaggctagaagaggagaagcaccaaatcgagaggagggagaaagactcatagaagagagtcggaagaagcagaggcagcaggcgagccggacaccagatgagacgcgacgtacatccagtcgctcacaagacagaagagccccggtaacatacgaggggggcgcgtgcgcacacgatggggcaccacacctacagacggcgcacacccaggcgaccatcacgtcacccacagagacgcgtcgcgcacaacactggggagagcacgaggcgaagagcgccgctcagacacaacaactccccacaccaaaagagcgaccccacacgggggagggtgcgcgagcacgcagatcacgcctatcgataccataccctacgcgagagcgagcggggcgcagcgcccacccgcgagaggggcgacaccagcgcggcgtaacaaccggccagacagagcgcgcagagacacgacctagagagcaggagaagagcaaacaacaaatgaggagacaacacctcacccgacggacagagacgcaccgcccaacacaccgaccacgcacgagaacaccaaacgagagagaagagagcgaagacacacccgagagagacacgcagcaaccagcgagccgaaccacaccggcggccccgagcccgacaaaaagaaaagaaggaacacgagcgacagcactgaacggacccccacctgcccgcaaccgcaatcacgggcagagacaacacggagagagacaacaccaccccccaaagcgacgaacagaccagcagcggcgcccgatacagaggcgcgggggcaccccccaacgaccaaaccgccgacaacccagacgaccaagacgagacggcgagccaagccacaagccaccacacaacgaaccgaccaaagagccggcacgacagcggagcaacacgcacgccgcaacacacacacaccgcggcagaacaagtaacaagaacagaacagaaagcgaagaacagcagccaccacgagcacatccacgccatccgacggcgacgacagaactatacaactgacacgagacaataagcacaggcgcgtcaacagcagaacacagccgcgcgcagacaaacacccaccacacgcaccgacgcaaaccccaaccagcgccacgggaggccagagaagagcatcgaacggcgcc

SEQ ID NO: 609773 - DNA, 276 bp, Homo sapiens
ctagaggatccccgttgaaatgggcacagaaattaaaacaggcacgtccagtatttcttcggaatacattatattaaggccaaatgttgaaaagactttcctttgtaacactggattagagaagacttttcagtgtgttatctctaggatgatcagtaattcagcacttaaaaactgcagaggaaactgaaagttatgttccaggatgactttccgttgtttaccatattttcttagatttggtcatcatcaggaagcatttgttataattacaat

SEQ ID NO: 609774 - DNA, 2107 bp, Homo sapiens
  misc_feature (837)..(837): n is a, c, g, or t
  misc_feature (1848)..(1848): n is a, c, g, or t
  misc_feature (1880)..(1880): n is a, c, g, or t
tttttttttgtattgatgaaaggtgaatagaaaaatattttatttttaaaatattttttaaaatagaaatggcatctcactatattgccaaggctggtctggaacttctgggctcaagtgagtctcccatcttggcctcccaacatgctgggattacaggtgtgagccaccatgcctgacctgtagtcccagctactttgggggctgaggtgggaggatcacttgatcccaggaggttgagtaagccgagatgatgccactgtacttcagcttgggtgacaaagtgagacccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 609775 - DNA, 1996 bp, Homo sapiens
  misc_feature (726)..(726): n is a, c, g, or t
  misc_feature (1737)..(1737): n is a, c, g, or t
  misc_feature (1769)..(1769): n is a, c, g, or t
tttttttttgtattgatgaaaggtgaatagaaaaatattttatttttaaaatattttttaaaatagaaatggcatctcactatattgccaaggctggtctggaacttctgggctcaagtgagtctcccatcttggcctcccaacatgctgggattacaggtgtgagccaccatgcctgaccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 609776 - DNA, 155 bp, Homo sapiens
tttctggatatctgccagaggacgtgctctgagtctgggctggtgtgctctcccactaggagtgctaggagctgtcacaggtgtgacggtcacggggcagcctttggggtctcgcagcgagcacacgcaagtgaagcacacgcgtggtaccgggc

SEQ ID NO: 609777 - DNA, 2132 bp, Homo sapiens
  misc_feature (973)..(973): n is a, c, g, or t
  misc_feature (1984)..(1984): n is a, c, g, or t
  misc_feature (2016)..(2016): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagaacgggtggtggttacaacatttctggggagatctctttaatatttaccagaggtagcgattgtttgactttatgttgagggtc

SEQ ID NO: 609778 - DNA, 209 bp, Homo sapiens
ttacttttccacagggtacttttccagagggtacttttccacaggtgggaatgtggggtgggagcccctaaacagagtccctactgggggacagctctctaccacctagtggagctgtgagaagaaggccactgtcctccagaccccagaatggtagatctgctaacagcttacactgtgcccctggaaaagtaccctgtggaaaagta

SEQ ID NO: 609779 - DNA, 248 bp, Homo sapiens
ctccgtcggcctcactcatgtcacaatcttctccaacgtactggaaccctgctgtgagaagtgtagctgtacatttacatggtctccagaacttcctttctgggaacgagtaggactctggagaagtagacatggctctctcttgtgactcttggggaactggagatttatgttgggtagcctcagattggagctgagtattagagagctcatggtgcagatgatgaatgtactcactcctccccaga

SEQ ID NO: 609780 - DNA, 205 bp, Homo sapiens
caaacccaattagtcaaatttaagtctacagaagtggtatcagatcaacagggaaattatggactcttgggtattgggataactggatactctccctaaccaccacacaaacagtaaaaaaccatgggtgaattctattaagaatggagaaaattttccaaaaatggctcaaagtccagaagcattaaaggaaagattgatcaaa

SEQ ID NO: 609781 - DNA, 934 bp, Homo sapiens
  misc_feature (382)..(382): n is a, c, g, or t
tgttgtgagcgataatgtaatcttgtgctggcgggttatgtcccccccccgttcctgactgtgcgttgtattatatgtatggcgccagcgttgctgtttccggacgttgagctcgagcgcccctgtatgtaaggtggggcagcccccatgtgtcccgggtgtgtcggccgcgggtgtgtccaaggtgctctgcgctacgcgggataggatgggtacccgcgtctgctttttcgtgataagatttatacgcagcacttgtttgtatgttgccgctcgctcgtcccgccgtctcgacactctccatgggtatgccgatgtttttggcctcccctccgtggctatctcgactagggttgacactcgggatggtgttgacacgccnccgacggtatggtgcttgcgcccttcccgcgctctcgttctgctctcactgttaagtgggaggccccctcactccgcccccccaattacgacgggcagtttgttgtgacccccacaaggggggtcgcgctcactctgtttcacgaaaactggttctctctctcccttccagtaccactaattggtcggtgcttaaacatttgccgcgaacccactctcctagcaggactcctctcgacgccacgcctcgcgggttatatgcgctgctctacattgtccagacgctgccagccggcgttcatttgttctaattgccctcgccactccaagatctccaatgagttcccccgatgatatggctacaacgttttaatagatgggaagccccctcgttataatagctttccacggtttggggcgcccaccttatttgtccaccccgaagaacgcctgcacgaccttgttcctccatgacgccccccctttgagttaattctccccgcgactctacgcaacttgttaatgcgcctcctatccccaaacgcccaacagc

SEQ ID NO: 609782 - DNA, 1972 bp, Homo sapiens
  misc_feature (973)..(973): n is a, c, g, or t
  misc_feature (1938)..(1938): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgttgatttggagatataactatttgtgcnaatatgtacgagatatgtgtattacatgagctgt

SEQ ID NO: 609783 - DNA, 636 bp, Homo sapiens
gcacgagggcctgcgctggtacaggctgtgaccatagggaagtggagctctgggacgcgcccctggcttttggataggactgttgcccagggggcgtggcggtgaccgagatctagtactccagggccggaggatgattagaccatgcatgcgttaacgacgctgcggaggtccctgagccagacacaggggaacggacagaggccaatggcgcacattaggccctaaccagagtcgcactctggcgtctagcaccggttgcggccgggacctgtcatggcaagacttaacctatgagcgtgtcatgggcctaaattgtgcaatgggtcttatgaaggactaaccacatgggggcctgcggcgatgatgagcaccttagggaggggtctgtggactgtgaccatgcctccttggtacaggccggtcccataaggttttaccatgtgcctttcccagttactcatggtaggcttgagggcgggaaaatgccctcaagagttgagggagcttttaggaacgggccctgggcccaacatgggtggagaagcgatatcttcttcccaaaaaatctatacaatttagacttgggggcctcgtaggatacctctgccctgaagagtcctctgttgtttttga

SEQ ID NO: 609784 - DNA, 1907 bp, Homo sapiens
  misc_feature (973)..(973): n is a, c, g, or t
ttagggcccgccggccgtgttttttttcccggcccttagaataccttttagggaaaagtgccccaggagcgttccctgcaccttcaatgtcgaatgaccttcctgtttcggaaagtgtgcagtttttctaagtcacgccatgctagggaataaacacgttggaataggccacctaccagacccacattaggcggcacctactagaaaaatagattaaatcgttatcctggcaatgagtcctaatacacttgatcattgctgtgaattttaaaaggtgtagcaggccgggcgcggtgagtcaccgcgccaggcccgatcataaacacttttaaagtgaagaggctttccgcttcctcaacataaggagtaaatctttaatgctgcttctaggaaaaaaagtacaagaaaagcaagacttcctccttgccttctctttaaaaagcaacagccgatgaacacgtgttggagcgctctcgccttgacagaattagagatcttcagaatcacttggcgtggtggtcgaagcgtctagccctagctcattagggtgccacagtttctcggcccacaagtcagcttttaaccacttttctccgcaaaagaccggaccggtcttcatgcgtcaactaaagcaagcgtctggtcccgtgtgtgaaacgtgtaagttcatggcatcagggaatacccatcgcgcataccgtaatagaagagggcgaggttcctcacctaacccataatgctcagctcgcctttccggaagcaaggactatcaccccgacaataccttcatccgggcggaagcgtctcaccctgagtctgatttggcagtgacgaagcgaggtattgtgggactttgtccgtctcccagtacgcatgtgcctcagccggcctctcccggctcctggggccacgtccgggcggtggcgccgtcgagagatgcacgtcagcgaaactggccaatcccctgcagcgnaagcgcagtggctcgggcgcaccggaagcgcagggggatggggcggcggtgacgcgattctgtccgcgttggaggggccgggccgctgctggagtcgccgcggccgccgcgtgacgtggcacagccagagcctaaaggctagagccggagctgccgcgccagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgaacaggacattccagttaagcccactgggagatcctctagagtattatcaca

SEQ ID NO: 609785 - DNA, 1212 bp, Homo sapiens
gaaggaagagcggcttgcgtggtgatcattactagcttgttcaatgagagaaccagtatggctgctgagggctgattcaggaagaacaccggatcgtcaacgcacgctgggtaccacatccagggaaggatcgcacaacgtaccactcgtggatcggaccgacaaccgataggcccgtgacactctgatcacgaggagcacatccgatgccgagacgaaggaacaccagcactgacggaaaggactgagagtcagacgtgcaatttcgttgttgcatgctattcgaagaagacaaggtgatcgcattcaagtattatacaataactgattgatagctaatagaaagagaaaagacttgataatagtagaaatgtatatagtctcaaagaacgaggagcagataatgtcaacaatgagttagtatcgccaagatagtggatagagggagaaatgatgaagatcaatatagacagtactaagaaatgagtgacctcatcaaaatacattagataaaaatgagaaatagattaacagacagaaaaatatggggtatatattcttagtgagagtagaataaaagaataaaaacatgtagaacgcacagttgagacaaagttgcagagacgatgaagggaaaaagatagaatgtggtactaaaattaaattgtagagggtacaataggaaatagaggaaaattaacaaataatagagaagatatggaaataggaaacagaaagagtacaacaatatagtaaacaattgataataggtgaacattaatacatagacatagttggaaagaactaacagagaacactaggaccaattaatcataaacacagtataatggtacgtattgtatagcaacacaattggaattatgatatcaaagagaattacgaaaaataacaaaaggaaacaacggagcatagcaaacaacgaacaagacccacagagccacatcactaccgcaaggcacgcaaaaatactagacgtagaagccaacacgaaaacgtacaagcacaaacaacccaggacataagagaacaagcacgagcacaacaaaagataagaagaacatgagacaacaccaaacaagaacacaccaacagacaatcagaaccaaacgaaagcattgaaacgacataagggcggaacggcacgcagtaatagcacaaaacgacgactcggctatacaataccaccaaacg

SEQ ID NO: 609786 - DNA, 1150 bp, Homo sapiens
  misc_feature (21)..(21): n is a, c, g, or t
  misc_feature (24)..(24): n is a, c, g, or t
  misc_feature (37)..(37): n is a, c, g, or t
  misc_feature (891)..(891): n is a, c, g, or t
  misc_feature (923)..(923): n is a, c, g, or t
aagcatggtatcaacgcagantgnccattacggccgnggcagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 609787 - DNA, 156 bp, Homo sapiens
taaatttttagtagataaccacatctccctacatggcccaagcgggtctctaacctcggagctcaagggatcctccggcctgggcctcccaaagtgtggggattacgggagtgagccaccacaccgggccttaaattacttctactcgggaaagtg

SEQ ID NO: 609788 - DNA, 1132 bp, Homo sapiens
  misc_feature (873)..(873): n is a, c, g, or t
  misc_feature (905)..(905): n is a, c, g, or t
ggagagccggagttgccgagcaagtcgcctagcaggtcctctaccggcttattcctgtgccggatcttcatcggcacaggggccactgagacgtttctgcctccctctttcttcctccgctctttctcttccctctcgtttagtttgcctgggagcttgaaaggagaaagcacggggtcgccccaaaccccttctgcttctgcccatcacaagtgccactaccgccatgggcctcactatctcctccctcttctcccgactatttggcaagaagcagatgcgcattttgatggttggattggatgctgctggcaagacaaccattctgtataaactgaagttaggggagatagtcaccaccattcctaccattggttttaatgtggaaacagtagaatataagaacatttgtttcacagtatgggatgttggtggtcaagatagaattaggcctctctggaagcattacttccagaatacccagggtcttattttgtggtagatagcaacgatcgtgaaagaattcaggaagtagcagatgagctgcagaaaatgcttctggtagatgaattgagagatgcagtgctgctactttttgcaaacaaacaggatttgccaaatgctatggccatcagtgaaatgacagataaactagggcttcagtctcttcgtaacagaacatggtatgttcaagccacttgtgcaacacaaggaactggtctgtatgaaggacttgactggctgtcaaattgagctttcaaaacgttacatgacacttggatatctaaccaaggacatgtttgataaaatgggctaggcttgttacaacaaattagttggatctgggttattaaacagtatctgggactggtntgggcagaatattaaacttattttgttgccantattgtttaccgagtataatgttgctatttagcaatgtgcttggttttacagaaattctccttggagagtttctctttaatttacttccatagcgtaatgctggcatagttttgtgaactttaataaatgtttgagtgtttttgggccacacaaatagtttaagtcactgaatctaggacataaaacggacagggataacatgacacggtattttccccaaattatg

SEQ ID NO: 609789 - DNA, 128 bp, Homo sapiens
tggatctgatagttacaaattgtgttacttgcctgggattttttgaacgtttgtaactgctgtcttcctagtccaaacagctgcagtttgggcatttttctttttaattattcttcctctgacttatg

SEQ ID NO: 609790 - DNA, 176 bp, Homo sapiens
tgtagatggggacataccccagggcgggaattttgtatggagccatcatggaaaaacagggatgggttttataatatacaaatataaaaatctataaagggatatttttagaaaaacagcccccccctgctttttttgaaaatagtttgaataagaataaaatggatttttccaga

SEQ ID NO: 609791 - DNA, 698 bp, Homo sapiens
  misc_feature (32)..(32): n is a, c, g, or t
  misc_feature (209)..(209): n is a, c, g, or t
  misc_feature (224)..(224): n is a, c, g, or t
  misc_feature (245)..(245): n is a, c, g, or t
catcccgagcctcccaaagcagaaatgcagcngccgccgccgccacctccaggccactatggcgcctgggctgcccaggagcttcaggccaagttggcagagatcggagctccgatccaggtaatcgcgaggagctggtggagcggctgcagagctacacccgccagactggcatcgtgctgaatcggccggttttgagaggggaaganggggacaaagccgcnccacctcccatgtcggcacanctccctggaattcccatgccaccaccacctttgggactcccccctctgcagcctcctccgcagccccacagctccaccaggccttggtcttggtttcctatggaaccaagccaccaaatttggggcccccgaccgtcctctccgtgtgggtgacgccagatggcactgtcagaggaggagcggctgcacgttggctcagcagcaggcggcattgctgatgcagcaggaggagcgtgccaagcagcagggagatcattcgctgaaggaacatgagctcattggaggcagcagaagcgggcagagtgtgtaactaggagcagggaacgaaagccggcagatagccaacgatgggcacccaggccctcggcccccaaaagacatggcgccacgatttggtgtgcgcactcctctgggtcctcgagtaagctgctccagtgggccagatgggacaac

SEQ ID NO: 609792 - DNA, 130 bp, Homo sapiens
tcctgcatggccatttataagagcagaagagctttatctatattccctcttctttgatacagactgggctagcatataagaaaaacataggtctagtgaaggacatactgattagagctttaatcagtgt

SEQ ID NO: 609793 - DNA, 114 bp, Homo sapiens
  misc_feature (47)..(47): n is a, c, g, or t
  misc_feature (110)..(110): n is a, c, g, or t
  misc_feature (113)..(113): n is a, c, g, or t
cgaccgaacaatggctaatgaaactaacctgaaagcaaatgataacnatacacaggactaaagggcgaacctgatctcttatactagtgccttagtcatctttattgcanaang

SEQ ID NO: 609794 - DNA, 414 bp, Homo sapiens
  misc_feature (399)..(399): n is a, c, g, or t
gcaaccacactttataacaactcactctcgtggtagcaaattcagtcccatgagggagaactcacttctactccaatgagaaaggcactaatcactctcacaacatcatcacctcttaaaggccccacttctcagcatcattatattgccaactaaatttcagcataaattttggtggagacaaaccacatccagcccataacaactacccaccttctttctgcttcattctctgccctttctttctgctggctcccctcactcttgttcctttccctttctgatctttctctcctattctttctccttcccttctgtgctccctctagtcctttccctgcttaccaggatggacttcagcctctgtgtctccatttcctgtctggcatctgcatgggnttttgttttccttgg

SEQ ID NO: 609795 - DNA, 146 bp, Homo sapiens
gtgtgcaggctctaggaagagtctcatggctccaaaacacatttctctgacccgtggcctcttgggttcttggtacagtcttcttgtatgtggtcatagaatatgcctgcattgagatgactaagaagtcaagcgacaatacttgg

SEQ ID NO: 609796 - DNA, 354 bp, Homo sapiens
aaaaccccccatttacccccccccccgccctcaagactgtgggctttgggaagccccgcttaaatgtttggccccccccaaagttggaatggggccggcccagggaggccccttgaaatttacccccttttgtgggaccaaaaattgttttaagggggccggccaacctgttttttcccctccctgggaagggggcccaggggccgcctttaatgggccccccgccccgggttttattttttttggaggccaccctttttttggttttttggggttttttataatccaaccgggttttgcgggtttaatgcccatttttcctgaaaataaaaaatgaaattttttggttcccca

SEQ ID NO: 609797 - DNA, 1632 bp, Homo sapiens
  misc_feature (624)..(624): n is a, c, g, or t
  misc_feature (1265)..(1265): n is a, c, g, or t
ccgcccgcctactgcctgcgccgtgtgtgttctgctccgggtcggcgctcggctgtgtctcacatgtggcgccctccatttcgccagcggtggttttttatctcctccctccccaggctcgttttggtgggcgggtggtgctccaactgtctagctccgacggttggtggttcggagctgtgcccccgcggggagggcgtctgttctttttcgtgggagggctgctagcagttgatgtagcggcccaccgggtgtcctcttgggcgtggttgtgtctccaacagtggggccggcccgcgttggtagttcgttgcgttgtcaccggttgtgtgtgtcaggggtggggtttgcccccccgagtctgttgctgtctgctttgtggcgcccacacgctggttgttgctccctgcgcgtcccccagccgagtagttttgtctgttcccgtgcggcgcgtttcgctgttggtctcccatcctcctacagtgggggggccctttactcgactcctcccaggggtgcgttcgtcttccttctactcctcctgtggggtccgcccccttgtagatgtttaatagatgacatgggtggcgtggcgctgcgctcctcccgctcgatcgtcccttnttggtgtgtgggccggctgtgtgctccaccgatgtgggggcccgcccaccgatggggcgccgaccatcaggggggttgtttattccccggcgtgtttagtgttaatgcgtactattatcgcggggaggattttttctccgtgtgtgtgttttcgttcgccccccgctgttttggtgtgatttgtgcggccgccccggttgtgttggttatgtcgtgctgtcgtccgctcacgacggtttgtccgtcctctttgttaatgatgggcggtggttctgccccaaagcctgtgtttttcctccgtgggcaaccaataatgccgccgctgtgtgtgccccaacgagttactacattgtggggggtcggtgttgtggacaccccaccacggcgttttaaaagaaagggtgtttttggcgtctcctcgggaatgagccccgcctgttctacagggtccgccccgggttttgtccaccacatagtggtgtgagtccgcatagtcttgtggagaacgccccccctcgtctggtggggggcttctctcgtagagagagttcccctcgtagatatgtatctctaatacctgtgggtttgtggtgatacagagatttctcacacacatatgacacaattgtttttgtagaggntttatatctctctctcatgtgagatccacattctcactttataggctatatctacgagaagagaatatctcttgagacacacccacgctgtgagatctctccacacaaccacgctctcaccacacgccaccacgcggaagatatgtcgcgtgtggctgacacatcttgccaggcccgaaaagaacccgtggcccttgtgaaagggcccaccaagattctccacccaccacttattggtggctttctccccgggccagaccttgggagaaaggcgcgcccatacatcttctccagacgtcccccctttcccctaaaataagttaagtttgttaaattcatactttattaaccattttggaccgtccca

SEQ ID NO: 609798 - DNA, 366 bp, Homo sapiens
  misc_feature (12)..(12): n is a, c, g, or t
  misc_feature (35)..(35): n is a, c, g, or t
  misc_feature (64)..(64): n is a, c, g, or t
  misc_feature (91)..(91): n is a, c, g, or t
  misc_feature (98)..(98): n is a, c, g, or t
  misc_feature (108)..(108): n is a, c, g, or t
  misc_feature (190)..(190): n is a, c, g, or t
  misc_feature (335)..(335): n is a, c, g, or t
caatttaatggnaattaaccctgctccctgaatgnctgggtaaataatgaaattaaggcagaantcaagacattctttgaaactattgagnacaaagntataacatanccagaatatctgggacacacctaaagcagtgataagagggaagtttacagccctaaatgcccacatcaaaaagttagaaagntctcaaataaacaacctgacatcccaactagaggaactagagaaacaagagaagaccaaccccaaagctagcagaagatagaaataaccaaaatcagagctgaactgaagggaaattgagatgcaaaaaaagccatacaaaaggntcagcaaatctaagaattggttttttgaagg

SEQ ID NO: 609799 - DNA, 727 bp, Homo sapiens
gggacccacggagcgaaagagcgagcggccctacggccgtcgggggccggggcccgagatgttatctgggaagaaggcggcagccgggtgggggctggtgcaggggagcaaccgcgacggaggtgggccctgggacagagggtggctccggaagaacgggtctagaggtgcctgcgcaaacaccagggggtcttgtcgggcccgggccgaggctgggaccggggttcgaatgggggagcggcaaaagccctggaaatagagaagtctctctggggtccattcgcccccagggggctccgtggttgggaaaccaggcatgaggactactggagggacgcacagcgctcgggcactaatgttgaacgaggccttgggttctgtggaggacccttgtggagaacgtgggaaattgagaagagacaccccgaagggccggtgggacaccagggcggggcgcaaacaggaggcgagggtaaaaggacaagagaagtagagtaatgaaagctgggaccccaaacttctacagaaaggaatacgtccccacgtccgacagaagagacaataatggcccaagacgcgtaggaaggggaaagagaggctccccccaaaagaacgccgagaaagccccgaacggagtaaaaaacaggaaacggagagccttgaaaaaccaggggaccaggcaggagaggctcagagaaaagactggtccggagagttgcacaaggca

SEQ ID NO: 609800 - DNA, 258 bp, Homo sapiens
ccatggtatcaacgtcactgaaacgagatttcaatgatcttcgagtacttcctgcagagacacatgagaagcgggacttcgtctccgcaggggcttggcccgaagtgtcagcggcgtatggagcccccgtggttggggtcttgttcagcttggaggagggtgcgtccttcttgaaagcaagttcctgacccttggagggatctacctttgcttcccatgatcatccaacgttcacccctgaacattttgtcctgagca

SEQ ID NO: 609801 - DNA, 144 bp, Homo sapiens
tagacgctcccccaaacgcagagaggactgggccattctccttagagagaagtggggtggcttttaggatggcaagggacttccttggtcaacgcgagaacctctctgcgtttggagctcctattcaagtcctctctgcgtttg

SEQ ID NO: 609802 - DNA, 221 bp, Homo sapiens
tgtattggtggtgctccgtccagaaaaaattcccttcttgcctggggactagactactaacattaatcacaagattataagttatgctttaggagtcatgtagctggagactacaagattctggccctccctaaactgctcctacagtcaggacttgagatggtttccagactctacccttgatggatcaaccggcaccacccagatcgagcaccaccaat

SEQ ID NO: 609803 - DNA, 197 bp, Homo sapiens
aatttaagtctttgtatttttttagagaccaggtcttcctcaggctggagtatagtgatgtgatcatagcttagtacagccttgaactgttgggttcaagtcatcctcctgcctcagcctcccaaagcactaggattataggcgtgaaccaccctgcccggccatgaagttaaatttttggttattagcttgttgag

SEQ ID NO: 609804 - DNA, 483 bp, Homo sapiens
tggttgcttttgctgacgaccatacgctcagccatgcccgaggcgttgcctaagctgtcagcgtgctactctctcttcctaccctggaggctattctgcgtcctgacgtcatgtagctgcctagccgcgtagttccgtcctatcatatgtaaacggacccggtttcaacgtcatacatggccatacgtcgcacatcacgctagcactctctgacgaatcgcctaccgtttatctcttcttaagccttccccattccgcatccgggatgaaccagttcactctgctacaggccttccaacgagatcctgcaaccgtgggtcccgcctttcacacgagctctaacgaatgtgactcatctaaagtgcacgcgcttttgtaggccatccccgttcatcttgtacctgaacgctcgccctaaggcttatctgttcgtatccgaactatatctctctgcatttatcactggcgcctcctacgctgccg

SEQ ID NO: 609805 - DNA, 140 bp, Homo sapiens
gtactaagatccgagagacgacgaggactgtgcatggggaagtgtttagactgggttcgagtggtgtttctccagtgcttaggtcgataatctgtcttggtgtagggttggctggacagtgggtagacacgaagactctg

SEQ ID NO: 609806 - DNA, 544 bp, Homo sapiens
atctagaggatccctctccaaaaaataagaataaaaaaggaaaaagaaaataccatcagacgctggtcagcatactgtcaccacagcctcacgcaggcgactacatccttgtacccagcgtccgcggggcctcctccccaagaatgccgcatttggagcccacattcccagggaccccagaatccttcccttaacagtgctccactccagctgcactgccccctccacatctgcctcatgttcagggccaagggccccataccccaggtcagcccagggaagacccaggccgcctgcccatgtatgccaggccaggactcactccagggcagcataattcctcttcagtgagagtgaacatgggggtggaagctgaacgaaggatcccaacacagacctgcgaggaagaccacagcaccaggtgtcgacagagcaggccagaaaaaaaacacttcagaaatggagaactggctaccaaatacaacctgagattattttttacaacgtatttattgcaaagaatgctggacacagtgttgcatgt

SEQ ID NO: 609807 - DNA, 1353 bp, Homo sapiens
tccgcctcttcgggagagattttagcgcacgccggggagcagacgtgtgaagtctgtcccccacatctaccgaggcgatataataccggtgggacccacagcaacaacaagcacagtggtgcgcgggaaaacattggggcgggggaaccgtggataatatgcgccgcgggggcacttgcgcgcccaaaataggagacccggtggcgcgacctaatgtgccgggcgcgaacgacaaagtaacacgcccccacaaaatggccgccatttttccccagaaagtgccccagcgtttcccatctggggggaaaaaagggagaaaacttggggggaactacccgctgggggccgcgccccgagggggctcttccccacgagaaaagagggggaaagtatccaactgtgtagacccgctgtgccgggctttggctcggggaatccccctcgagatgctgcgagcgttgcgaagacccccaaattgtggttaagggtcacaaaaaagacccggcgtgaaaaaaggcctgtgtgttgtgtttaacgtcccctacggggtttcacccctatgcccacggtagttctctcctgagaaaaccactcggtttgcgcacactgttgtttcgtgcgaagcacacgggccaactaattgtggtattatgtggacgccctctatgtttctctgccacaaattgctttttcctaaagagaaaaagggcgagaccgggaaaccaaagaaaatcgggggaactattccgagggcgctagctcgcctcgggccatcctgacgcactctgggttttcgaggaataaccttgaatcggcgacactagtgccctcattttagcgtcggcatcctacaggggagagacagtgcatttcttgcgcccacacatttctcgtggggaaaaaggttttctaaataccttctcgatatgcttccactagtctttcctcgtgttaaggccacaggggtcccacgagaaacctgggaactgatatctttttttaatatgtgaaagccctgggccacctgaaagaataacactggctccacctggacacccaaaagagggaatggaatcctcccggcacagggggcctttctaaaagccttaggaaaaaggaaactgaaactatattcacacatttggaacttttcaatacctactctggacgctgaattttttctttcctaaaacacgggaaaaatgaatgcttaccaaagcactcttttttggtaatttgctttggatccctcccccaacagcctcggtgtttttaaatggagacaaataaaccatcaccttttgtaccaaaacttttcaacgattaaaaaacaaaccaaaaacaaaaaaaaaa

SEQ ID NO: 609808 - DNA, 249 bp, Homo sapiens
taacttacctctgaaaatctacaactgcaataaacttcaaaccaaagcttacgatagtatttacaccgtatccattctagaataatgattcatccttgtcctcaaggtggcttagagttggaagacaggcaatgtcatgttatattattttcaatcaaactaaggtctattatggatacagcaacagcttaagatcacgctgccataaggctgttggtgaatggtccactaatatctgatgggtccgtc

SEQ ID NO: 609809 - DNA, 286 bp, Homo sapiens
  misc_feature (17)..(17): n is a, c, g, or t
  misc_feature (141)..(141): n is a, c, g, or t
  misc_feature (179)..(179): n is a, c, g, or t
  misc_feature (258)..(258): n is a, c, g, or t
  misc_feature (260)..(260): n is a, c, g, or t
  misc_feature (263)..(263): n is a, c, g, or t
  misc_feature (270)..(270): n is a, c, g, or t
gcggcaagggctttcgnggcaagagttcgggcgctgttgcagcaccagcgcacacacacgccgagcgcccctaccgctgcccccacttgggcaaagcttcgggcagagctccaacttgcaacaccacctgcgcatccaacnacggcgagcggccctacgcctgctcgcactgctcacangtcggccagagctcagcgctgctccagcacctgcacgtgcattcgggcgagcgtccctaatgctgtcagctctgcgggnangtntggccanctccagcctcaccaag

SEQ ID NO: 609810 - DNA, 984 bp, Homo sapiens
  misc_feature (225)..(225): n is a, c, g, or t
  misc_feature (726)..(726): n is a, c, g, or t
  misc_feature (964)..(964): n is a, c, g, or t
gtagtccgagtggaccatgagctatcttgagtggcagtgtgcgatcgtgatctccgtgaagacctggtagctgctttgcgcgtcatggccttgcaactatcttgcaccttgacatgatggcacgattgccaggaattcataagaacgcgtttgttcacttcatttggacacatcgctgtgtgactcgtcaaactatacacatccccatcgtgaatccggagaacntgtgcctgatgagcctctatgtgagctcgtatatgccagccaggaagacaagaggttacgatggagcatggattacattagatagctacgtacttgttcgtactggataaatgtgtgggacacttagaaactttaccgcttggaatttatcctgaacaaactgaactgcgcaaatgacataaaatggataaagtacgatcacgacaaggtgatagtaatgtaacatatcagacgagaagcatgtccgtggtgattagataacggaatggtcaagatggtcatatatatagctgcctgacaggaaactatcgtcccagtggtgatgacacaatccttatggtaataggaagattcacacagatctgacgaacggttgatatgaaaagtgaggtctagggggaaaaagcagtattatcgtactgggtgactgggttcaaaggtaaacacttattgaaaagaaggttaagtacacacacatttgactgaacaagacacacatgntgaaggacccttgtggtaagaggaaagtgtggtttaaatttctctgttgtaatcacaacattttgttgtgaattgaggccatttttcattctgttttgtaactttattctggttaaaaggttttctccattaagtgttacaagtaaaaaagtatgcatggtctagtaattatggaatttcattctctcgcatgttttgtttcaccttatcattaagggtcattagtcctaagaaggtntggatttttaagaaaattgg

SEQ ID NO: 609811 - DNA, 110 bp, Homo sapiens
ctaggtactctaaggatccagtcaccgcgtgtgggatctgatcgcgatgcggggtgtagtgaccttcgaagtgtattaccacggctgtgtcgatgcttcaaatgtcgttg

SEQ ID NO: 609812 - DNA, 1315 bp, Homo sapiens
cgacggacggacgacgacgacgacgacgacgacgacgacgacgacgacgacgacgacgacgacgacgacgacgacgacgacgacgacgacgacgacgacgacgacgacgacgacgacgacgacgacgacgacgacgacgacgacgacgacgacgacgacgacgacggactgacgacgacgacgacgacgacggactgcataggctgctgctgacggaggctgacgactgacggcagtagcgaagaacagtgcgatacaacctggggtggatctaagcagacacgattgcggttcagagcatatagtcctgttaacaaatgcattcatattcgtcggtaggtgtcatcaaataagcacgcaatagtgcagtatgtgcaatcgtggatatctaataccacccaatgctcctgtgcacacttgttccggcgacgacaacggtcggatggctgatacagcgctgtctgtccgaggtgagggtatcgtctacaagagtgcgttacttactgtcgtacatgtaatcatcccacagtgtgtagtgtagtgcgagagatcacgctcgctgtcacgtacccttcggtcagtatgtccggacatggcgacagtccaccgactgcatcgcacgtccacttgtatttctattatagagtatgcttcagccaactcgtggacacctaaactatatcatgatccaatatctagtagcctctgctactatcaccataactacatacgaccacacaccaatctccattacacacctacctcaatattcacattcttcatcattccttctcatacgtatccataccctcatctaccgcactctctcaaccaatcgaagtacaacttactctagtcccattctctatctcaatatatacataactattacaccatacatcacctatcaacccacacgcctacatgagactcacacaacatatactccacaacacatctctcacatactgtcgcatccctactacatacaactaccaatacccaaccttacgcacacaatcaatatgctcacatctcataactattcatcccactatcctctaattagcttatcactaaattacacatatatccgacaccgtccttaccgctccacatacagaatgcaacagatagtgattatatacacatcgctccatcaacataaatacccatacataacatcacaacttccccatacacaactcacacataaacgtcctcatataatgacaactaacacaccatcaacacaactcacatacccactcgaataaccaaccacacacattcacacgatccatatcgattatcc

SEQ ID NO: 609813 - DNA, 847 bp, Homo sapiens
caggtttaagtcatcctgctcaggttgggcatagtggctcatgcctgtaatctcagcactttgggaagccaaagtgggaggattgcttgagcccaggagttccaaaccatcctgggcaacagagggaggaacccctctctctaccaagaaaaaaaaaaaaaaaaaagagtttaaaaaacaaatttagctgtggcacctgtggtgtggttgcacactctcagttaggctgtgaggtgtgaaaagggttctccttttaccctgtggggaaagaactgtaaagcttgcagtgtgaagccatgtgaactcgtgtgccactgtggcacctctcccagtctcgtggggagaccaacaggtgtgcggaccccttattctttcaaaagggcttgacgcgtgacaagggattccctttataacccgtgggaagacttgaaccttgcagttgacccatgtgattcgttgccacttgcactctccagctctggggggaaccaacggttgggacgcccttaattcttcaagagaaaaacaaatagaaaaaaaggtgctcatctctctctcctctcacaacctatccgggttgtgagcaacttgtgggggcctcactcccgggttctgagagacacccctctcgtggtgcctattcacgggagtcactcccctaggaagaggggctctcactttttttaaaacagacgcttgggaggggacaggggggcagacactttacaaggggcccggttgttgttggtgtcgctgagcatgtgcggatttttccccctttttcacccggtgtccccagggccccgtggaacgggggttccccaatttttcttgggcgcgcattgtg

SEQ ID NO: 609814 - DNA, 973 bp, Homo sapiens
  misc_feature (973)..(973): n is a, c, g, or t
ggggtgttggaggcttgaaggtagctttaaattcgtgtagtcctgggagctcgcccttgtcggctgagtagtcgggctttacggcgccggatggctctggtacggtgaagtctcgtgcgcaataggcgtccatgagacatgctgtgatcttccattgagtggaggcgggacagtgtgccacacgtttacacaaggccaggacgattaagaatacgcaaccaaatttgtcgcgcgttgaagtaaaagtacgaaggtgtgcacttgttgtttgtcgcagtctgtgtatcaaatctccttggcctataagcaatcctccaacgtcgtcgtgctgcctcagagctgggattacacgagttccatcttggacatagatcagcaagctaaagatggtgactacatagaagccgcctgtaagagcagatcactctgattccaggagctacgtcatccaaatactaacttggtctccttggatgcttttggacgtaatcttaatattagctggtctttgatttgatggacactgatctagaggttatacataaaggatagtagtcttgtgctgacatcatcggggatcaaaggctacttgttgatgactcttcaaggattagaatttgaggtcatgcattgcatcctaacatagggatctgaaagcaatcaactgtgctcgatgaagatggagtcctgaaactagccgatttgtggctggccaactatggggagccaacgcagctgatccataggtggcacccggtgtttcggccccagttaatattgcagcatggatgagtggtaggtgacactgtggccgcgtgaataaagagaagaaggggcatatggagaatagacgtgcggcagagatttaaatggcccgggacggtgaattgtcctcaatgatatacggagacgcgcatgggaaagaaccgctaaacagagcaaatacgtggtaccatcatccataatgacgtgn

SEQ ID NO: 609815 - DNA, 208 bp, Homo sapiens
caggagcccaagacgaaggaagtaaacgcggaaaaccccatgggggctccccccggagttgcttttggaaacccccgggtttaggtttgggggtggggtcaaggaactttgggcatcgggaaaatggttaaatccagtggaaatgactcctgcgtgaagctgggatcctcgagggtcatgatacttaacagtaaaaagatgggctaga

SEQ ID NO: 609816 - DNA, 499 bp, Homo sapiens
  misc_feature (69)..(69): n is a, c, g, or t
  misc_feature (90)..(90): n is a, c, g, or t
gcgacggattcactttttccctggccagccggggggccccttggatttacctgtatccgggcccgcctncagaaaaaggtgtcccccccnaaagtctccccacaggagtttcccaggattgtgggccgcatgttcaaccaattccacaagttaattgaggacaaggcaaaggggcagtccattatgggcctgaagggtttttttaaaaggggaatgaaaaaggccttgggtgacaccaagtttttttttgtgttggggaagccccccccaataagcctgcttggtgtgggcctaagttcccagaaattttttgggggccctggtaatggcccctaaggttggagcccccatggccagcccaggctggttttgttttttgtccggtcacccaatccccactccctggggggcgtgattcccactcctggggggccccatcccccagttcctcaaaaaagggtttttatttttggggatttaaaaaaaacttccccggtta

SEQ ID NO: 609817 - DNA, 960 bp, Homo sapiens
tgcctggagatcgctctgtgcacgatgctgcgggtacggcgggagccgcgctggacccaacgcagtttttccgagcagtccgcctgtgctcacgtcctccgctcccagtcctctactgcgcagccagagacctgctatggccagctgtctatactcggggaagagccgctgcttcggaacgacccctgttggccaatgctggcggtgcgaccatgcaacgaagatcggccaacactgagcccgctgacgacgctgccaagagatcgagcgccttcgcccaaaggcgggctttcacccctggaagcgctcctcgtccagctgcaacctcggctccagcctctcgggcttcgcggtggccaccgggggccgtggctcgggcggctggcgggcggctcgggcgccgccaacagcgccttctgccttggcctccacgtcgcccacgtcgtccgccttcagcagcgactacgtgcggcctcttctccaactcggcggcttgccgctggcggcaggcggccggtggtgtcccccgcaggaggcgcggttggccagtcggccttcatttccaaggtgcacacgacggcagccgacgggctgtacccgcggcgtgtggcatcgtgcacccgtacgagtcctggttacaagtcggggttccattcgacgcttggcggcgggcgaggttgaccaaagggcgcggcgtcgcgtggtgggacgtgcacaggcagcccgggctcgtggcctggaagtgcagaaacccccgcatagagggaggtcccaagaagctcggttgcaactttgcggcgccccccacaaaggccatcgatgagcactcagcaagattgggcaccctaacaaagcccgaactttcaggttcggctcacgacaataccggcacttacagaatccaacggtgccctcaggattacctacacgcgccagccagactccccaactggtttcacc

SEQ ID NO: 609818 - DNA, 222 bp, Homo sapiens
  misc_feature (177)..(177): n is a, c, g, or t
aacacctcacatcaacacctaaaccctcacaccatctacactaccactgcctgcactagcactaccaccgcctgtactaccaacaaaatctgtaccctcaccatcaacacctaagaccctcaccaccatctacacgtaccactgcctgcactagcactgaccaccggcctgtactanccacgtgccaccaagattctacgggtttgatgatcctcttcctcc

SEQ ID NO: 609819 - DNA, 1301 bp, Homo sapiens
  misc_feature (215)..(215): n is a, c, g, or t
  misc_feature (235)..(235): n is a, c, g, or t
  misc_feature (448)..(448): n is a, c, g, or t
ggtcagtcagtgcgcggccaggtacgggccgatcgtggcccgcggcggtcctggcgaccgccatggcggccgtgcttgtgactttggactttggacgacggacggaaggctatgcgtgggtgcgatggtgcgagtccgagagcttcagctcccgcggactgctgtgtccccattgccggagttgagggcatgctggcctaggacgccgtgttggngatcacctattgaacgaggntggaggtcgtgaccttgtagtactcatgcgtgtgaagcgggtctggcccgagagtcggcatcgaggcctccacgtgcgtttgatgcttgcctgcgttgtagctaggtgcaagggcggcggctaatggcaacagagtgttccatgagtagcagacatagcggtagcaaaaggcatcgcaaaccctctagagcgcaaatagactagctagtagcncattcgacacatcgctccagtacagcgagagagcccaaacagtgtgttgccagcgacatgtcccataggcaccacaagcctactacaactaccgggggcactgcagccaggtaaacaaatctcctagtgagctccagctgcaacgacacgcacccctctacatctgtgggtggcgacaacttggcgcgccatatctgtgccgtttgcccaggtaccatcgggcttgcggcacagatcctcataacccgtcactacccttgtgggcatgcgcttcaagggtgtggttgagccggaaggccctccgtttccagcggtcgaattccttgcggaagggctggaaggcaggcgcggccaattcctttgccccgttgggtgacacgcactaaaccgagccctcgtgcgcctttgccttaaccccttggcgcccttggacgcagtctccaccgcgttgaggccccccctggtgacgcacccattgtgcttccccaacattcccccccaaggggggcccaattccaattccctcaaaccccgcagtggaaacccttccccaacagggcccgcggcaagcaaacaccaatccaatggcctttccaagtctcaagagcccctagggcgaccccatacctagtctcccaaccatccatttggcaaacccccgcgaacccctactctggcaggcacgcttccctttgccaccaaacgcgggaaagcgtcctcttcactttcccaacatgctacaggggcgggaccgagcccccgcggtctccacaccttcacacacaacagccctcatcttcctaggcgcggcgcgcaacccccaaccttcgcaaccgctctcccacttgtgggc

SEQ ID NO: 609820 - DNA, 104 bp, Homo sapiens
ctcaacgctttatacttcaaaataatacaattcctttaaaaatcaaataatattccttattatactcatttttttattccaagtttttggctacagtctgctac

SEQ ID NO: 609821 - DNA, 85 bp, Homo sapiens
tatcccggtcatcttgctacacgattacttcacttacttgaactactagccctactattaagagccacagcaagcttacatgttc

SEQ ID NO: 609822 - DNA, 241 bp, Homo sapiens
gcagatgcgcctgcccctgggtgacagagcgagaccctgtctcaaaaacaaaaagaaattggacagaggacctggcataagttcggagagtgagtggcagaaatcagagagtaaatcagatgatatcaggcctggtagaaatcatcaaagtgatggctttagtagtctcgcagcagccacggttctcatccttggctctagacactctttttagcacgtatgatatgaatctcgggattta

SEQ ID NO: 609823 - DNA, 999 bp, Homo sapiens
  misc_feature (255)..(255): n is a, c, g, or t
  misc_feature (387)..(387): n is a, c, g, or t
gcgctggtcgtctcatgccgtgtaactacctagtgaatcctgggacggccgaataccgggtagtggatcgatcgagcgtcgtcgtgcagagtcggcgatccatccttgcgtgaggcgaggcgtgagacatcgccgtggtctcatttttatcacattgggactgaatgtatccccggagcgggtagtatggctggcgcgccatagtacgatcactccagattactatggatagagtctgagagtcagcgcaagaantgtgcattcgaaccatcggcgcacggcagagacgttggcgtaaggaggtgacgcgccgtatgcatccactgcatacctggcacatgcctagagccattagacgaagtacccaacgcagagactcacctgtcntctggtatctcacacacaagttgaagcaatcagctaacagggaccttttgcttttaattgctcattaccctggggggagccaaaggcctgaacagcttcaacgaatgaatattccgtgggagggccgtgaactttacaagctctcagcggaagtatttccggagggggtcgaggatcccatgtatatggcattcccatgtgtaatctctctccgttacccgtcgaaactagccagacattgccagctcccacgcgtgaaccagcgctggtcaagtggcctggtatccgtcatcgcgaggggcccttgacacgcttagttggaataatgtttacagaggaaggatggttaaaaggggttagtaccaacgtcaggaagcctatacagtagtacaactatcgggggacacgcagagacgcacgtgcccaatgataaacctgattccgtcggatttactgttggaggaagggggtaacctcacagggggaaccactggtcggaatttgggtccaacagtgggcttcgaccagaagatcaccagcaaaatgctctgagtgagggttactttctgacttcaaaaggcaattgggaaagaagggcttttgaaggccagg

SEQ ID NO: 609824 - DNA, 341 bp, Homo sapiens
  misc_feature (42)..(42): n is a, c, g, or t
  misc_feature (48)..(48): n is a, c, g, or t
  misc_feature (96)..(96): n is a, c, g, or t
  misc_feature (115)..(115): n is a, c, g, or t
caaagtgttaccatgcggcattacaccataaattattttaanaaaaangaatttggggccggggccacgttggctcacgtctgtaatccccagcantttgggaggctgagacagncagatcacttgaggtcaggagttcaataccagcctggccaacatggtgaaaacctgtcttactaaaaatacaaaaattagccaggcatggtggcgcatgtctgtaatccccaactacttggcaggctgaggcaggagaattgcttgaacccgggaggcagaggttgcagtgagccaagattgcatcactgcactccagcctgggagacagagtgagactgtgtctc

SEQ ID NO: 609825 - DNA, 1369 bp, Homo sapiens
ggtccatatgctagcaattgagagactcaggtcttgtagtaaccatgttgcgagtagcgcgccggggcaaacaatcgagggtgcaagccgacgagactacttgtttgcattaattcgtgctaacaagagctaagcatactgagaagggatccttggtatgtagactcacttaatgcccaatagctatgggtcaagtaaagtgtgcctactgtgggagagatcactggatgcacaactcgcagaactctcgatggtaactgttaaagctgcttggactttcccattatgcgagctagtcagtcatgtgcgacatgcatgccatgtaggggctaacatgacaacacgccattctcactaaacgatgtactagtgctatacacgtacttatctgcaatgctaactgcttgttgctgttcaatccgtttgcttgctaactccaaaccataatacttatcgtccgaacggcagtgtactctactttcgagtcatgcaaatgagggactacacttattctacccagatgctcatccaatattcgagatagtgagccacaaacgtcgctattctaatggtgcccacggagtagcatatcgacttgaatccgtcaaagggggtctgtgcatggagattaagctatattagactaacaattgtcgtggagatgcacataccacagtgagggcacattcttccgcggaacatagtgcagcctgaggacaggaccctatagcggccacacacgccaatgctatagaacgtgtgaactaactcgtccaacagttgtgactaggttgcactcaagttaacaagttgccgcaaaatattttgcgatcaagcggatcgctccacattacttagtccggcgacacacttagcacaaggaaaagatttcgagactatacgagagaaactccccctatacatccctacacttcccctttaggcagggttggctcaaagggaatacttttactccccccacttgggatacccactggtctcgacttcaacgaacatgcggttaaaggaaaccgcgatcgaggacctccaaagctcccgtacaaccgtacaggaactggcggaacagttcacccacacagaaccgatgtccgcgaggatatacaagacggacccccaggtacagaacggcacagtgtttaacaagtggtaacggaataccaacccacatgaaaaagacgtagacaccccaccatggggcataacagcctggtgcaggatatcagcacatatctcctagcgggacacaggcctgcacacgacactatccgtccacacacacttcacaaccactacactgccgatcccaacgcggccttactcactccataacgacacgacccacatccac

SEQ ID NO: 609826 - DNA, 891 bp, Homo sapiens
agtttttgtgaaaaaagaataatgttcttgtggagcacctgagagtctcccatgaggaacagtgaactgagcctccaggtaattaactgcataggcatgttcagttcgcatcctgtatattttgcacatacatctagtattagcgacatacagtgtggagtataaaacagttacacccttggcagagagaactgccggtagccatgattttcgttagtgagaccatatttatgattcagttgcaattgtcagataggatgtgaacatggaaattcatggaaaatagtataattttcttatataaaaggttttgtatataatgtgtgtcagtgactatgtttcaaaatcatgttcatcgaagacaccttttttctaaaataggcattgcatacacatatgcacacgtatgtgcacgtgccacacattttttgtataaatgttgggtattgattataaaagtgttgtcaaatgttttgatttattcgtgcatatagacagtggttgggctttttctctgaattgtagaatttctatgcgcattgatgcacttgaaactaaggaaaattatttatctctgagcactggaaacttattttcgcatatttctgtaatattgcagtccccagatccagaacatgggaagttagggaaaatgtgtgattttgatgttgtctgaattaactgtcagtatttacagtacacaatgacaacaaacttctttttaaaagacagtttcattgtactgcaaaaatctgaatatttatatttcttgttctctttctttatatgttttgcattttaatgatgttgagccactggaaatttgtaacagattaatttgttataggagtttaaatgtgttgtcatgtctccgtgtcttgtcctgggctg

SEQ ID NO: 609827 - DNA, 138 bp, Homo sapiens
ggcgcctgtcacctggaacggcggccaagccgacttcacgatgccggcggccacgggcgacagcgcacaaaccgcaaacgcagtcattcgttccgaccgtatcccgctggcatctcgtgcgcgcaagtccggcgagac

SEQ ID NO: 609828 - DNA, 431 bp, Homo sapiens
  misc_feature (26)..(26): n is a, c, g, or t
  misc_feature (157)..(157): n is a, c, g, or t
agcgtgggcaacatggcaaaaccccntctctacaaaaaggtacaagaaatttagcaggcatgggcggcgcgtgcctgtagttccagctatttgggaggctgagttgggaggatcacttgggcccaggaggtgaaggctgcagtgagtcaagattgcnccactgtactccaccctaggcgacagagcaagaacctgtcttcaaaaaaaaaggaattcttagaaatatacaccagatattaccatacatatgaactcatatatagagggttataaacttttgcagatcatttacctgcaacattgttgattttactccatgaattctctattcacattgcatcatagtacacacacctgcaacccaaatataagtaattcctagacagctttgatacatccccagagattttatgtacaattcatccagctaa

SEQ ID NO: 609829 - DNA, 847 bp, Homo sapiens
gacggcaagtgtactgcgggctggtccgggctcctcaggttcagactcgacgcgttatccagtcggttcgtggagaggagaggtgcactttacaggtccccgagtgaacacaaaggagaaccctcgcaccatatccaggccctggtccaggagcgggcccatatccactcttatccatcactaggaccgaatgggtccaggaccgtatggggggacccgtacccacctcctcaagggtaccccgtatcgaaggagtagccacagtacggctgtcacgggtggacctcaggagcctcctaagaaaccacagggtatgtggtagaagaccaaaggaagagatgagctaggactcatccatccgtgcctcacagcctgttggaggagcctctctgttgctgctgtctctgtggacatgctcacctgaccagaccagcccagccgtcctgtccgtgccagctctgttgacagctctgacaggtgtgcctgccccatctcttctgattgctgttaacaaatgagtagctttgagagacgacctctaccttcaggtactatgggatctagattaattgggggtcgctacgtgttgactttcaaggtgacttggatctcctttaagtggtccacaatccgatttcttatcgatcttctacacgatgtgctaaatgatttttttggcaaaggtcagttgtgcaaaactataatttgagttataccttcagggtagtggccaatgtagaacatcaagctgggagccttctcgttacagcggccgttttcataattggcaaggcagtaaacaaaaaaaacaattgggggctccgcaaaaatttaaactgggggggca

SEQ ID NO: 609830 - DNA, 133 bp, Homo sapiens
  misc_feature (6)..(6): n is a, c, g, or t
ttcatnaaattaatatgccacgtttttttaactaggtaaacaagtaaaatgattatattccaggagaattgcttgaacctgggaggcagaggttgcagtgagcttggtgatcatgccactgcactacagcctg

SEQ ID NO: 609831 - DNA, 488 bp, Homo sapiens
  misc_feature (61)..(61): n is a, c, g, or t
  misc_feature (253)..(253): n is a, c, g, or t
  misc_feature (414)..(414): n is a, c, g, or t
  misc_feature (417)..(417): n is a, c, g, or t
  misc_feature (480)..(480): n is a, c, g, or t
tggtaaggaaattgggtaaggagcttccttccttctcttcccttcccttccttttcctttncttttcccttcttttccctttttccttccttccttccttcttttcccttcccttcccttcccttgcttccttccttccttccttccttccttccttccttccttccttccttcttttccttcttttccttcgagatggagtcttgctctgtcacccacactggagtgcagcagcctgatcttggctcaccanaacctctgcctcccgggtccaagccattctcctgcctacccagtagctaggattacaggcacccagtaccacgcctggctaattttttatttttagtagagatggggttttaccatgttggccaggctggtcttgaacttctgacctcaagtgatccaccntgntccgcctcccaaagtgtttgggattacagcttgagccaccatgcctggcctacactgtgaccnttttctta

SEQ ID NO: 609832 - DNA, 115 bp, Homo sapiens
gagaaatgcctggataaaggggcccatgtctccccccttggagcccttttgatggagatgaggggccgttgaacagaccgggttttgtgagtatagtggtttgagatgcaaagtg

SEQ ID NO: 609833 - DNA, 501 bp, Homo sapiens
gctggaagtggccgagacgccggaaggggcgtccgtcggtggctgaaccccctgcactgccggagctgttgtttaccctgcgctgcgccgtactttaccctggtggctgtggcggggtgctgggtgtgccgtggggtcccgtgtccatccggtacctgccactcgggcgcaagctacggggccatcgtaggaggagccgagggattgaaacgagttgagccaccgagcacaacggggaggtagaggcgccgggtatttgggccttccaggccgcctgcgcaaaccgagaatgccccaaggcactcgaacgatcttaagatcaaaacaccaggtgtggtggtagcgcggtaggaggaatcgcacggtagaggagaagaagccggacgtattgacgacctgagggagcatgacaggcccaccgggatgcgtggagacagggaattgacggaacgagtgggaaaatcggacgggaaaaggcacacagacccccaaggaggagaa

SEQ ID NO: 609834 - DNA, 925 bp, Homo sapiens
agcgggctgggcgacgcgctgtggctggcggtgccgtgctgggactcgtagtgcggtccgtgccgagacctgacccgcccgccctgcggccccgcagcagctccaagaaggaaccaatgagacctgaggccttccctgctgcccgtgaccctgacacctgccaccctctgctcccctgcctgtgcatgcctgtgcagccaagcggcagtgtgatctgacccctgttcttgctgtgcctgtgtctgctggccatgttggcccctgcgtgtgcagcctgtgcctgagatgaaccccatgtgcccccagtctaccccatggcctctgctctacgtgggggacctccacccgacgtgaccgaggcgatgctctactgaggaatgttcatgccctggcctgggcccatcctctccatccgggtctgcagtggacatgatcacccgacgctccttgggctactgcgtatgtgaacttccagcagccggcggacgcggagcgtgctttggacaccatgactttcgatgttatacaacgtggcaagccagtacgcatcatgtggtctcagcgctgatccatcacttcgccccaacgtggagctagcgcaacatattcattaccaaatctggacaaatccattgcatcctaaagcactgtatgatacctcttctgcctttggtaaccatcctttcctgctcacgtggctcgctgatgacacactggttccacgggctacgcgattcgtacccttcgaaacccacgaggctcctgcacaagctatcgcccaccccgcctggcctggcccacatgactgccaccgcatcggtggccgattcagtctcccacaacacgccagccgccctggcactgggcccaccctccgccctctcccttcccactcgggaacacatgctaccacaccccaccgccc

SEQ ID NO: 609835 - DNA, 911 bp, Homo sapiens
  misc_feature (1)..(1): n is a, c, g, or t
ntaagatatacaaagcggcagtttctgtacacggccttctttcagacttgttctgcgtaccacacaacctaggtctcacttcatacacatggaatatatcttggagcccgatttacaccagtgggcttggaccttggatcaatccaggctcttggtgtgccgccaaagaccgcgtgtccaccccacttctagggttcaaaaacctagaaaggggccacgcaatgtgtgacaccgcgaaccccaagatgctcggtccacatgactatttcatcccgtgtcccgagaacactaaattgggtgcatgagcagagcccattatggccaggtccccaaggctgccaaaaaaccctggggaacagcgccaaccgttttcagctctgggaatcgcgtggaacatacggctccccacaagagtgtatctggaacactccccctccctccgagtatattgcccccctttcttgaggagaggggaggccccatccaggaacaccaccgccaccttgttgaggcgtctgtgaaacaccaacgcccaatggcccccaaaagacgccacttgtgaaacgtgtttattggaaagaattccccgccttttgtagaggaaaatgctccaaggccgtgaccgattaaatggaaaccctctctttcccaggaagggtaaaaaacttggttgctgccaatcaaactgccctatggctttattatactatccccattttcaagcctctcctcccctctcccctgagattatgagaaagaaaaatgaagatcccaagcgttaattcaacctgtttttcctttttccggtggtgtaaaacccacccccccgttcgtaaaaacaaaaatttttttaaacatttcccccttttttttgggcttccattaaaaaaaaatgggaaaaaatttaaaaa

SEQ ID NO: 609836 - DNA, 107 bp, Homo sapiens
  misc_feature (3)..(3): n is a, c, g, or t
  misc_feature (30)..(30): n is a, c, g, or t
aanttcaaggcttctaacaagatgtacggnggacatgggtatttggcctttcttgattaaattctctgctcccctgcaaataaagcctttttacacatccaaaaaaa

SEQ ID NO: 609837 - DNA, 116 bp, Homo sapiens
aactggctctttcttcctatggaaatcctacatccgtgtatgctgagctggtaaaatactttgtaaattacttattaaatatttcattctgctttaacaagccgcaaggtgcaaac

SEQ ID NO: 609838 - DNA, 502 bp, Homo sapiens
cccacggggaccgagaccaccccccctaccccgatctgtgtaaaacacaaataaagccattgagagcaactacaaaaaaaaaaaaaaaaaaaaaaaaaaaaaacttgttgtgggcgccccgcccgcggcgcccccgcggaaaagagttttctaacacccactcggtgtggggcgcggcgcggggccccccaagagggtacggtggcgacaccggtggcacaagagggtgtgtttccccagaggggagaaaccggggcccaaggaacacaagcggcgcggggatcttctctcccacacaaaattaaaaacacgcgacgcgggcggagcacaacgcgaacgcgcgttcgcgggaaaacaactctgcagaagaggggaagagtccgggaggagaccactcatgaggggagcactcatactcaagcgaggggagttcactcaggacgacagcctgcgacattaactacaaatttcaccccccccacgccggggtgagccctcgagt

SEQ ID NO: 609839 - DNA, 793 bp, Homo sapiens
gcgggcagatcacgtggtcaggagatcaagaccatcctggctaacacggtgaaacccccgtctctactaaaaatacaaaaaaattagccgggcgtggtggctggcgcctgtagtcccagctactcgggaggctgaggcaggagaatggcgtgaacccgggaggaggagcttgcagtgagccaagatcgcgccactgcagtccagcccgggcgacagagcgagactccgtctcaaaaaaaaaaaaaaaaaaagattaattgggaggtcaccaaaaacgggtccaaaaaattccggggaaaaaaaagggactttttaacattaatttaccaaaggaaacctattacgaataatttgctgtaacggtgttacaccagtctttaaaatggcagctatatacgggcttggacatttttgggcagcaataaagataactttacccaagtggagattcatacagtccaggttttcccagatgcttaggagacgcacagtttggcctagcatttctgttcaagaaaggtttggcggtctgtggtgacataatcttacatgagttgtttctccccagaaatggagttctccacacgacacccttgggcaacaaggggcttggcgttgggggtatcccggtgcggccttccaaagggcggacctttcttcctttccaaattcaaggtcatggaaacctctcggaatttgagaaccttagctatgcaaaccttcattgctgaggaacatggtgaaagccccaccactttggcctagaagccttgcattggtaattttaactggt

SEQ ID NO: 609840 - DNA, 110 bp, Homo sapiens
aaacgagggctcttcggtcgggtcctcccacccccaggtaggcggcacggggttctctccttcttcttccggcggtccttacctgcgtcggggggtaccggagctcgaat

SEQ ID NO: 609841 - DNA, 224 bp, Homo sapiens
  misc_feature (2)..(2): n is a, c, g, or t
cncatagtctattatgctatatgataatataatagtcttctaggaaatcaccccttagagatagttggaagacctacatgatctctaactttggtgcattttaatctactaataaaatgaaatgggaagaaaagaacaaacaaaaggagttggcagggaaacagggtatttttttctatttcagaatgggtggaaaaatatagcatttttagggtttaatctgg

SEQ ID NO: 609842 - DNA, 200 bp, Homo sapiens
agggagggtgcatagtagttgagctctgtacatgtcgggtcggagtacgcgtatcgatgggcagtggagggggcgcaatatgcatcctaggcctataaatattccggagtatacgtagcgggtaatgttaacaaccgtgtacctctagaactatagctagcatgggcaaatttaaaggcggtgatatcgactcgggcgca

SEQ ID NO: 609843 - DNA, 285 bp, Homo sapiens
ttttccccttccccttccgggggggggggccccccttggccttaaaaccttcccccccaaaaattcttttttcgttgtttagggggggaaagttggggcccccctttttcggggattggttaaagccacccagggttaaccaccacccatttttggttgggggccccaaattccccttttgaccccaggattggggggttttcaggcttcttcttggagtgggggtttccttcaaccagttggggccaaagggaaggggtttattaaccccttgggggcctgcca

SEQ ID NO: 609844 - DNA, 195 bp, Homo sapiens
ccacgccgaaggtcacactgcacacgcgagcctccacactgcacacgccgaatacccatactgcacacgccgagtgtccatacacttcttgaaaaagcgaagtcgccgatcttcacggatcggcgatttggtctgctcagtgtgggctttcggcgtgtgcacgtgaagatcggcgattttggtttggtcgctcgg

SEQ ID NO: 609845 - DNA, 1174 bp, Homo sapiens
taaggggatcgtgggggggagaataacgagtcatagggaacccaacgggcgcgtttgaggaaccaatttcgcctcccctggtagtttcccttccttcaccccccgccacttgtatttttagccagaagacacctcttccgcggttattatcaaaaaaagggcttcttacagtcagtagtaatagggatttctttttgtcgcccttttattaaagggccgccatataaatccccattggggaggtcccgcgcgagaagtgggagcctcttcttccaaaggaagccagccaacgccctggtttgtaagccacccacccgtgcgtgttgtgtgtaagagaagatgggctaacgaatcaattgtaggttgtccaaccaaaaagagaaagcgcgggtttctcaacacccacacaacttgtgggtgcattttctgggacgggcacattttgtgatgaccaaaagggctcaaaggccgtgaaaaacaaacaggcgttatttttcgatggttatcatcatcatgtttaatcttccccccatgtatcgcacctgttgttatcggcaaaaatttgttgtttacccaccccggttttgtctccacacacgattgtatatttctacgcaagcactttttataatctccccccgagcgagagagtttttcctcccctctctcctatatagaataagaggcccctttttctcccacaaacacctttacgcccggtgacgtcctaccttgttagcaccataattttttagccgcccccccttcgccccggagtcccaggtgatgtgatgtgttcccgacgggtcgtgtcgccccccggtagattagcgccccgtgttagttgtaaaccaaatagatatattaaaaacaaacatgtggtcctgctttgtagatctttattactagatagatttttccccgttgtcctttacacacccctcttctccgaagtttcctcttaccccctccttcttttgccatccttccccttccccttttttctgagctagcccccagtccccttcattagcacttctctgctaagccaaaatccctttcctttcctcttttttttccccaaattttaccgatcctttctcccaacccctggccttccttttcttttttctcctcaattttcccccttaaggtccctttgcccccccctcca

SEQ ID NO: 609846 - DNA, 147 bp, Homo sapiens
tcgagtataaaatttttttcagtcgagcaggaaggctggtgccagcaggctgtaattgagaggaagaagttagatttaacaattgtagacacaccattaggggagttaaaattgtacagcagtgacatgttctactccaatcacttg

SEQ ID NO: 609847 - DNA, 120 bp, Homo sapiens
tgagatggagtttagctcttgttgcccaggctggagtgcaatgacgcatacttagttaactgaaacctacatctaccgggttcaagcaatcctcctgcgacagccacctaattagctggg

SEQ ID NO: 609848 - DNA, 335 bp, Homo sapiens
  misc_feature (108)..(108): n is a, c, g, or t
  misc_feature (187)..(187): n is a, c, g, or t
  misc_feature (271)..(271): n is a, c, g, or t
caactggtattctcagccataccatgggctcatattttagaaaccactcttgcccaggcatggtggctcatgcctgtaatcccagcactttgggaggctgaggcgggnagatcacgaggtcaggagatcgagaccatcctggctaacatggtgaaaccctgtttctactaaaatacaaaaaaattanccaggcatggtggcgggcgcctgtagtcccagctactcgggaggctgaggcaggagaatggcgtaagtaaacccaggaggcggngcttgcagtgagcccagattgcaccactgcactccagcctggacaacagagcgagactctatct

SEQ ID NO: 609849 - DNA, 576 bp, Homo sapiens
tagacggtgaccctctgcctgtctttcggtctccctctgatgctgagccaaagctggactgtactgctgccatctcggctcactgcaacctccctgcctgattctcctgcctcagcctgccgagtacctgggattgcaggcgccgccacgcctgactggttttcgtatttttttggtggagacggggtttcgctgtgttggctgggctggtctccagctcctaaccgcgagtgatccgccagcctcggcctcccgaggtgccgggatggcagacggagttgcgttcactcagtgctcaatggtgcccaggctggagtgcagtggcgtgatctcggctcgctacaacctccacctcccagctgcctgccttggccccccaaagtgccgagattgcagcctctgcccggccgccaccccgtctgggaagtgaggagcgtctctgccgggccacccatcgtctgggatgtgaggagcctctctgcctggctgcccagtctggaaagtgaggagcatctctgcccggccgccatcccatctaggaagtgaggagcgcctcttaccggcagacatccatct

SEQ ID NO: 609850 - DNA, 257 bp, Homo sapiens
atatatagtcatagaagatttgtggaaggagagctttcagaaaccaggcaatgtgaagaattcacctggaaataagtataaaacttcagggtctgccatcttaaccaggaaaaactagggcagacctttgttatcttttgtgaaatcatcgtacaagcaaactatcctggaatcccttcccctagaggtaatgttcaagccttagaactcctcattctcatgatgctatttatgtacataattataacccaagttaa

SEQ ID NO: 609851 - DNA, 524 bp, Homo sapiens
agacgtccattctgcatacttaaactatccctctcaaatagagccttccatttttaaatacgctccagaatctcatccattaaacagacacacacacacacccaactcatgagacctcaaccactacattcagtcatccccatcatggctaaatttctggaacttttcagtcttcatttcctcccttcccactggtccctcaacctgcttccaaattccatctccagctgtcagtaaggtcaacagtgactgacaggtaaatgcaaaagactctccaatcatcagcatacttaattctgccagcagaatcagatactctcctcctgggttcctgtgatacaaccttctcctagttttcctcctacttctccgctcacttctctgtcttataataacccatctttctcaattcaaccacattctaagcatatgactcacaaatctacagcccatgtcttccatcacactccagagtgtaatgcttgccctggatatcacaaaggtgtatcaaatccataaggtcc

SEQ ID NO: 609852 - DNA, 256 bp, Homo sapiens
atggtatttttatgttatgaaaactttgtttcccttgaaacagagttttgctcttgttgcccaggctggagttcaatggcacgatctaggctcactgcaatcattgcactccagcataggtgacagagcaagactccgttctccaacacaaaaataaataaaaataagaaaaccaattcactacaatggtagttttaatcttttgaaaactttgtacccctttaaatcagatttaagttcattatcgcccaggttg

SEQ ID NO: 609853 - DNA, 120 bp, Homo sapiens
ttccaagtagattttttttattagcctttcatatttttaatcgaaatgtcttgacagtaaattgtttttacaactacaaatttatgtgaaggaatgacggtgagggaatgatgaaaatga

SEQ ID NO: 609854 - DNA, 1027 bp, Homo sapiens
attagagtgtataattacaccaggtaaaggctggcaattggacttggtagctgtcacaggggttaggaatcacccagaagtgcaggcacaggcttcgtgactgacaccactcagtaggtcaagctgctggcttgtgcaacagctgcagcctccatgggcagcttgcatctcctccaaatagcagtgagttgctatcatgcaaacctggcatgtgcacacactgcaagtcaacacagctgccagatcattgactctttgtccagccagaactggacagcagcaaccatttaggctcactgcaagtgtgtcctgatgtccattgagcaagtgcatggctcaagcggcaactcatgtcttggcttatgtgaacatcatgtcaaatcatcttcatgcttcgttcctatcagataaccactttatcatacattctacaaacaaatggtctttgttaataacgttggagggcacaacaagcatacacagacggagggcaagagaatattgttccccaatgggatttcggcgataccctgtgcgccatccattacacatgtacccacgtggcatagggagagaaacgagcacgtcaggtacaacagcatatactcttccaaagatactttactcatcatctgtactcccttatagtacaatcacctggtacttcctgtagctggggagaattcattggcatcaaagcaggaaattttctatttaacaactttcgcacaactatgggggaccaggacacggctcaggttccatggatggctaaatccacagtgcaatttgggcgcagcggccgccgcactggggacacgcatgtaaatgggaagacccaggagcgacaggaaaaaccaaggacccggggccaacaaactagagggagaaaagcaaaacaaccaaacatagtacactgacaacacatccaacacacaacaacattggcgacaactgagcacgtacaccccacaacaagggcagggagacataacacagacaaaggagaaaggaaggggagaacacg

SEQ ID NO: 609855 - DNA, 889 bp, Homo sapiens
  misc_feature (887)..(887): n is a, c, g, or t
  misc_feature (889)..(889): n is a, c, g, or t
tgcagtggctcgcgctgtaatcccagcactccgggaagccgaggcggatggataacctgaggtcaggagttccagaccagcctagccaacatggcgaaaccccgtctccactaaaaatacaaaatgtagccgggcgtggtggtgcatgcctctaatcccagctccttgggaggctgaggcaggagaattgcttgaacccaggaggcggaggtgcagtgagccgagatctcaccactgcactccagcctggatgatacagcgagactccgtctcaaaaaaaaagagactaataggccgggcatgttggtcacacctgtaggcccagcactttaggaggctgagccaggaagaggctgagcccacgagttcaagaccagccttggaaacacagtgagaccccaatcttaaaaaaaaattagctgggcatggtggtgtgcacctgtagtcagtcccagctatgccagaagggggaggatcacttgagccgggaggttgaggttacagtgagcgtgctggcaccactgcttgagtgacagagcgagaccctgtgttttaagaaaaaaaaacggcagtagtagtaagagtggtacaggacataccaacaagggaggccttcggagggacattaaggtcacgaccaatctgatagaattttgcaggaatacttaagaagaacctactttatttgtggagagtaggttgggcatttctagttaataagagctaaatttttataactaatacggtgaatctattaattggaagcagggggggggaactgtcagactggccgcaggtcaccacgggaagaagaggcagcgataaatagagagagggggagaaacagcagaggggaaaggacacaataataggagtgagaagaggcngn

SEQ ID NO: 609856 - DNA, 398 bp, Homo sapiens
  misc_feature (192)..(195): n is a, c, g, or t
  misc_feature (199)..(199): n is a, c, g, or t
  misc_feature (202)..(203): n is a, c, g, or t
  misc_feature (205)..(206): n is a, c, g, or t
  misc_feature (212)..(212): n is a, c, g, or t
  misc_feature (300)..(300): n is a, c, g, or t
gatcagtggtgatgacacctgccccgggtcacccgcattgtgggtcactagatgggtgctgctggtacatcggtggccgtgtcgcagcttccactacaacccagggcaaagtgaagcattccatcttgaatcaagccgatattttccactgaaatgacttacttgctttggcctcttgtggctgagccgctnnnngatnccnngnntctggntgggctataaaggggctcctctggctggcaccattcttcagcccgtcctttccagtgtgggagggagccaagggagctcattaccagnggacaaaactggatgaatggggactcggctctgctggcaggctttcactgcggcatcatgcgacccggactcacagtgcagccagacggtgacccgtg

SEQ ID NO: 609857 - DNA, 451 bp, Homo sapiens
ggctggtgtaggccgtcattgtaaataataatctgttcttaactgacttgcctagctaaataaaggtaaaatactgactacagttgtggtaggtacaatatctaaactgaacaaaaaatataaatgcaacatgtaaaggtcccatgtttcatgagctgaaataaaatatcccccaaaaattcaataagtacaaaaagcttatttctctaaaatgttgaacaccaatacatttacattactgttagtgagcatttctcatttgccaagataatccatgtagtatatcaagaaggtgattcaacaacatgatcattacacaggtgcaccttgtgctaggaaaataaaaggccactctaaaatttgcagttttgtcacacaacgcaacgccacaaatgtctcaaattttgaaggagaggtcgacgcggccgcgaatttagtagtagtagtaggc

SEQ ID NO: 609858 - DNA, 170 bp, Homo sapiens
cccactactactgtaccaggtctgtattagtctgttctcatgctgctaataaagacatagccatgactgggtaatttataaatggaaagaggcttaatatgactcacatgatccaccatgactatgggagggctcacgatacatggtatgaaggcaaaggtagaagcaat

SEQ ID NO: 609859 - DNA, 327 bp, Homo sapiens
acaggacaacatatacacaacaaacaaggtgcaagcagtaactactactaatcaacgcacataatcatacaaagcccccgcacgcaggaggatcctcccgaatcaaccgctgacccctctcctacataaattatacagcttcctacactattaagagtttaccacaaacaccaccccatcatagtcttgcacccacagagagcaatcctacctccatcgctgaccccactaaaagcactcatcctggaccgtactcctaatcacataacctattcccccgagcaatctcaattacaacatatacaccaacaaacaatgttcaaccag

SEQ ID NO: 609860 - DNA, 336 bp, Homo sapiens
acattccttcttagaagacttgactggtcttacattgctgcatcaagaaaccccagctgcttagatttgggacatgaacgacgatgagaccattttagatggcccccctgtggggctgacttttccctggccgcctgctgaggagctttccatcgccaaagcaggactgctgaccccaggcctggtgattttgggcccctcctccataccccgaggtttgggattccccccttttctgcccaggagtggccagtgttcggcgttgctcgggattcaaaatacccccagttcaaagctaaataataaccttggccttggccttgctattgccctgga

SEQ ID NO: 609861 - DNA, 1644 bp, Homo sapiens
  misc_feature (288)..(288): n is a, c, g, or t
  misc_feature (304)..(304): n is a, c, g, or t
  misc_feature (435)..(435): n is a, c, g, or t
  misc_feature (496)..(496): n is a, c, g, or t
  misc_feature (723)..(723): n is a, c, g, or t
tgtttctggagagtagtgcgggctagcaggttgtctaacatggtctgcaccatatggacgagccatgctcaacacaggatgccatatgcacggatgcccatctatccctctggttcgagcaacacgtcttggtcgcatgatgcctgggctgcgtggtgccaatggctgtgctggtgtcctcgcacatgtgtcttacgaatctaggatgctagtgacacaatggtgctacgcctctcagagcgagtctctcacgtgtccaatgagtgtcgagtggtccatgtcgcgagnccagtattctgccccnaaggaagagtgagtgcccaagacaacgggtgagtgtgatggacctaccctctgaggtggtgcctaccctgtcgagggcgagtctaacttgcgtggccataatctgctgctagaccgtaatggcttggcgtnatgcacatcgtcggacgccatctcgcttggctccaccgataggatggcatccctccgtagncagacggatcgtctcgctagcagagcgtgcgtagcggagagagccgtagcgcacggggaggcagcgggagcgtccggacatggtgtccaaaggcgtcctacgtggggaccagaagggtcctagatcgtacggaaaggccgcaatacgtagctatggggcccgcaaaagagagtgtacggcgctatgggcagagcgaaatgtgcctcgggcgcagtaaatagtacccncacccgctttttagataacactaagggcacacacggtgacaataatcgcgaagcacgggggcgatcgcgaccgaagacgcctttgggattagcgcccaggggatggcccttgaaagaagagccaccgctagcctagagggtagccccccttagtgctagggttggcccaccgtggatggtggccgtggggcgaagggtgtacgtggcccgtggagagcgggggtgcgttgcggttgaggcccctaggggcgcgtggcgttggggcatggggtcgcgttgcctttgggcgaaggcgaattgggggtcctccggcgcattcgacattttggtacccctcgagatccacacttctcgccctaagtggggggaacagaaacccctagcttgtggtcgcgcacacattggacaccgttggcccgtatttccaaaacatagagcgcggggccacaactacctatggggtccgagaggacaatatttccctgagggaacccaatatatcacacttcacccaagtgggatgcgggtccgaacaccaaaaggtccttgggtggctggaaccaaagagcactcggggtgttggcgcccactcacacaggggcgccaccacaggaactcggcagccccctgggcgtgttttcgccatggcacctgtctgttctttaacaaaatgttccgggtcttgaacacaccgcgtggtgagtggaaacaccacccgtggttgtctgaaagccgcgctttttgtaatacatccaccctggctacgatacataacgggagaacactctcggttgtgatggtagacccctggattggtacaacgtatcatcaaggcccgcacactgaagggggcctctgcggaagtcgtcagcctaccgcaggccctatgaccctttcggtgtaataactcatcgctagcag

SEQ ID NO: 609862 - DNA, 242 bp, Homo sapiens
ccccgggccccccccccccccccccggggggggattttttttttgggcccgaacggtttcccaaaaacccccggccgttttttttggatggggaaaagggtaccccctttttttttctttaacccttttgggggggatttacccccggggggtttttcccaaacggggttttttttatgttccaacccccgggatttccaattagaaggggtccccaaaaatttaaattttttgatttggta

SEQ ID NO: 609863 - DNA, 968 bp, Homo sapiens
ggccgtggctcgtctgtggggggcgaacacgccgggtcctcgtccgtgtgcagtggctcacgcctgttaatcccagcactttggaggccgaggcaggtggatcacctgaggtcgggagtcaagaccagcctgaccaacatggagaaaccccatctctactagaaatacaaaattagccaggcatggtggtgcatgcctgtaatcccagctactcgggaggctgaagcaggagaatcgcttgaatccgggaggcggaggttgcttgtgagccgagatcgcgccatttccagcctggcaaccaagagggaaacctccgttctcaaaaaaaaatcaccacaagcgagggatgagaaaaggaacaacatctaggtttcacaccccagggccattgtgttgaccgttaaggaacttcgtgccgacaggaaggaaacgggggcggatcacataaatgcaatcctccaccacaggcgtgggggggcacaggcgggcagagctcccggtccccagggcacccgggtccacaggggtcatcagaaaccttgtggcccaacccaaggagaaggcccctttttacactacccacaaaagggcctgtgggacgaacttgtcacgacaaaggcgcaggaaaattccctcgtgcgaaactgtggatcataggctaatcaagtgggcctcccaggcttaaacgaggttgcgaacaactggctcggaatgttggctcggactgcgaaaacctacgtcgggtcggggtcaacagacgctggagggtgacagaagggcgggtcaacccccattgaggcagcgggggggattaccccccttttacaggtggatactggcgtggaggggaccctatggtggccagaaatggacgcagggggatcacacgtacaaacaaccaaagccagtacagcgatggacgcatcgctgggctgtcttcccggcacatttgcttcccgagattagtg

SEQ ID NO: 609864 - DNA, 1886 bp, Homo sapiens
  misc_feature (574)..(574): n is a, c, g, or t
gctgaccttcatgacgcctcggactccagcgccatggctgctccctccgaggaagttcttcgtctgtggcggaaatctggacacgattgaatcgtggctggaatgcttatgtcgtgggcggagctcactctagtagctctgatagcggctagagccaatcggtgccagagccgatcacctgagtgtgagtcttgttgctccaccgctacttgcactattactcgaccttcgtcgcacgtgtcatgccaatgctacgatcctcaaatgcacttagcttgctgcgacttggcgccatgcacaccatgccctcatcaacagagcgatgcaccgttaaatcgggagacttattcagcatgggtgcgaagcattctacgccctcttgcgtctatgcaattcaaacgtacctagtctgggagcaccacagatgggggttgcgtgtccatgcgtgagcgcagcttcacgaagcaggacatgaggcagtgggtctctagagtgcgtagcatcagtacttgtaagcactggactttgcgcgcgcacgaatgtgaggttgcgcctcccaatgcactacgtgggncaacgcatggtgggaaaccttgcgccgtatgcattaccgatcctgccaccgatgatctacttaggtgttgcggaactgcagatgcgcactgggaactttgggacaatcgtgcgcggcacacgaactttgcggcctcaaatccgaaccttcgcctgtcaacgaggttctcagcaatacgcacccgactgcgctctgacaccaaacatactgagttccaaggttctttgcgttcacactctcaaacggagtttgaaagaaggacgtatacattaggaggaacagcccagagaaagtggtcccagaattatttgcctcgcgcggggacattccaagtgtgcaatgaaccaccatttgccttagacattcgcggcgacccctactattacagaggcctgagctttgtagacacatcggagacagacacccgtggcggcggggacttaaactccaccctctaacacccgagaggtgccaaacactagggacgtttcacatgggtgagcacacaatgcgctaggcgttgcagggaatgttcctcaggaaaacgcggacagatggggcttttgtccaaaatgggtgcccccaaaatgccggttttcactccttaggaaagaatagtgtagaaggttgctgccctctccatgacagagaaaaattcccctgatctcgattacaaatttcagaggtgcgcccccggcggcacttttcttagctgcacgtattgtaggcggaacaccagccacatgtccataaggggcgtccgcccatttcgttacagcaagggacacagaacacacatatgacactgatatcggcaacatgtgggccattgcaccacattaggataggagagagattaagacaagtgaccttacacacacattacatataagaacgccacgtacaaaatgttgcgcacgggcgacagtgatttgacagcatcgaagcaggggcgccagacgaagcacacagaggataatacgatcgccgacatgtaccaatacatgttcgagccacataataagcccccagtatcccgtgtgcaacaatgaagagacacaggaggaacacaccattagttgacagaggatacacaaacaaaacaggaggacgcgagcagataaccacggctcgccagctaatatccccccgatgcacagtcagtgccgaacatggctaaagaagatagatccagaccagcggacgagcagactgaacaaggtcgggacgacactaatagacacacgaatagcagcacgactgaagatcgcacaagaaacgcgaaggtagacagcaatgactagagcagacg

SEQ ID NO: 609865 - DNA, 282 bp, Homo sapiens
ctcccctgctccagtcccctggaaggggctgggtgctggggagtgggcctgccaacaggcagggtcaggcgaggttttctggaactagccttagcttctcaaatgggccttaggacacagcccatggtgggagggggcagcgccaggctggctctgaaagccaaggaaagctaagaactccacctctaggcccctgaagcatggtcagcgtgggtgtctggctggatggggtggggcagtgaccccctgaactattctacggcttcgtcggtcaggataccg

SEQ ID NO: 609866 - DNA, 625 bp, Homo sapiens
  misc_feature (42)..(42): n is a, c, g, or t
  misc_feature (198)..(198): n is a, c, g, or t
  misc_feature (200)..(200): n is a, c, g, or t
  misc_feature (208)..(208): n is a, c, g, or t
  misc_feature (250)..(250): n is a, c, g, or t
  misc_feature (258)..(258): n is a, c, g, or t
  misc_feature (263)..(263): n is a, c, g, or t
  misc_feature (321)..(322): n is a, c, g, or t
  misc_feature (344)..(344): n is a, c, g, or t
  misc_feature (370)..(370): n is a, c, g, or t
  misc_feature (377)..(377): n is a, c, g, or t
  misc_feature (401)..(401): n is a, c, g, or t
  misc_feature (407)..(407): n is a, c, g, or t
  misc_feature (415)..(415): n is a, c, g, or t
  misc_feature (455)..(455): n is a, c, g, or t
  misc_feature (546)..(546): n is a, c, g, or t
  misc_feature (620)..(620): n is a, c, g, or t
tgaaggttttacgatgctttgttttcattagccagtcttttnctactggacttgaatggccggttgcgttaaacagttctgggaccgttcttccaccactgtttaagagtggggtggcaggttttaggggtaatattcgatttagccttctgagctttctgggcagacttggtgacctggccagctgccagcggcctncntgtccacngctttgatggcacgccaccggcaactgtctgtctcatgtcangaacagcnaaagnggcccaaaggtggactagtctgagaagctctcagcacacatgggcgttgccgaggagnnggatcaacagtggcgagcatcnccagacttcaagaatttagggccatnttcgagngttgtggcggaacggcgatgaggnttttcngtcagctnggcgaacttgcatgcaatgtgagcggtgtggcaatccaanacaggggcatagcaggcgcttatttggcctggatggttcaggataatcacctgagcagtgaagccagctgcttccattggtgggtcatttntgctgtcaccagcaacgttgccacgacgaacatccttgacagacacattcttgacattgaagcacacattgtcnccagg

SEQ ID NO: 609867 - DNA, 653 bp, Homo sapiens
  misc_feature (653)..(653): n is a, c, g, or t
ggccgggcgcggtggctcacgcctgtaatcccagctctcagggaggctaagaggcgggaggatagcttgagcccaggagttcgagacctgcctgggcaatatagcgagaccccgttctccagaaaaaggaaaaaaaaaaaaaaaaaaacaaaaggacaaaaaaaaaaaaaaaaaaaaaaaaaaaaggtgggggggcggccggggccccggagaaaacactttttaaaacacacatcgcgggggggcgcgcgggggccccaagggggtaaggaaacacgtgggccaaaagcggggttcccaaaggaaacaccgggggcaaaaacaaagggggggggtctctctccaccacaaataaaaaacgcgccgcggggggagcaaacgcgagggggtctgtgaaaaaactcccaagagaggggagtccgagagaggggcccaaacgggggcctcttaccacaagggggccccagggaagaggccaaggatactcaaataatatacccgcccacgggcccgggggggggggagcaactaacggcgcaggcaagaaaggggaggcgaaaaacagagacgcaaccacaaacaacacaaaggcggagaaaccaagacaaaaaacaaagacacaactgaaggaggacaacggagacaaacacggn

SEQ ID NO: 609868 - DNA, 159 bp, Homo sapiens
acgtttaataccttacaaaacctgaaagatgctcaataattcagtcacagaaggacaaatgctgcatgattccacttatatgagtttttgtaaaatagacttatagaagtagcaaatagaatgtgattgctaagggatgggggagggggagatgagttg

SEQ ID NO: 609869 - DNA, 205 bp, Homo sapiens
  misc_feature (39)..(39): n is a, c, g, or t
aaagggggggggggggaggggggtggccggctttggtgngtgattttttttttcttctttggtcatggggggcgaggggaaagggatgaattttccccttccggccttttcaccccccgggcctgttttttttttttgggaaaaatttccccctggctttggggccccccctttttttttaataaaaatggcccggggggtggga

SEQ ID NO: 609870 - DNA, 316 bp, Homo sapiens
actagaggactcggctcattcagttctttgagataagctcgatctatctttttggatagctggattcagtttgctagaattttgcagaggatttttgccatcagtattcatcaaggatattggccctgaagttttccttttggtttttggatctctgcaaagttttgggggcaggatgatgtagcctcataagaatgagttaaggaggaagtttcctcctcttcaatttggttggaaataagtttccagtaggaatgggaacagctcttctttgtacatttggtagaattcagctgtgaagccgtctggtcctggg

SEQ ID NO: 609871 - DNA, 198 bp, Homo sapiens
  misc_feature (123)..(123): n is a, c, g, or t
ccctgtgtatgcacacctagggtcagttttgcaggtttaagccatttaccaagatagttgtaggtaaagaagggcagatttattagaagaaattgctgaaacatattgttggacagtgggccnagctcagcagacgaaggggctacctgcagagaggcaagggctggaggaaagttttatagggtcctgctgaagggt

SEQ ID NO: 609872 - DNA, 178 bp, Homo sapiens
aagccaccttcctattcctactgacactggcgtacttacttaaaaaaaacttttcattgtaaaatattgcctatgtacagaaaacatacatgatcaacttaatgaattatcataaaatgaacacctgtataaacagttctttgatcaagaaattgaacactgacagtaggcaatattt

SEQ ID NO: 609873 - DNA, 309 bp, Homo sapiens
atggcatgtagtgatgacactctggacttccgactcaacaggattcctgagcttgaacgtgcatagtaccacaattctatgaagaacctactgccccagtctttgcacggattaatagcttcgctgcctggctgttattcttccgtcatatagggctttctcatcgaccttaggattgctacgtggttcagcttactgtcatgtagaatgtcctcgctttgtggcttccttagtctcctgcccttgccttgaagtcccagcattgatggcagtgcctcatcttcaacttttgtcctcactacatgccat

SEQ ID NO: 609874 - DNA, 119 bp, Homo sapiens
agatgggaaagttgctgagacaagaaatgcctagtggaattatagtgctagatacaaaattcacacagtgaaagtgcacggactctggggacgactgggaagtgtcctcagccattcag

SEQ ID NO: 609875 - DNA, 617 bp, Homo sapiens
ggatagcagaacagctatcaggaggccatggaaatctagaagtgagagtagatgacattgagggatgtgtcccatagaactctctccggaggagtaggcaatgtctgaacactgcacagcaaaattaatataggaatgtgatgtaagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattctttgcaaaaagtattactgagaaaatatgaaaactgtggacatgagaatttacagttaagaaaaggttgtaaaagtgtggatgagtgtaaggtgcacaaagaaggttataataaacttaaccagtgtctcacacactgcccagagcaaagtattacaatgtgggcactatttgacagtcttctataaatttttaaattcaaacagacatacgataagacatactggaaagcaatgcttcaaatgtaaaacatgtgtcaggtcattttgccatccgttaacacaaaacccaac

SEQ ID NO: 609876 - DNA, 105 bp, Homo sapiens
ggtcactgaggtcatagaggtcacacgctcatgggagcttaggaggtcaaatattcacaggctcagaagatcatgaggcggtcacagggtcaggaagccatgatg

SEQ ID NO: 609877 - DNA, 185 bp, Homo sapiens
catgctggtcccccgtccgattgccatgggctgctgcttgtgctgtgctgactgctctttctccttctgcggctgctggcctcagctttgtgcttgggacagtgactcggcagtcagcacaaaccagtactccttgtgagcctgcctttcatcagtgctgatcatggtgccatctgggacggggt

SEQ ID NO: 609878 - DNA, 399 bp, Homo sapiens
accaggctgtaactctctatcacccccataacagcacacacagagatacaagaatgaatctataacagcatgatcaattgtatgtcagtgtaaatggattcatatctagtgttggacgataacgtgatgtaatccccaacaattgtaattgtaagtccttttgattctagccatcctgataagtgtgaagtggtatctaattgcggttaagatatgaatattcccccatggctaatgttgcacatttttcatgtgcttatagtatgctatacacttttgtaaagcttcgtcccctgatatgatactcttgattctctctctgtatccaaattgacttgagaccagagcatgccaactatgttattaggcaactagaaagaaccaggaagataactacta

SEQ ID NO: 609879 - DNA, 181 bp, Homo sapiens
  misc_feature (176)..(176): n is a, c, g, or t
ctaattaaaagtgcatattccttttcaatcgcattcttgatcaggtcttcgttcgtgccgttaatgcctaacgattccagcgcgattttaacaatatcaaccgcaccagacttcttcggctcggccgctagggattgtgtcacacctaacttttgcatggccacggttgcagcctnagcaa

SEQ ID NO: 609880 - DNA, 286 bp, Homo sapiens
taatttaaataaaatttgttcgggggataaaatggggttgcccgtgaagaaaatttaaacccccctctttcaggtaccgggttagggaaaaaaccatttcccctaggggttcaaaaccttttaaagaagcggtttgtcttccggttcaaaaaaaagggaggtttgggctttttttctgttaatagggctttttccccttgattaaatgaaggaaggtttctttttgaagagatttattttctgtaaataaaaattcgttgtacccataaagttgggttttccctca

SEQ ID NO: 609881 - DNA, 192 bp, Homo sapiens
ttatatgttcgagtccctaaaagagacacccaagatcccccggcaagacagtgataattgacactatttttactttacggtagacgtgtgcccagaccaaaacttctttttccccctctaacatatcaatcgtacattgacaacttctcgtatttgttaacggttgtttatgaacgttttttacagtagttt

SEQ ID NO: 609882 - DNA, 131 bp, Homo sapiens
agcaaacatcctggttgcatgtttttcaaccagtcatcaagcatgtcaggggcacatcatggttttcacacagcccttttcatcattctgtcttcatttgattctgaataagctaagttggtcgcatcatg

SEQ ID NO: 609883 - DNA, 1275 bp, Homo sapiens
aaaaaatggtggtcgaggctggtttaattggcacggaggagagagagagagagagagagagagagagagagagagagagagagagagagagagagtagtagtagtagtagtagtagtagtagtagtagtagtagtagtagtatgtgtatgtatttgagtatttttgtgctgtgtgatgtgagatgacatgagatattattcatcatatttattatcatgatatcatgatcatgatcatgcagcagcagcagcagcagcagcagcagcagcagcatgcgcatgcgcgctgcgccgcgcagcgcagccgacgagagctgcgcgaagagaagaagaagacgagacaagaagacagctgccaggccgacatgatgactgatgctcgacacttgacagaagcctacatgcaggacgactgacgcctgcatgcactgacggcacgactgacagactacaatcagatcagaaacaaccacaagcgacaatcgacaaacaacgccccatacatgcaacatagcaatcaagtccattaattagtcgttcgttcgtcgtccggttcgtccgtcgtccagtcattcgtcgatcatcagtccgttcttcgttagtcgtcatccagccagtcagtcaagtcaggcaaggcacagcacgcccggtacggcacgcagtacggcaaggaagcacggagggacggaggtaggtacgttcgctcgttccttcgtcgactatacggaggcatgagcagtgccaagtcatcgctaaagacatgcgtacggtatactcagctataaccacccctagaagatcatatcagatacggaagatatcacatttcgcttaacatttcttaggtatagcgtatcgcaattcgcaagcgtatgaactacgacaagcccaggacagcgcaaggcaacgaatagccccgcgattgacaagatagcatgtagacagagccgacagagaaaggattgaaaccaacgcgaaatatagtacaattctatccataagaaagcgtccctaccaccttatccagtccatcacataacccacaactaaacacacccactcaaacactaacgcctatgtcccactctttcctcctctcactttcaccactcttactctttccttatatacgcactctcaccctctctcatcaatacacacaatacactcccatacgaactaccaaatcaaattctatcacaatacgtacacactcatcctccatcacactcatcttacataaaattaaaattcacaatacacttcctcatccag

SEQ ID NO: 609884 - DNA, 93 bp, Homo sapiens
  misc_feature (34)..(34): n is a, c, g, or t
  misc_feature (38)..(38): n is a, c, g, or t
caatcactgacttgccccaggctccggtgtgacncgtncagcttatcgacagtgacgctgtaggtgaagcggctgttgccctcggcgcggatc

SEQ ID NO: 609885 - DNA, 135 bp, Homo sapiens
  misc_feature (133)..(133): n is a, c, g, or t
cccactccaccttactaccagtcaaccttagccaaaccatttacccaataaagtataggcgatagaattgaaaccttgcgcattagatatagtaccgcaggaagatgataatcataccacgcatatatagcangg

SEQ ID NO: 609886 - DNA, 476 bp, Homo sapiens
gtactggcactctagtcatttgaaccgggaggcagaggtagcagtgagctgagatcacgccactgtactccagcctggggatagagcaagactatgtctaaaaaaaaaaaaaaaaagaaaagaaaaaaagaaaaaaaaaaaagatttaagtttttaatatttatttttcttcttattaaattgatccggccttggtggggaaaaaaaaacaatttggaaaaactccagagattgggatgtacaaaacaaaactttgccaccatccaagagcgacagttaacaattccttgggtatatcccagggtggtgagcttggacaaaccagtacggttaaaacttttacccacattcatcttccaggggtctggattccccgggtacagtcacttatgggccggcctcggggtgaccaagtatcatcgggggtcaccatttacaaggcggcgggcacacccgggacatatagccggccccaa

SEQ ID NO: 609887 - DNA, 406 bp, Homo sapiens
cggcacgaggtttatcagtctcttttttgccccttttctttgatataatgtgaattaggcttcttagcgaattacctgtacacattcttaggctacaaattttggcatgttcaaatttatcaaagatttaaaaatgaggttgttgaattttaaaaatgcacacattcagttttaaaaacacagacacagtaagtctgaaggaattaaatcagtgtgcaaaagttcatgagcaatcatttaagtcttgtgattacatttttaaaatgtttaagtatttagaaatttaatggtcgggtgcagtggttcatgcctgtaatcacagcactttgggaggtcaaggcaggccgatcatgaggtcaggagttcgagaccaacctgaccaatatagtgaaaacccatctctact

SEQ ID NO: 609888 - DNA, 350 bp, Homo sapiens
  misc_feature (79)..(79): n is a, c, g, or t
  misc_feature (242)..(242): n is a, c, g, or t
  misc_feature (261)..(261): n is a, c, g, or t
  misc_feature (272)..(272): n is a, c, g, or t
  misc_feature (315)..(315): n is a, c, g, or t
  misc_feature (340)..(340): n is a, c, g, or t
tcatcagtttacatgatatttaaattgtgaagaacaataaccagtacaactggcataaacaggtttgggcccagcgcantgcttccttaccagggcatgcagctcagctaatggggtacaggggcgttggggcataccaggggcaaggctggtaggctccaggggttcacaacgtgttaagttcattacatttgccaaggggatggggaagtgttgactaatgctgtgagcctaggtaagtnggagatgggcactcctccngttaatttccnccagggcttctgtgtcttggaagttttcgacccactattgggnggaaaacaaggcaatttggggtttnatttggggtt

SEQ ID NO: 609889 - DNA, 1095 bp, Homo sapiens
gctgaagaaccaagttcaggcttcatctttggatatcaacagtactccaagtcctcttgtctgctgttgactgactttgctaaactaccacttctacgacgagtgacagacttcttactcttactgggacgtttactacttggacacgtgtaactgccgaaccgacacgtgaactgggacaaacgactgacgcgcacgtctctgacctactgaccgctgggttaccactacgaccactcgttttacgacgggacacgacttgaacgtttgacacttactgacactggttatcaaaacagcagactatttaagggaaccaggaccataaacgacacgttccacagaccaatttggtgtacgttcagacacttacttgacgcaacaatgggtcatgtacatgtgcagcatgaggacacaggaagaccaggtcgtttaggaaaaacctaatggagcctgtggagcacacaataaattagccagcaacatagctattcatatccacatgccagactggactgctgcacagcaattcagcatcacacaccgaccctcattatatctaaatacgcgcatctatggttgcacaatcacgttgcaacgacccaactgacactactttaacggtactggagtaacccttaacgatggtagcgtctggggtcaactaacgatcagagggccatatctacgacacgccttggttaactcctacaaccaaggggtcacaagaagaaacactgggcaacaacatggatgggatcgtcatttactgcacttgggcctaacggtatggaactccatatatccccggaaagaccaagttgtatcaaatcctggagctggacacaggtaaaaaacacaacgcgtcttatacaagaaggacacacggacagcaggctcaccaacaaacccaaccgatcaaccgattggaacggggccaactacatggacacatacgccaattgaccacaaaggaccgtaaatggatgccacaatgacaaggacaccaacacgacaaagcaaccacgacaacggaaaacacaaagaggacaaccaaacggaaaaacaccaggcgcgcacaaagggagcaaggaa

SEQ ID NO: 609890 - DNA, 123 bp, Homo sapiens
gcagaggcgtgagactccagatctgactccaaattaccctgggtctagaattcagcctatcaaatatcttctgattttagactttgccttatacgtttctctggattttagatctataccacc

SEQ ID NO: 609891 - DNA, 103 bp, Homo sapiens
taaggtttacacattttttctccccccaatttttttttggggaaaaggggggggaaagggggggggggaaaaagggggggggggagaagggggtccccccccc

SEQ ID NO: 609892 - DNA, 546 bp, Homo sapiens
tgactagaggacccttcaggagagagtctgtgaaacattctctgtaggtgcgggacagtctggtggctgaccattaacgtccactccagcaccgagtgctggacacttggtggcttctgttcaactttcctggcttggagcccagatcttgtctcatgagcagagtaactactgaggaggcttctcagatgggaagttggttttaagccagaaatctggagagatgtcatgcccggcagcagcccccacgggccccggcctttgtggggcagtgtcactgtctggtgttccaccagtacccatgctgcaaggagtggggcttggctgctgtggttggcttgtccttcagtggttttccagattgtgtgcagttatcatgaggagtttgttgctgggagtttacaggaaaagggaggaaaaggcatcgcaagttgtccagtccattgaggatgaaagtacgtcactcagggtgaatagataggttgggacgagagttgcctgtatacagacagtgcctggtatcatatttttggggggactttaagc

SEQ ID NO: 609893 - DNA, 391 bp, Homo sapiens
aacgcgctgatagcctccgtactaaaatacaaaaaattagccaggcatggtggcgcgtggctgtaatcccagctactcaggaggctgaggcagaggaatcgcttgaacctgggaggcagaggttgcagtgagccgagatcatgccactgcactccagcctgggcgacagagcaagactccgtctcaaaaaaaaaaaaaaggaaaaggaaaaaggaaaaaaattttttcagtttaccccaaattgggtggtggaaaacggggggtttatttttaagcggggggggggcccaccccttatatccccaccttttggggggcccgggccaggggactcacaaggccgggaaatggaacccttctgggttaacaggggaaaccccccttttttcct

SEQ ID NO: 609894 - DNA, 502 bp, Homo sapiens
ggtcgactgcgtcctcttgagatcatcggggtggtgccgctgatagccagtacctctcggtcgtaatccttgcccagccggatcagcgcgccgtcattccgcgcggcgacaacaaatggccgttcatcaaccaggccagccccccaaacatggctttttccgacaatccttccacgatggaaagttggtcacgcatcagttcttcgagtccggggtcgcgagccatgagtcgtaccttcctatgccctagagcttcctgccgaaacgaaatgatgctccgtagccgagtcgggtaaatggttgctgccatcttccctcagcctggaccggaagttccgctatggggctgggttctgtagaggccgcgcttttgcaattcaggaatgatcaactccacgaagtcttcaagcgagccgggactgatcaacggattgatcatgtagccgctggtgccggagatacgtgcatgctcctcgaatcggtcgacgacttgttgcggggt

SEQ ID NO: 609895 - DNA, 210 bp, Homo sapiens
  misc_feature (122)..(122): n is a, c, g, or t
attatactttaagttttagggtaccatgtgcacaacgtgcaggtttgttacatatgtatacatgtgccatgttggtgtgctgcaccattaactcgtcatttacattagggggagggggtgcnggattccagtgactaaaggaaccattcaattttattaattctctgaatgaggggaggttttaagatttaacgaatatatctgcgtctc

SEQ ID NO: 609896 - DNA, 143 bp, Homo sapiens
cgcgggcacctatcctaagtctacgattgtgtgtgacgaaggtaggtttccccaaggaccacattgtctcttttcaccaatttcccccgactcctcttagctaaccgatcattctgcgccggcggtacccgagctcgaccttc

SEQ ID NO: 609897 - DNA, 651 bp, Homo sapiens
tggagacagagtctggctctgtggcccaggctggcgtgcagtggtgtgatctcggctcacttcagcctccgccacctcaaggcagttcaagcaattctccgtgcctcagcctcccgagtagctaggactacaggcgtgtgccacctctcccggctaattttttggtattttagtagagacggggtttcaccgtgttagccaggatgatctcgatctccgtgacctcgtgattcgcccgcctcggctcccaaagggcctggaattactgggcgtgagccaccagtgcccagcctcaaatatgtttttaaaaaatatcatggtcctcctcctcttaagattttttaaagttatttggtcaagtacttaagtagtctggctcaagtacttgtgtttacaattaaaatggatattatagcatttaatagaagaaagtggtttatggtttatccaaaaagaatgtcagctatgacctgttgtagacttaaaaaactacatgtttcgtgaatatttatacatgtggaatgatcttggaaatatccaggattcttagtaatgtatttccgtgaataaatgtctgtttcatgaatttctaacttacattgtgtggggtcttctgccaacaattgctttataattgtggtccaacagttg

SEQ ID NO: 609898 - DNA, 1038 bp, Homo sapiens
  misc_feature (182)..(182): n is a, c, g, or t
  misc_feature (187)..(187): n is a, c, g, or t
  misc_feature (209)..(209): n is a, c, g, or t
caccgctgtgaaccacaacaacttggcttctgcacgcgcgctcccccggggtatgatccattctctcgctggtcctactatatgggtgtgttctacatataattccagcctttcggtttgtccctcttcaagtgatagggcggaccttctctcttatatttaagatttggccttccccaccncaggngggggattcaaaagccctggtnctctgtataaccttgtttgtatcaccccgctgtgatgtgttgtgtccgtcctccccctttataagatgggctggtgcgctttgtactcacctcctctaatcgctgataggactccctcttgtggcgcgttttaatttttattttaattgccacaccaccttgttcgcttcgtcacataatcactcccactgggtgcttttagttcgtttcccgcaaccgctgtgctcgcgttataaatttttcgctgtgttggggggcgacatcctctcggtggcacaagaaccactcacaccttctcgggacgctcagttacgcacattgctgtagagagacgtgtgcaccccaccggtcgttcataacagccgcgacgtcttaacttagtatacctgctcactgtgtgagtgcccaccaacatactagttgtcccgcacgcagtacgcacaagtgttgcccctcgggggagtaagacacgccgcgcagtcactagttgttaagagagtgctacaagatcacaaccacataaggagtgttataaacgctccgcaatctttgtgagtgacacaggagcactgccccgcattggtgccaccccgcctattttaaaaggttctgttgtgttctaccgacattgtgaatgcctattcgggagtactgaggttcataacccgcgagtgtattccacgtccggtgtttatttattctcaatttccccccgtttcggaaggtccaaagaaataaagagccttttttcccaagacgcctttccccctagaagaaattttttccacttgggtttaaaacccccccccccccaggaacaggggtttta

SEQ ID NO: 609899 - DNA, 475 bp, Homo sapiens
  misc_feature (19)..(19): n is a, c, g, or t
  misc_feature (82)..(82): n is a, c, g, or t
  misc_feature (144)..(144): n is a, c, g, or t
  misc_feature (166)..(166): n is a, c, g, or t
  misc_feature (208)..(210): n is a, c, g, or t
  misc_feature (225)..(225): n is a, c, g, or t
  misc_feature (239)..(239): n is a, c, g, or t
  misc_feature (301)..(301): n is a, c, g, or t
  misc_feature (316)..(316): n is a, c, g, or t
ccgcattccccccagctcnttagtgggcacccaacgctaaatggttccttaagccgctaatgactaattttaagggattagngctgcagcaatcaactgtaattgccaggatgtaacaggatttggggggccccagggctcccntccagcctcccggcaggccgangaggacagtgccacctgccggggtctctgagggatcaacctnnntccctccctcccacntgcacctggcaccngggcagccagcacaagaccattgcagggttagtctgtctctttccttcccacagacaactcngttgcaaagttttgngagaaatccctgggttttctgcagcccctcacttctcagagtgggggtcctggaagcaccctgagaaaagggaaggttcctcagggtcctgccttggaagcaacttgttgaggaaatctaccttttaacaagtctcttcccgcagcttcgttacacaca

SEQ ID NO: 609900 - DNA, 911 bp, Homo sapiens
gacatgttgctggcgggagagcggcggggccgagagcgtgactcgcccgctccggctgattcccccgcgcgcctccccgcgcgtcggcagccatgtcccgaggaaaagcccaaggaggcttgtgcacgacagagaatgaccacatcaacccttgaggggtgccggccaggacgcgctccggtggtgcagtctcaggatccacgagcgcacacccgccgctgaagacaaagcttgattgaagggccataccgtgcgaaagaagcgacaggggtcttgtccacaatggagcgcaggcactccagatttccagcgttccgacaggtgggcaagccaaacttccacttgaaaacttgacacacttcaaaggcaacaggtttggcgagcatgcggacaggaccggaaggaaccaccaaattccggacgttgttcccaagccaggacaagaagctgggcgagtggtgtgtgcccgtgaagaagcaaggcccctggacaggtggacacaaaaggttttctaagaaggggccccggttccccccaaggtcctggtgcgcggatcacaatttccttcgacaatttggcgttggttggacatgggtgaacgccaatcggtttgcaccagttgtccggaacccacaaagtgggtgttctggcaggaaaaaacttcggaagagggaaattttcaacccaggaaagtgaaatgttttcacacttctctcttggggaatggcttcattccaaggctggcataacttcaaaaaacttgatttatttgtgcagaggtggaattgaaattcgtggtacacgtataaacgttggtggccactccagggacattgggtacactcttgtggggtcgccaggtaacacaagtggaggttggcaacgaatatttgtggggaaacctttgggcg

SEQ ID NO: 609901 - DNA, 1214 bp, Homo sapiens
  misc_feature (355)..(355): n is a, c, g, or t
gatacgacaccgcgtgtttgttggccaccccctctcttgctccgctgtgaggctctccctctcacctcccgcctgggttgtggcccccctcctttatgagatgccctccggggcggcacagtcagacgacgctcgccggggcgtgttgatgcttccttcgtggccgcggcgcggggccggcggggactagaccgcctttgtgtctcccccccgtgtggtactgctctgtgtgtggtcccgctcgttgtggctctcgtttttttgggggtggctcgccctgcttttgtagtgctaccagttttgtgctctatcctaacaaccactcggcggggtgtgtgctcgcgcgcctccggcnatgttcctcctccgggggagttttgtgtttgtactacacctcgccttttcctaggcgaaaattttttgttgtgtgcgcctcgtccctcctcctttgagaattgatatagaatgacccagcgggtggtctctatctaatgagagagaatatattgagagagaaaggagtggaaacacatacattctgttataaagtatatagataaaataaataagaagaacagaggggggggagggagctcgtcgagaggagagagttgtgtgtgagccccccccccttctgggggggtgcgggtgcgctcctcagtggatgcaccgcctgttgtccctttgttcgctctctcgctcccgcggagaacttgtgtttttttataggggggctgccccacagcagtgtgtcccgcccacacgtgtggcgccaccttttttctccacccttctcgcgctcacctctggcgcacacccgctccacacacccccgcgctctctttattgtcttcaggtgcgccccctcggcgcgggtgcccgccccccctctgtgtgtgggggtgtctcccacaaggtgtttcccactgggggccgccgcctcttgtcccccgcccctctcctcttttctctcccgcgcccacttcccgctctcttgtggggtcacacgcgcgcgcctctcccccgccgacacactccccccgcgcgggccctcgggggtgtgtgggggtcccaccccctctttcccacggggcctcgttcgccccgcgttccctcctctctcccccgcgcgggtggggggggggggggggtgttttggccggggttttttttttttttgtgcaaaaaaaaaaaaaggaggccgttttttgata

SEQ ID NO: 609902 - DNA, 290 bp, Homo sapiens
  misc_feature (5)..(5): n is a, c, g, or t
tcganctctagaggatcccccgatgaatcatcccggagagattgcagtgctggcctctgtcgcattaccgaccgttgtgctggtcaacaatgcccagcgcgagcatcaggaatttatgcaaaatgttcgtgctgtggcggaagaaaatggcgcagcaatccgggctttgcctgcagacggcatagccgtttttccgctggcggatgattatgcggatttgtacctgctggcacggaaaggcatggcagaaaaattgttgccggttgttcagatccgttactgccagcgct

SEQ ID NO: 609903 - DNA, 1514 bp, Homo sapiens
ggttgtgctatcgcgacgaggagttctgcgcctgccagaagatcgattccctctcgtttactgcctcgatgaagcacgagccaacaaagcctccgatgaggaagcgttcaatacgtgttcaacgcgtagaggataagcacgattcgatggcctagcttgaccctctgcgatgacgtttgccctgtggatatgcgggcgtgggactggaggttgatactcttgcaggaatcgtccgaccaaggaggaagagctagaggagtggaagcaagagaagtggagtgcaggtcgtgctcggtagtagaaccagttgcgtctgagagacaaccaaccgcatggagatagtgtatgtagtggcgactgtggttgagaggtgacgcgtagtgaagatacccctacagaaagtacacatccccgagtcaactctttcatgggagcaaagatactttatgaccgtagacgtctaggatacttctacgatcggactggacattgggcgccttaatgggaccgatctatccgtttagtttagaagcacaaattcggcgtccagttagaccaattcgtttagaccaaaaggaaaggggacgcggtgataaccccatattcttgagctagtttacaggaacaagtggcagtcctgtggagtcggcaaggggactggcgataagggagaacgtcgggacgtgggcgaaggaccaagtggcagctcatataggctaagcggatgggcaccaagcacacgtggaggtaagaacccacacggatacgattttcgggggtgcttccgtattgttgcgaactctagaaaaccggcgagagaatcgcacggcgcttagtgtgttcgctcctgtgggcgggcctaggatatatggaaagtgtggccgtaaggcgatgaattttagagcttccgaatgcggcaatggggtttgcgcacacaacgagaggcggcaactctgtggacctgggacagccagagggaacacattctttcggaaacgtaatgtgtgccacgccttgtctggaacggaatccgccgttttggtagacggacgacggccgttgtttagcccctgtggtttgaaaaacccttagaagagttggttcctttagacgacaagggggaatctgattgaactcagatattcaagaagcgttgcccttctgcagtttgggtttcaaccgcaaatcgcgcgagcaaaggaaggcgcatatatttgagcaggggggataccacctgagtcactgcatagagggagtcaagacaaacagcaacaggctgttgccctcggggaaatagaaacgcacgcggcaggtaccttgtgcaaaaataggtgcgccctgagtagtttggtagtccagtagcacatcgcatgaggtcaggtgttaggccaattaatgtagtggagcatatgcaggggagccagccagaggtagccacataatcagcagaaaatacttcaggagcaaaaattattaagaagttaggcgcgaggcaaagctatagtaacggcgtg

SEQ ID NO: 609904 - DNA, 887 bp, Homo sapiens
  misc_feature (24)..(24): n is a, c, g, or t
  misc_feature (351)..(351): n is a, c, g, or t
  misc_feature (471)..(471): n is a, c, g, or t
  misc_feature (480)..(480): n is a, c, g, or t
  misc_feature (538)..(538): n is a, c, g, or t
  misc_feature (542)..(542): n is a, c, g, or t
  misc_feature (563)..(563): n is a, c, g, or t
  misc_feature (570)..(570): n is a, c, g, or t
  misc_feature (573)..(573): n is a, c, g, or t
  misc_feature (580)..(580): n is a, c, g, or t
  misc_feature (595)..(595): n is a, c, g, or t
  misc_feature (601)..(601): n is a, c, g, or t
  misc_feature (614)..(614): n is a, c, g, or t
  misc_feature (632)..(632): n is a, c, g, or t
  misc_feature (637)..(637): n is a, c, g, or t
  misc_feature (642)..(642): n is a, c, g, or t
  misc_feature (657)..(658): n is a, c, g, or t
  misc_feature (661)..(662): n is a, c, g, or t
  misc_feature (665)..(665): n is a, c, g, or t
  misc_feature (683)..(683): n is a, c, g, or t
  misc_feature (702)..(702): n is a, c, g, or t
  misc_feature (705)..(705): n is a, c, g, or t
  misc_feature (715)..(715): n is a, c, g, or t
  misc_feature (729)..(729): n is a, c, g, or t
  misc_feature (732)..(732): n is a, c, g, or t
  misc_feature (761)..(763): n is a, c, g, or t
  misc_feature (770)..(770): n is a, c, g, or t
  misc_feature (778)..(778): n is a, c, g, or t
  misc_feature (787)..(787): n is a, c, g, or t
  misc_feature (789)..(789): n is a, c, g, or t
  misc_feature (794)..(794): n is a, c, g, or t
  misc_feature (797)..(797): n is a, c, g, or t
  misc_feature (802)..(802): n is a, c, g, or t
  misc_feature (808)..(808): n is a, c, g, or t
  misc_feature (820)..(820): n is a, c, g, or t
  misc_feature (823)..(823): n is a, c, g, or t
  misc_feature (826)..(826): n is a, c, g, or t
  misc_feature (836)..(836): n is a, c, g, or t
tttccatacttccgaacaagcgtntcacatccataaccaaaaattagatgagaaagaaaaagaactcttgtgcttcgaattgacttcattgcactaaatagcattccacactgcggttccaggccacagggtccccgggggagggggagacaaagggggtggctgacagggagaatccaggaccaccattgccactcccaccagaccagccacacccccgtcccacacagtgggcatccaaatctgatttgaaaaacagtctccaccaccaaaagaaaaatcccatgagacaatgaccacaagccaatcacccacccaaacccgccgaccccggcccccgggagaggcggncgggagaccacacatctcacatcaaccctaccatgaggagattaccccacgcgtccggggtcacccaaaccggagcgccaagaaaacccccgtgtcagggaaaaaaaaaaaaaaaatccncctccattnaacagtggagcaaaggacctgaccaataattttgtccacgttttcatttgaaggaatncttnatgcccattttatgaaatgtntttagcncanagtaatnaacagggatccagcntgccangggcgaaaaattntccagatggtcgccaagnaagantcccnccccccgattgtccnnccnnccntgtgggcaaagtggtggnggatgagtaaaagggagcngcngaggggaaantccatccggacccnccnaggggagtgggtggtcccagtaaggaccnnnagtaatnttttttcnctcaatccntntcccnttnagccnccagtntttgttgttttnccnccnacctttttcnttgaaaaattttcaccccagccaatgttagggagaaaataaatgtttttgc

SEQ ID NO: 609905 - DNA, 197 bp, Homo sapiens
tcctgttggagggtgtggaggaaagaatggaaatgatttctgaagaggcaaaagagagtatgtattccgtggaacaaaacgtgagagaaaagtgagttttgaagctgtagaagcacttatgtcaatgagctgcagttggagagtctgagttttaagaagatacgttgaaaacagacctgttacaccaggtatcctgg

SEQ ID NO: 609906 - DNA, 102 bp, Homo sapiens
  misc_feature (88)..(88): n is a, c, g, or t
tgtatttttagtagagaccgggtttccccatgttttcttggatggactagaaaaaaaaaaccctcctccgggtgtttcagccccccanagggccgggcccct

SEQ ID NO: 609907 - DNA, 1055 bp, Homo sapiens
agcggactcctggagcccgcggacccgagcacgcgcctgacagcccctgcgggcccggcgcgcggcgtcgccaggccagctatgggccccgacccggtgggcgcctgagaccgttggctcatgggagctaccgccgcgctacttcgaccatgggacggaggtggaccatacgctcagggtgcgaggagtcggtggctagatgatcgaccgtaaggtgtactaactgtcaagctgatgttcatccgccgtgcgaatccgaggggtgcatcccgggctcagtcaggctcactaccgtaccggggcatggattggccacggcataccctattgtgggcacttccacatggaagctataggggcttttgtgaacgaacgatattagtgaatctgctctccgtgcattggacgaatgtggtgctctacgatgtcatgacttcagccctattgaccgcaccagcgcaaaggagacctataacgagggcttgagctagtagatagaggtttcccaggggaagctttgacgtgctcgctacctatgctgggtacgtcgggattgcgcgtgtcttccacctgaatggagggccaaccccagttgtacctgtctttcgccttgttctggttatcgcgtgtcgttgtcatcgagttcgtttggacgtggcgcttggtaatgggtgtgcaacgagccatgggttcttccttcaccctttttttgggagttactttaatcgcggggaccgttgtcccttggttactggccactccgtttcctgttcgcgttccttagttgacctgcggtggcgtgtcctccagaggttgttctggtgctcaggggccctcacaagggcagtaggtacctttgagcaattggcacgcccaaattgatacaatatttgcgcggtccaacccaatgatacgggtgatcagttttcaaaggccacaccccattcaaaacatcgctgggcgaagaacccgaattcgttgagctcttaacaagtttccaattttgtagggtcggcggttattatggggccctacccaattggaaaacagaggcg

SEQ ID NO: 609908 - DNA, 155 bp, Homo sapiens
cttgaccgctctgagctagacctagccccggacccactccaccttactaccagacaaccttagccaaaccatttacccagatgaagtataggcgatagagattgagaccctgccgcaatagatatagtaccccaaggggaggttgagaaaatttt

SEQ ID NO: 609909 - DNA, 129 bp, Homo sapiens
cggcatccctgtcaagccaagcgcattgaccacgacagacagacacgatgcacggcgggacccagggccaagatccaggataactacaccgaagaaggacatgaagagcgtctccaccgagcaggaggc

SEQ ID NO: 609910 - DNA, 425 bp, Homo sapiens
  misc_feature (197)..(197): n is a, c, g, or t
agatcttagagtcggtagtgtggagggtgtggtcacagtgtggtcagcagacagaatgaaaagcatgtgaccaggagacaggtcgtaatgcataccaggtgatagacactgcgacagagatcatacagtgcccccgccctaagcctaaagctgagatgcccagcctgctcagccatggcccacctgcagctcctgcncaaccagcgcaacagctcctcaggaagggagggcgcctctcccctcatgaatgtatctgcaagtgcacagctttgcccatctctggggcacgaacaagtccaaagtaccaacatagtcttaggttggctggctgtgcccatcgagttgggacaaggtcttccccagaggagaagggggcaggcccacccagccgggaatcagtctgtgagcaccaccaactccccatg

SEQ ID NO: 609911 - DNA, 204 bp, Homo sapiens
agcctctgatgtctgtgctgctgtcagcaggcagcttcgtatcactgacaacagaggtcggcatgatgaggacctagtcatacaagaaggatagcccaatcgtacaaccacgataatttggagattcaccagatcccctcagagtttttgtgtttttgtctgtgtatgtgtgtgtgtgtgtgtgttgatggaagcgtcgcgcat

SEQ ID NO: 609912 - DNA, 665 bp, Homo sapiens
  misc_feature (1)..(1): n is a, c, g, or t
  misc_feature (12)..(12): n is a, c, g, or t
  misc_feature (47)..(48): n is a, c, g, or t
  misc_feature (120)..(120): n is a, c, g, or t
  misc_feature (260)..(260): n is a, c, g, or t
  misc_feature (263)..(264): n is a, c, g, or t
  misc_feature (321)..(321): n is a, c, g, or t
  misc_feature (423)..(423): n is a, c, g, or t
  misc_feature (543)..(543): n is a, c, g, or t
  misc_feature (590)..(590): n is a, c, g, or t
  misc_feature (628)..(628): n is a, c, g, or t
ntttaacttttngctaacggagcgagccactggtgtgggtaacaggnnatccgccactagaggcgtgccgagtgtaggatagcaccgcgtccgggagcgccagccctacactcacccgcnccatggcctctgcctacgagctagcctgcatatactcggccctcattctgtacgaccatgaaagagacagccatggaggataagatcaaagccctcataaaagcagccggtgcaaatgttttttttgaggggggcagcanacnngcaaaggccttgcaaaaagaaacatccggagcaccatatgcaatgcacgggccgctngaccatgttaaaaaaaaagtgcttccaagcagaaaggcctgaccccttcattgattatggatcaacttaggagaatatagcaaacctcaaatcccaagactncggcgtctctggataagaccagtaattagacccttttaactaaacactcttcgaaaaagaggtcaataaaaagttatactactaatcatcccatacaacttttacctttgggtttacatnaccagattaattatgtggtaacaaacactctataagaccaaaaactnataaaaaatgataattggtcaccatcctaggcaatttnaaattatagtgttaccaatctattacaagataataca

SEQ ID NO: 609913 - DNA, 308 bp, Homo sapiens
cgggagttgctgtttttttttcaaacgtcatccatacaataaaaaactttgcttttaaaattccatttacatcagcggttaaaaaaaagtgacaggggatgaaacatgaagctgtaaagggcctttttggggggggtcacacaagggcccccaattttgcaacaagacggaggccccccccctgcacagtacattagggacattgggggacacagcacgcgttccaaataatttacacattaaaggaaaagctgccgggtctttgcatgcttcctatttgattccccaccctggaggtttgtttgggc

SEQ ID NO: 609914 - DNA, 892 bp, Homo sapiens
ggaggagaggagagcatagcacctgcagccaagatggcatgtgggcagcaacagagtgtcctgatggagagcccggccggtacttactcgcggagctcccccgtgggccggattttggcgattccctgcttgccctagtgcaccgtgaatacgccttgctttatctgtgcgtggtggtgggtggtccatgatcgtcttgtggtgatctgtgtggtacgcgcctgctgcatgaggtgcttcacacatggatgctcagtagatactagcatcggacgaataggttactgggagcactgatgcattcgggtgcagctcgagataggcccgaggccaacggcctggtccgctgagctgagacacgctaggttgaccatcatgcctagcacgtatcgtcactactatggcatacctaactggtgcctctgcggtgttgtcatgagctatccaagccacgcttgcttagatacgcacttacaaaggccaatgacccatgagtcaacgcatgactagactacaaatctcatgcacagcactagcgtacgcagaaaggagacatacccacaagagtctttgaagagcatcctcagcttagcaacaacgttccgaccagagcctttcacaggatcggaaagtgcatcctcctggccagggtcgcaatagacaccagcaagatggccctaacggtcttagagcatgaggcccagcgcatagaaggagagcgacgactgctagagcatacagacaaccgctcacgagagcggagaccacgtgcctatacctaggggcaatgggccggtagagacaacacatgctgatggacgacggatgaccgactcttacactacaatacatagggaacgagcctcacggggtccacgtgcgacagcaccca

SEQ ID NO: 609915 - DNA, 233 bp, Homo sapiens
ctctgcttgagtgaagttcatgtattctctgagagctcgtacaagagggcgatggcagttgacgttgatgtgatgcaacgctcctgctcgtccttccgggtatagtgaagcgtgtctccccggtccgtgccgtggcgatgatgtccgccttgcacaccaggaagtctgtcagcgtggacttgccatgttccacgtgcgcgcgatgaccgacatgttactgtgcgttggcccaa

SEQ ID NO: 609916 - DNA, 176 bp, Homo sapiens
ctaaacccgactccaccttactaccagacaaccttagccaaactgactttacccaattaaagtataggcgatagaaattgaaacctggcgcaatagatatagtaccgcaggaaaagttgaaaaattataaccaggcttattatagcagggactacccctataccttctgcatattg

SEQ ID NO: 609917 - DNA, 468 bp, Homo sapiens
  misc_feature (168)..(168): n is a, c, g, or t
  misc_feature (468)..(468): n is a, c, g, or t
ggagtggcagagttaaaaggttgtgacagggatagtgtgacttgcaaagccaaaaatatttaccatctcagcctttatggaagtttgacaacacttaatttagtggaatgttattgttaagaaatatctattaaattgtacaggatttatcattcaaacccagttgtngacctggcactctagaagctgagcacagatgttctctagcccacttgtagtaccaggaagtcatagcaagggcaggtgaggctctgagaccgtctgagaggctgcatctccacagactcaccctggtataagatcacaatgaggtgtggagtgggagggagcagtggtgtatgtgtgtctagcccaggcctaactgcattaaaggggagaaaacagactttgttatagttgaagcagctcccaatttaaagcaatcatttataactggggctgttccctaagaatttagcataattcccn

SEQ ID NO: 609918 - DNA, 330 bp, Homo sapiens
  misc_feature (112)..(112): n is a, c, g, or t
  misc_feature (318)..(318): n is a, c, g, or t
  misc_feature (324)..(324): n is a, c, g, or t
gccaacatggtgaaaccccgtctctactaaaaatgcaaaaattagctgggcgtggtggcacatgcctgtagtcccagctactcgggaggctgaggcaggagaatcacttgancccgggaggtgggaggttgcagtgagctgagattgcgccactgcactccagcctgatgacagagcgagactcctcccccgtcccacacacaaaaaaaacttaacacggatataatttattaagggagccagtcactatttcttaaacaattttattatgtatttattttaggcctcataataactgggtttaactattattatttntccccnttttta

SEQ ID NO: 609919 - DNA, 855 bp, Homo sapiens
  misc_feature (28)..(28): n is a, c, g, or t
  misc_feature (64)..(64): n is a, c, g, or t
  misc_feature (73)..(73): n is a, c, g, or t
  misc_feature (79)..(79): n is a, c, g, or t
  misc_feature (100)..(100): n is a, c, g, or t
  misc_feature (168)..(169): n is a, c, g, or t
  misc_feature (182)..(183): n is a, c, g, or t
  misc_feature (186)..(186): n is a, c, g, or t
  misc_feature (219)..(219): n is a, c, g, or t
  misc_feature (227)..(227): n is a, c, g, or t
  misc_feature (234)..(234): n is a, c, g, or t
  misc_feature (249)..(249): n is a, c, g, or t
  misc_feature (261)..(261): n is a, c, g, or t
  misc_feature (290)..(290): n is a, c, g, or t
  misc_feature (303)..(303): n is a, c, g, or t
  misc_feature (321)..(321): n is a, c, g, or t
  misc_feature (325)..(325): n is a, c, g, or t
  misc_feature (327)..(328): n is a, c, g, or t
  misc_feature (334)..(335): n is a, c, g, or t
  misc_feature (339)..(340): n is a, c, g, or t
  misc_feature (343)..(344): n is a, c, g, or t
  misc_feature (347)..(347): n is a, c, g, or t
  misc_feature (355)..(356): n is a, c, g, or t
  misc_feature (372)..(372): n is a, c, g, or t
  misc_feature (384)..(384): n is a, c, g, or t
  misc_feature (387)..(388): n is a, c, g, or t
  misc_feature (391)..(391): n is a, c, g, or t
  misc_feature (396)..(396): n is a, c, g, or t
  misc_feature (662)..(662): n is a, c, g, or t
  misc_feature (671)..(671): n is a, c, g, or t
  misc_feature (730)..(730): n is a, c, g, or t
  misc_feature (749)..(749): n is a, c, g, or t
  misc_feature (753)..(753): n is a, c, g, or t
  misc_feature (758)..(758): n is a, c, g, or t
  misc_feature (761)..(761): n is a, c, g, or t
  misc_feature (771)..(771): n is a, c, g, or t
  misc_feature (846)..(846): n is a, c, g, or t
ccacaacaaactagaaatcctctaccgnagtggaataagagagaacactggaacttccacagancctacaganttttcnggatagcaacacatctttganaaataacagtgctgtaccactctattagattctttccattttttattaattgacgcacagagaaaagnngcaaaatgattannggnatttatgttttttaggcagggtgttggctttanaccaacgnaaaaganaaacagatgaatatncttttgatcttnattttctttctcttattctcatggtaggntgagatgcttttnaatgtgatgttatatgcntaangnngcttgnnttgnngcnncangttttttnncctcctcggctaagcnggtctccttatngtnngcnttgcngcacttctctacaaaagctgcgaaatcatccataacagctttcagttgctcttttgttgccttgggcttgtgtttcacaagctcaacaagtgcagtttgtttcttgatttgtctctccttctcagaaagtgtgcatatatctgcatggaaggtgaatgtttcagcattaaactctttgggaacgtatgtttcatcgacttccagagctgaaaagcatggtcgcctgttcaccaaggattctgtgcagcatttggtgactctgtcanttactggcnttttctcatgcaacacacataactggttcaggaccacggatagatagtcttctgcacanggcattctttttgcttcangatntttanaanatttgctgcncacttttcctaggtttcttgagacctctacaagagttggagttgacacttggggtactttcttggtgtaacgatntaatagcgc

SEQ ID NO: 609920 - DNA, 287 bp, Homo sapiens
  misc_feature (133)..(133): n is a, c, g, or t
gctaatatggctttgctgttgaatgaaatagattatagtcgatgagactgactctcgccttatgtgaccctactggagcagaagattgtgtgctaccaattcgacccatttactgcattatgcagcctgtatnaactttgatctattggaggtcattttcaactttccagtctatggaccgcatgctgacgtgagcaagcctctttcaagaacttgcttgtcagttctcgcccttggacactgttctttagcagatgctagtcacgatgacagtttgtgggtaccga

SEQ ID NO: 609921 - DNA, 219 bp, Homo sapiens
tataagcccagttcagtaaatcttcaattgcacaagttagttgtaatccttaagctctagtgtgttacatggaatgtgtccatatgaataatagatattactctatcgtgatggcagtggacgtatgataaatattaatgttgacaagctgtcataatcttagggtcagtaccctaaagtaacctttgtgtcgagatataactgtcctgataagagact

SEQ ID NO: 609922 - DNA, 235 bp, Homo sapiens
cataatcgattccacgtttttctcgaacggacagaactgaaccccaacctgtttgacaggccgcagaccaatgccgatccaaggcaggctgccatcggtaccgtctcgtcgcccgcatagaactccgatgcttcgcggtacattcccgttccttcaagacgtacgtggcttcgcctatgaccttctctacttacggtcagcagttacaaagtccgctccactactctctactgct

SEQ ID NO: 609923 - DNA, 220 bp, Homo sapiens
accgccgcgccggccttcatctccttgagcaccggaaacagctcgtagatgaaatcgggcaccttggacggcgcacgcttggcggccgcaccaatcagcaggttctcttccaccgtcaggcgcgggaagatctcgcggccctgcggcacataggcgagcccctgcgagacacgctcgtacgcgggcagtttctggatggtgcgcccttcccaatcgatcg

SEQ ID NO: 609924 - DNA, 172 bp, Homo sapiens
tgcaagacacatgcttgcatccaacactcagtctggcaggcagatgaaaaacggggaaccatttgtgatgggtccagcatttgccatggacacagatgccgaggacccggtatgctattaggcatgcaagttctccatcttcaacatttctcccgcatagcatggttacacg

SEQ ID NO: 609925 - DNA, 954 bp, Homo sapiens
  misc_feature (300)..(300): n is a, c, g, or t
  misc_feature (455)..(455): n is a, c, g, or t
  misc_feature (458)..(458): n is a, c, g, or t
  misc_feature (513)..(513): n is a, c, g, or t
  misc_feature (536)..(536): n is a, c, g, or t
  misc_feature (582)..(582): n is a, c, g, or t
  misc_feature (584)..(584): n is a, c, g, or t
  misc_feature (596)..(596): n is a, c, g, or t
  misc_feature (642)..(642): n is a, c, g, or t
  misc_feature (661)..(662): n is a, c, g, or t
  misc_feature (665)..(665): n is a, c, g, or t
  misc_feature (674)..(674): n is a, c, g, or t
  misc_feature (683)..(683): n is a, c, g, or t
  misc_feature (739)..(739): n is a, c, g, or t
  misc_feature (835)..(835): n is a, c, g, or t
  misc_feature (848)..(849): n is a, c, g, or t
  misc_feature (864)..(865): n is a, c, g, or t
  misc_feature (913)..(913): n is a, c, g, or t
ctgctacgaataactggcacgagggaatttttttaaggagcacgcattagtgtacacagtgtgagagagagtggacactatataaaaatatgggtcaaaagacatcgtgatgcgttagagtcaacatttagcgtcagacacaggagacacacacgtgtgatatcacgatagacgctgtgggcgcctcgatatcagaagaaagaggtgtctcttatatcacgacagagcgacagcacgcgtatatacatatataacactcctctcaacacacaatagcgtcataagatgtttgcgacatgngagaaagcgtctatagagagtgcgactatatatttataaaagatgtgatatgtgagactcctcgtgcacatagagtctctaatatttatactcgcgtcgtgtgagaagacatcgtgtaaatattatagagtgatagtggagtatgagtaccacgngcngcgctcacatcgtgatctacatatcaacacacacctctatagtagacgactctcncaactatacatcttcacgatgtngcgcctcgtgggcgttctcacgaagtagtgaggaagaaatatatantntcgcgtcgtgtngtgagtactgcgtttctactatccatcttatcagccgtctgtggtngagtataaaaacatgtggnntgngtgcactantagtcactntatgtagaaaaaacactcacacaacatcgtgcgacgcgactattatttaaaataantatgtcgactagtgtgctcaatactgcatagtgcgaccacctacgaagtatgcgtcgttgagacgcctcgtctgtgagaaaattgtggactactangtgctgctgtttnntttgcgacaactagnntgtgtgttgaaaacaacacaaactatggtgtatgatggtgaagaatantaatttctacaggatgtatccactattattacctgcataag

SEQ ID NO: 609926 - DNA, 2238 bp, Homo sapiens
ctacgtacataaccctaaagctactccactgctaaaactacatcgtcccaacaattatattactaccactgacatgactttacaaaaaacacataatttgaatcaacacaaccacaccacaagccgtaattattagcatcatcccccatactattttattaacacaaatcaacaacaacactatttagaatgataccacacaactatcaccctccgcaccccctaacaacacacccctccataatactccattacctgactccctcacccctcacaactcatggcaaagaccaaacgcacaactgtattccaggtgaaagccaacatatcagcagaatacaacaacatcgtaaccgtctctactatctaactcgtcccctacagaaatcttccatttcacgttacgtaaccacattacacaggtcaatcgagcagacctacagtacatacttgtggagtatcgtctctgtcgaccaacacacgacattagtcacccgacgcaccatgggagaaaataaaatgacagccacgaatgaaggggcgacaacacggaccaggaaaacgaccagaaaaccggcagggcgaacaagaaacaagacacgtacgtacacataacgcaccccatgagagtagagcacaccacaaaccacgccataacagatcaaaacagcaaacgataacatagtacgagcagacaccaaaacaggcgcatagggaatacacgtaaaaagcagatacagacacttagacacaagtgtgcaaccatggcgcacaacgaaagcgtaatcaacaaacaccagacagcccaacaacagctacagcatgaactaacacaacaagagaaaaaaaagaacaagcaaagaacaccaacaaaaggcaccacaaataaggacacacaacaaagacagataaaaagcacaaaaggagagaaacacacacacacagacacagacaataaaaaaccagagagccggagaaacagccccagccacagcaacccacggacacaaacttcaaaccaaccaaacacacggcacaacaagccacagccaacaagaacatactaagtcaataaaaaagacagacgaaaccaagcaagggaacggcatcagatcacagcctcacaccgactcttgctaaccgtcgaaaacaacgagcaggacaaggaaaccagacagaaactagacgagacgacagaacgcagaagacacaacacacagaaaaatcgaagaaaaaaccagaacaacgaggagcggagacgaagaacagaagaagaacagaagcagcggaaaaagaaaaagagatacagagaaggaaaacgaagcaaagaagaacaagaaaacgaagagacaagcaagaacgacgagacaaagaacaaagaaacaagaagagaagaagaacaaaaacgaaagacagacgaagaagaagcgagacaagagaagactaaagcatgaaaccgaacagaacacgaacagaacgagaagaggaggaccaccgaaggaagtgaagacaggaggagacgaggagccaaaccgcaagaacagagagagacgaaaacacagacgcggagacgaaagagaaggaagagaaagaacacgaacagagaaaccgaagaaggagggagaacgaagaaacaagagcggaagagacgagaagagagagaaagagacaggaggagagagagaaggagagagtgagagaagagcgagaggcagcgaagagaagaagagcagagaaaaggacgaaaagaaaaacgagaacaaaagatgtgacgagaaacaagaggaaagcagagggagagactcgcaacaaacagaagaagaaacacgagaagaccagagaagacaacgacgaacgagcacgacgagacgaagagacaagaactagaaggagagagaagagaaagaagccaaaaggaaagcagacgagacacacagaagaactaagcagaaagactaggccacgaaaggagaggagcgacagccgaaaaccgaaacgcacagcgagcgaaacgacaaaagaagagaacgaacacgaacgaccaaacaagcaaaacaaaaaagagcaagacacatagaacaagagcagggcgaccacaggactgagaggaacgaacaacagacaagagagaaactaagaacagaacgagcaccgaagacaacacaagtaacgaagaaagggacgcacagcacgccagacagagccagacgacacagcagcacgagaaaaagccacaac

SEQ ID NO: 609927 - DNA, 227 bp, Homo sapiens
gtctctagaattgtggtcaacccatctgtgaagcactaggatcatgggtatgccgctgtgcctggtccatccatatctacgttaatagacagctgcaatgtactctgcagtagcaattatgccttctctctagatacgaactggcacatgtatgtgtgtatataagcagcgttgtagcatctcatcctggctaatggcacgtggtccatcgtgatggatttctgtac

SEQ ID NO: 609928 - DNA, 903 bp, Homo sapiens
  misc_feature (632)..(632): n is a, c, g, or t
gatgtgtgtgtagagaggactcacggcctacccggcactgtggaggaagctgggggtagacgcgctgttcgagacggtaagatgtggcctcggagagcagtaaggttgcgccgccagcttccgctacttcatgccgagcggatcaactgaactcggggggtgcggctcgcacgaaagaagagccgactgtggaacatcatcgtcgaagcagagcgcaaggggtcgcgtagagcagtgtggagcaaagcgcctccgtctccacagtgtgactggccctcgtaatctctgggacctcacgggcgtgagagacgcgttggagacgggtgaatccccccgcgtgtaatcgaaaccaactttgaaatactcctcctgtgtacggcgtggggcgaatccctccgtggtacacactcgggggcctggggttctctagtgcgtgtgacccgtcgacttccccattgcggcccactgccccccccggggcaggggccccactctccccgcaggcagaaggactgttcttccatggtcgcggctcttatctcagcccaacctggaggaactactccccactgggggcttgaccaaactccttttgcagcgcgaccccttgcttcggctaggcctcagccatncgcatcccctttggggcgttttggtctagggaacaattgggtcatcgagcatcgagtacaagggggaataagcaacatttcctttgggacacagggcgtccttcgccgagacattaaatatccggtaacccccaagagcacccgttacccaattaatgcgcgcccgttcccaaagcgccacttaaccgccacgacttgaggccacagaagctttcccattgtttccgcgcccacattattcacactccaggtacccatcacctcaccccaa

SEQ ID NO: 609929 - DNA, 420 bp, Homo sapiens
  misc_feature (83)..(83): n is a, c, g, or t
  misc_feature (151)..(151): n is a, c, g, or t
  misc_feature (237)..(237): n is a, c, g, or t
  misc_feature (240)..(240): n is a, c, g, or t
  misc_feature (350)..(350): n is a, c, g, or t
  misc_feature (358)..(358): n is a, c, g, or t
gccgaattccgtttttacccaaaattaaccagcgccttaaatatggtgcccgcatttgaaaacagacatgatgcaaggaggcntgtacggctcaggtggagaaaggtatgactcttatgagtcctgcgactcgagggccgtcctgagtgancgcgacctgtaccggtcaggctatgactacagcgagcttgaccctgagatggaaatggcctatgagggccaatacgatgcccggancgngtcgccaatggcctcaggctatgggcgcatgtgggaagaccccatggggcccggggccagtgcatgtctgggtgtctcggctgccctccctcttctcccagaacatcatnccccgagnctccgggggggagcccgcgtggccgaagctggaaaccaaacctaataaagttttcccatccc

SEQ ID NO: 609930 - DNA, 100 bp, Homo sapiens
gacagaccctcctcttagttcacacattatttcaaaggcacaagtcctcgtttcggaacgcaaagagaggcattatttttcccaaaggagttacacggtt

SEQ ID NO: 609931 - DNA, 765 bp, Homo sapiens
  misc_feature (322)..(322): n is a, c, g, or t
  misc_feature (402)..(402): n is a, c, g, or t
gccggctgcggggtacgagtccgcgacagactccgggttaagccaagcgccgcgcaatgctgagttcccggatgccggagaggcatggatgatcgtgctaccgagatcaggctcggcgaagatccggatgtgtccgatgttgaagcgcggaagattacgaatgaattgaggagacatatatgtttgagtgagagacacgttccgtggattgtcacgagttatcgggtgcatgtggtgcgcgcgagaccagatggagaagaagtcggagtgatcaaagagtggagcgagaggaattctgcttccctgttggtgctaggggaancagacacgaaggtgtcagatgtgtcgagccgatactgtgctgttcatatggatgctagtggacgaatacaggacttcagnctcctgattatcgaagcttggaactctctcgtgagatctcgaaggtgctctctagataaccaaatcgattgtcttgaattgaaggtaaagcgtttggcccgtcttcgaataagccacagggaagacaaattatctccaaatgttcggagggagaaaggaaattagaagaagggggatagggcctacatgggacaccggctatgcgaattgttcggagccagcaccaacccttgtggtcggcgattgtcccccgtttacggacggaccgaattggataccgctgaacataggagacccggtatgaacactatccgcgatggaaagtttctattcgttaacccaaaggatttaccggccaaggcg

SEQ ID NO: 609932 - DNA, 119 bp, Homo sapiens
  misc_feature (58)..(58): n is a, c, g, or t
cccattggtgataagccgtcaagcattgctgataggttttacctcgggggacccacangcgtccgcggattcagcatgcacagcatcgggccacagagcgaaggagactacctaggtgg

SEQ ID NO: 609933 - DNA, 383 bp, Homo sapiens
  misc_feature (30)..(30): n is a, c, g, or t
catcactcctgctcaggtccttttggcccntggtagtcatgtggccccccctggatgcaaaggaggccaggatgtgcagtttccccatagtggcttcccagccacaactttttacttaaatggggggtatgtattatggtgaaaggttacccttcctggcccattttcccttaaaacttttaacttgcccctcctagtccaagtcccctttcaaatgaagttttttttgcccccctttcaccccctgggtcccttagtgctgggtatgtgactgctgtagcattcccctgcccctggtgcaaacagcttcccttggaaatgggtatgtccaacgccttttttttttttgcaaaaagagttttttataaaaggaaaaaagtgga

SEQ ID NO: 609934 - DNA, 609 bp, Homo sapiens
gatatcctgtgcaggagcatctcattccttttgttgctggcaagctggtacttggaggaagcctcaagagctcgagttgtctccctcggttgcagtggagacaaattggccttatagtctggccatatttcagcttattcttcagcttgcatcagggcaatgtcattgtcatattattaacgagtacctgcttcttgtttcccattactgttgtagttagattgaaataggactacttctatctccaggtcccgcttctcccctcctacgctgaccttgtattgagtgttccttgtcatccatagttgaagaatgtgctgctgtcagcacaaagtactcagacaccacagcccccatacagctctcgcgtcccttagaagggcgaatgactgagatcttggcctgccatggttgcttgtggtaatcggtacccttcctgtgttcccaaaccatgccacagagactcagagactggctttcatcgatcatttggtagaaaacatcttccaggttttccatatccttgactttgaacacatgttgctcattgtctttcttggaagacacagcatagatgtccacttggttcaccaaaggcccgaacccaaa

SEQ ID NO: 609935 - DNA, 1122 bp, Homo sapiens
ggcttctggagggaacgccgcgatggctgcgcagggagacgccccaggtccagttcaaactggtatcggtcgtggatggtggtactggaaaaacgaccttcgtgaaacgtgcatttgactggtgagactctgaccaacgatggtagtgtacgccgcaccgtctggggtgtaagacgagttacagtaccccgtatgtgttccatcacgcaagcgagtagagacctgattaacgttcaatcgtaatgcggacagccatgccagggctagggagaacagttgcgagtggacctgaagcagactggctacttcatatctcaaggaccctaggttttgcccatcgaataatggtcctgagtgtaatcgatcggcagaaggttacttacaagagaatgtggcctgagactggtactagaggatgctgagtacggaagtgatgtgaagaagcagtcgccacactggttgtccgtgtagggaagcaaagtaggggatatcaagggacaggaaaagtgaacggcggaaggtctcgatcgtcttgcgcagtcgagacagacagaagtctggcacgtactacaagacgatatcgtgccgaagagacgtaagcataccacgtctgactgggcgcgcttgcctctgggttttgctcaggaaggctcagttgcgattacccgtacactttgggaagttagtaggccgatgaccgtggttctcgtgcaccagccatgaagttggtcaggtgcacctcaggttccgggcaagccaacaaggtgatgaggcgacgaactttaggaagtgttgcgttcagtaaccaacttgctcttcccggggactgacctgcattcgattgtagccctggttgcagtaacttgaagccctgggatgcgcaagtcgctcacggaagaggttctcacggtcacgagtaagagcgaggctaggtcgctgttggattctcaggccggttggctaggcagatgttgttggcaccactgcatttattgatcgtagactggaggggaaacatggttgctaaaatactgtagggggatgcctaagggacgacaggagtggggattacgggcatattgatagttggtagttaaacagaattaaattggctcagagggg

SEQ ID NO: 609936 - DNA, 416 bp, Homo sapiens
  misc_feature (261)..(261): n is a, c, g, or t
caacacgtacgatatgattaccacattaaggctattgtacagccatgaggtataatatcaggaagaatcttgatgtgagccacacctcttttagagtgagaaaacaaacacatttatatttttgtcaattgtccagaagaggacacactctgatatattttacaactagataaatgcacattaggaagcagtacaggttgtcaagacatgctggcaaaatatattccacttttcagacaagtcaactagcacagatggtcnaaacgaaagcctttacagcacacatctgggcacctgccctgctcaaggtgccagtcacaaaatacatcacagctcaattttcattatgcaactgttataccaatattgcttttcacctgctcaagcattaggtcttccagtttgcactttgtata

SEQ ID NO: 609937 - DNA, 335 bp, Homo sapiens
ccagatctattttaacacatcacattgagaattgcaggagaataattacccagtaacccaaagggatacacatgcttatatattcttcttcatagggaaaaagaacatggggaaatgtggctgatttgagggatggtaaatgatttttaggggaaatgaatgggtctaatgctcagacaatggttagtaaatagttttctttggaaattgaatgggacagagagaagacagtggtttgggacaaagtttgtctggtgtctaattttcaatctcttcctctgtgttatgagtttattcttctctagttaaatttcagggaaggcaattgtgtttct

SEQ ID NO: 609938 - DNA, 685 bp, Homo sapiens
agggcctcttcacttcctgtacaggccccagaatcctagaaaaagcgcctacttatgtgataacatctagaacaaaaaaaatcccctttccacaagacaaaccacccgtgctcctgaaccagtgatgtgtgtcgcattgtaaaacgccagtaagtttcagagtcccctagtgttgcacagaaacatgggtcaacagtctaccatgcaaatcagctatggtagccgatgcacaatacgttcaaggagagtttaaggatggcccatccacgttccatgcagatatatgcacactttctaagaaggaaacccgctcttctcccaatgtgctcttgttgagctcgtaaaccacaagtttcgagccaacaaaagaccccatgaaagctgtcatggattatatcccagcctttgtagataagtctttcaagcccttttataaggacacgttcttttcccaggacggtaaaaatcctgtttctacaacacaagcccctttaggcattacaacatcacatttaaaagcgtcccaccctaccataagaatcatacaaataaaatgatggtcttgagctcattcaggtgccattcctaatcgttggtgtcaaccccacaccctgtgtaaaagacataaatttcgttaatcatactgcccaaagccctgtgcttcagttagtctgaaatggaaaga

SEQ ID NO: 609939 - DNA, 382 bp, Homo sapiens
gggtgcctcctggcagagtggcactggcgcgcccgtgaggtggcaccagtgcccgggaggaggcccgaggacacagatgccctgcctgcccgtgggatagcaccggcacccggcgaaggcccagcccctctgggaggtggcaccggcgcccggcgaacgcccgacgaccaggatgcccaacccgcccgtgaggtggcaccgacgcccagtgaaggccagacgaccaggatgcccagcccgcccgtgaggtggcacaagcgcccggcaaaggcccgacgaccaggatgcccagcccgctcgtggagtggcacccgcggctggcggaggcccagcccgctcgtgaagtggcaccggcgcccggcggaggcccgcggtcctcacc

SEQ ID NO: 609940 - DNA, 152 bp, Homo sapiens
agtcgtatgcaaacacatgcacactatgcacacatgcacacttacaaatgacacatgcacacacattgcacacacatgcacacacactgctgaacacatgcacaacactgaacacatgcacacacatgcacacaacacataacacatgcaca

SEQ ID NO: 609941 - DNA, 345 bp, Homo sapiens
atccttccctttcttacgtcaaacaaccgtattttgatttggcgattcattctgaattccatgaattacagcacaacattctttttataatacagcaactgagacttcttaccagcagcaaataatctaataatggtggtgggcttctctaaaagaattgtgtggcgcaaattaaacactctaatgtgactttcccggggagggaaaaattctttttagatattacttttagacaccattgcgaaaaaaaaaaatctcttatattttaaaacttaattttctacacaggctctagccccggggatttcttaagaacattttttttaataacagccctatattaaa

SEQ ID NO: 609942 - DNA, 153 bp, Homo sapiens
ggggggggggggcccccccccccccccttttttttccttttggggggcccccacccccttttgaaaaaacccccccccccccggggggggttttttttttttgggggaaaaaaccccctttttttaaaaaaaaagggggtttgggccccccca

SEQ ID NO: 609943 - DNA, 459 bp, Homo sapiens
  misc_feature (44)..(44): n is a, c, g, or t
  misc_feature (98)..(98): n is a, c, g, or t
  misc_feature (414)..(414): n is a, c, g, or t
atcaacagccatctgctccagagatcactaatgcccagtaactntgggtgaattgattatatataatgaacaaaaagaatgtgccaaagtgggccctnagtctcttcaaaaaaaaaaaaaaaaacccaaaaaacaaactagcttccacacttaaaaccaaagggcaaagaaaaaaacaagatataaacagcagtttgctcccactttcacttgattaaagttcgaaatactgggacccacttgctatgtgtgtgtgcatatgtatgtgtgcttgttgtatgacattatttcattgcacatatgaattcctaaacctagtttcacatttatatgttggggtcactttgaatattgtctactttgtgataaagcaaatgatattttattttgtgaatatgcattaaatatgtgttnatttgtgttaaagattattaccaaatatgtctatactctcaagga

SEQ ID NO: 609944 - DNA, 412 bp, Homo sapiens
agaacttgcgtgagccatgataagaatgacaacagctcttctgatcatcagcaacgcctgctggaccatcaactgcttaacatgatgctcatacgtcattcatgacaacgacaggatagcgtaaggactcatgaccacagaccatgccatgactaggccacatcagagtgcagatggcccctggaagaagctagcgcttgatgtccagcagggctatgcggagcatcatacctgactctactggtgctgtcgaggaagctgacctgggcattccagatctagccgtgaagctcactggcatgagcttacgagttccagtgtcaacgagtctgtgaaggacctgtcctgacgcttagaccaatcctgctaatatgatgacatcgataaggttgtggtgagcgcggttggctgc

SEQ ID NO: 609945 - DNA, 651 bp, Homo sapiens
gctaaagaaactacatggaatcatttttggatcatgaaaaatgtgtttggatcttttataagaaaaagccattgaacttattgatgttaaaaatgcaactatacttggcaaaataaaatcaagctgtgaactgatgcttactgatattctgttagataagaggtgttagaaacatatttgatttttccatgagtcctgcacacaagtacacgcacagccccttattacagcactatatattcaaaagagtatgcaattgaaaacaatgggggtttttttcttgttggtccttaggagaatatcagagagcctaaactatgaacattggtgttactggcctgatttctaccaccggctggatctttggcctgttttcattggaaggatcatagattggcatttggacagaccattcctagcgaaatactggccctttcgcggagcttggaaaaccctgggggaaaaacagaaagctgggaagataagaaggaagaagaagatgtcacgggggcaaaatatgggcggattccggatttgtccaaaggtgctttacattcagtagaatggaaaaaccaaaacaaatgcatgcatagggccacgccctggcaatgaaaagaagccaagaacctggacaatttgggggatgaaaac

SEQ ID NO: 609946 - DNA, 148 bp, Homo sapiens
cagagtgagacttcatctcaaaaaataaaagaataaaaaaatacgtggttattatctctccatcaatcctcacaacaaccctaacataaccattcttaattaaactatttatattatcctaactactaccgcattcctactactctgg

SEQ ID NO: 609947 - DNA, 1037 bp, Homo sapiens
  misc_feature (881)..(881): n is a, c, g, or t
gttgggcggtgctgtttcttccgctcgtcgatcgtgcggctcttcctctgcgcatgtcggctgcggcgcggcggtcggagacttggcctaatatcttcggcgttgctctgagaaggaagaattggcccgataccaatgcctagagctgctcgctaagatccactcggtgtgcggaaagtccccgccgacatacgagcgtgggccacgtaatagtgccgctcagtgaatacagccgctccctcttatccggtcggggctgacaggaacgtcctcgatcgcgtacagtggcccggtgacctgttgggcgccttcgcagagacttcgctcggtgtattcatgaacgttcgaacgcgaggctgtctcactccgggagacgcctgtcgccattccagtagggttgggtgtagggcagcgatcgcgtcagcgagtgttctaaatagcctgactcgtggagtgctttcgatgaggcgccaggccgaatcgggtgccgcatgccaggcagcgctcagctggaacgcgtaccctgccgtgggttcctggttccgcaaggataccatacccttggtgtgcccagtcccaacgccgttacagagcatgtcaacgctagtcaagtagtccccatagaagcatcgagttccacggttagtgccctctgacccgggcattgaccgggcggaatgcagcaagcacgctttcaaggttgcacatgagcctatgctattggtacacttgggcggatttagtaaagcttaggataagcacttctccgtggtttatacaatacttaagccttttccgaggtttgtaacacgtatgcagattggagccttttatttgttcacggtttaaattggcacaccacatttgtgcttgtgctatcntacacggtaacgttcggtttgcgaacaagtttctaggttatgcttttaaaaccggtttcacgttgtccccagttcccgttttttcaaggcgttcaaccgggacgttggaacagcgttgcctgatagaccacggttgaatacctggtgtctccagcc

SEQ ID NO: 609948 - DNA, 212 bp, Homo sapiens
cgcacccaccgcccctgcccaagagcattggggcatggcgtacgagaccaaacatcctgctattggctgggtgaaatgagacatggagcgccgatccggcttgacatggatcaagccacggtcgctatccagcaggagtcagtgcaatagtggcccctcatcacccagaatggactgcaaaactgaacgtcgacgcggccgcgaatttagta

SEQ ID NO: 609949 - DNA, 402 bp, Homo sapiens
cactcgtggtcagggagtgctgttcaatactgggtcaatggaggtctcagattgtgaaaaaaaatccaggtttggaagacactcaataaactgtcacttaaagagaaaatatcagagtgggcgcggtggcttatgcttgtaattctagcacttttggaggctgaggcaggtggatccctgaaggtcaggagtttgagagcaacctggccaacatggtgaaaccctgtctctttaaatacaaaattagttgggcatagtggcatgcacctgtaatcctagctactcaggtggctgaggcaggagaattgcttgaacctgggaggcagaggctgcagtgagccgagatcatgccactgcactccagcctggacaacagagtgagactctatctcaaaaaaaaaa

SEQ ID NO: 609950 - DNA, 1051 bp, Homo sapiens
tcctgtggatggcttcatccctggcttccttcctttctctttccttttttattttgtgattttttgtcaaaaagaagcccttaccgggttttattatttttgttctgtcatagaattgtattatttaagacagtggagtaaggaaaagggtgccagggatgggtttacatagttattttgagtgcattgtaaaacattttctattaattattgctgggttgatcactactgtttaagatgttaacataaatataattccttgggggggagctagagaagggttgtgaatatttcaaggtctccttatgtatgatagcaacgagtatattgtaggtgccatattttggcgggcgaaaatggaatgcgcggtgggtttattctgatagatgcactaatcgatgttcgcctgaagtaacagtgaggccaccaacccagaatgcgctctgtgggaacacctggctggtgggatcgtcctcctcgtgtccacaccctataggagggagagtgtacagcgcaaggcggggtccgtactgacataccacgcaatgagtagtccgctgcagaaatgaaggggaggcatcaagtggtttcgttaacaaaccagggtgaagatagagaccttttgtcacgctcccaacaaggagtactaggggctgcgccgcatcgtggggtaagacgccctcttccaacctgctggcacaacgaagacgcggaagagaccgctattgctgcggaaacaccgcgtaatagatcaggagacgggtcggccacatgtctgcccggcgcgggattgtcgtagaacacggtccgaaagcaccgtgggggaaacaaactcagaaaaaacatgtcccttgacacacagaaactagcagccaaatatcgggacccaagcacgaacgtacaaagggcgtcgggcggcacaaaaggactagcgccaagctgaggcgcaaccccacataagacgcgaaaagcatagcatacacccgcgggcacacggtgctcccaccggaaagtgacggaacaacccgaagagcaagcgaacccagggaaa

SEQ ID NO: 609951 - DNA, 473 bp, Homo sapiens
  misc_feature (17)..(17): n is a, c, g, or t
  misc_feature (60)..(60): n is a, c, g, or t
  misc_feature (92)..(92): n is a, c, g, or t
  misc_feature (125)..(125): n is a, c, g, or t
  misc_feature (135)..(135): n is a, c, g, or t
  misc_feature (143)..(143): n is a, c, g, or t
  misc_feature (162)..(162): n is a, c, g, or t
  misc_feature (178)..(178): n is a, c, g, or t
  misc_feature (222)..(222): n is a, c, g, or t
  misc_feature (232)..(232): n is a, c, g, or t
  misc_feature (287)..(287): n is a, c, g, or t
  misc_feature (365)..(365): n is a, c, g, or t
  misc_feature (418)..(418): n is a, c, g, or t
aaatcgacgaaaccctnggcccctgcccaaaaaggaaaaaacctgcccgccggaaccctnaactgaacttccccaaatggaaactgcccttncttgggctgggaaaaaacccctttccctctgtncccttctttnctctgtanccttcccttcccagcccanactcccagggcggaanttggatgaggccccgtccggagggagccatctcttgctcccgangctgggaaantcctttcctgtggggctcctagggcccctctgcctgctgtgcctgggtggggaancggctgccctgagccccaggtcttgtgggaggctgcgaggacgagagccctggctggagcccccgttgctgttcccanagggcctcggtttttcctaaacttgctctgcatgctgtacaaggctgccccgncgtcatagacttaaaggactgcaataaatgtagagttgatgtctaacaaaaaaaa

SEQ ID NO: 609952 - DNA, 177 bp, Homo sapiens
gggcagatcgtgctcagcttgacttgtgaggtgttggcagcgcgactctcgtcgtcagcagccgtcttgtccgtcggcagcttcagatcttcctagccggtgttggggagcttggacttcaccatcttcttcttagcgttggcgcccgtgatcttgccgttgacaggggacagcgtg

SEQ ID NO: 609953 - DNA, 81 bp, Homo sapiens
aagtggttgctaactacctagaaggatatactaataaaactatttttagactatcttctgtcgacgcggccgcgaatttag

SEQ ID NO: 609954 - DNA, 158 bp, Homo sapiens
cccagaacgctgcctgctgagattgaaccactgcactccagcctgagtgacagcgtttgactctgtctcaaaaacattaacaaaagcggaacccacttttgctcttaaaagtatccactgcaggccgtgcacggtggctcatgcctgtaatcccagca

SEQ ID NO: 609955 - DNA, 540 bp, Homo sapiens
  misc_feature (527)..(527): n is a, c, g, or t
ttgacgcgtctcctttggtttgaatactagaccattctcttcaagacaacgcaggattgttgggtgtggtggctcacgcctgtaatcccagcactttgggaggccgaggcgggcggatcacaaggtcaggagattgagaccatcctggctaacacggtgaaaccccgtctctactaaaaatacaaaaagttagctgggtgtggtggcaggcgcctgtagtcccagctacttgggaggctgaggcaggagaatggcgtgaacccgggaggtcaaggctgcagtaagcagtgatggtgccactgccctcagcctgggcaacagaacaacatgcaatcttaaaaaaaaaaaatcctggccaggcacagtggcttatgactgtaatcccagcactttaggagacggaggcgggcagatcacgaggtcaggagattgagaccatccgggctaacacggtgaaaccccgtctctactaaaaatacaaaaaattagctgggtgtggtggcaggcgcctgtagtcccagctactngggagggtgaggc

SEQ ID NO: 609956 - DNA, 228 bp, Homo sapiens
actaaggaccgtcttgctggggcttgggggccaggagaagtgagagcgatgtgaatcggcgagagtagtctcgaaattctgactcgtcctgaggtagatcttcatctctctgcaatctctcgagcccatctgatagcaggtctgcgtcagggttgcctgcctgaggccaggaacagtgcgcgcgtacccctccttctgctcctgccagtccagcacaagaaccccacg

SEQ ID NO: 609957 - DNA, 1362 bp, Homo sapiens
  misc_feature (17)..(18): n is a, c, g, or t
  misc_feature (522)..(522): n is a, c, g, or t
ggcgccctccggagccnngcgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggcctgggggcggcggcggctggcggctggcggcggcggcggtggtggaggcggctggtggcggtggaacggccatgcgcatcctaggcggagtcatcagcgccatcagcgaggcggctgcgcagtacaacgcctggagcccccgcccccacgcacacattactccaacattgaggccaacgagagtgaggaggtccggcaagttccggagactcttttgcccagctggctggagatgacatggaggtcagcgccacagaactcatgaacattctcaataagggttgtgacacgacaaccctgatctgaagactgatggttntgggcattgacacatgtcgcagcatggtggccgtgatggatagcgacaccacaggcaagctgggctttgaggaattcaagtacttgtggaaacaagcatcaaaaggtggcaggccatatacaaacagttcgacactgaccgatcagggaccatttgcagtagtgaactcccaggtgcctttgaggcagcagggttccacctgaatgagcattctctataacaatgatcatccgatgctactcaggatgaaaagtgggaacatggattttgacaaacttcatcagcttgttggtccaggcttggacgccatgtcccggtgcctttcaaatctcttgaaaaggatggcactggacaaatccaggtgaacatccaggagtggctgcagctgactatgtattcctgaactggggccccagacccgcccctcaccgccttgctataggagtcacctggagcctcggtctctcccagggccgatcctgtctgcagtcacatctttgtggggcctgctgacccacaagcttttgttctctcagtacttgttacccagcttctcaacatccagggccccaattgtgccctgccgtggaagttcccccctgggctctagggacactctaacaaggctctgtccacgggtctcccccattcccaccaggccctggaaaaaccaaactccgtaactctcccctgtacctgttgccagcctaggcaattgtgatgcttcatgcccgaggggccttttctcaatcgggagataaccaggcctgaagccgggaaccttaaggtggtccaggggccagtccagaggggcgcacaccggccaaagctgttaattgc

SEQ ID NO: 609958 - DNA, 1427 bp, Homo sapiens
  misc_feature (17)..(18): n is a, c, g, or t
  misc_feature (587)..(587): n is a, c, g, or t
ggcgccctccggagccnngcgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggcctgggggcggcggcggctggcggctggcggcggcggcggtggtggaggcggctggtggcggtggaacggccatgcgcatcctaggcggagtcatcagcgccatcagcgagggactggacgtgcgcgaggtacagactccgtgatgccgccgtgctgcacacgtcaaacaattacgtccgagagcagttggggcctagacggagacgtgagggaaggtcgcggcgaggttccgggatgatcgtcgttttgtcccaatgcgtgggcatgtgacgatgacgatggcatggtccagacgccgagcaggaacgtcagttgagaccattctcgtcagaatacagcgttgatgcatcacagacgagaccctgatctgaagactgatggttntgggcattgacacatgtcgcagcatggtggccgtgatggatagcgacaccacaggcaagctgggctttgaggaattcaagtacttgtggaaacaagcatcaaaaggtggcaggccatatacaaacagttcgacactgaccgatcagggaccatttgcagtagtgaactcccaggtgcctttgaggcagcagggttccacctgaatgagcattctctataacaatgatcatccgatgctactcaggatgaaaagtgggaacatggattttgacaaacttcatcagcttgttggtccaggcttggacgccatgtcccggtgcctttcaaatctcttgaaaaggatggcactggacaaatccaggtgaacatccaggagtggctgcagctgactatgtattcctgaactggggccccagacccgcccctcaccgccttgctataggagtcacctggagcctcggtctctcccagggccgatcctgtctgcagtcacatctttgtggggcctgctgacccacaagcttttgttctctcagtacttgttacccagcttctcaacatccagggccccaattgtgccctgccgtggaagttcccccctgggctctagggacactctaacaaggctctgtccacgggtctcccccattcccaccaggccctggaaaaaccaaactccgtaactctcccctgtacctgttgccagcctaggcaattgtgatgcttcatgcccgaggggccttttctcaatcgggagataaccaggcctgaagccgggaaccttaaggtggtccaggggccagtccagaggggcgcacaccggccaaagctgttaattgc

SEQ ID NO: 609959 - DNA, 92 bp, Homo sapiens
ggtgaccaaccaaccattgaacctaaattatatgtgtaacaatttcttaaagtgtaacgttagtttgaaacacccccttctgtcgtcttctc

SEQ ID NO: 609960 - DNA, 1468 bp, Homo sapiens
  misc_feature (17)..(18): n is a, c, g, or t
ggcgccctccggagccnngcgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggcctgggggcggcggcggctggcggctggcggcggcggcggtggtggaggcggctggtggcggtggaacggccatgcgcatcctaggcggagtcatcagcgccatcagcgaggctggcttgctgcatggtacaacgccggtgaggccgccctgcacccacaacagcaacacaagttaacaccagacagttagatgtgccagactgagggaagttgatgtgatgtgtcctgtgcaggttcctggatgacatctttggcccaagctagagctggaggatagacattggaggtgtcaggctgccacaaggaagctcattgagacacttctcagagtagagtgatttgtagagcaactgaacactcctagatctagaagaagcttagatatgtgttatttgagcagtttgagcacgatttgtcagcaaggcattggttggcccgtgagtggagtaggcagacacacacagtgcacaggcttggtgctatctgagggacatacaaagggtaactatgtgggaaacaagcatcaaaaggtggcaggccatatacaaacagttcgacactgaccgatcagggaccatttgcagtagtgaactcccaggtgcctttgaggcagcagggttccacctgaatgagcattctctataacaatgatcatccgatgctactcaggatgaaaagtgggaacatggattttgacaaacttcatcagcttgttggtccaggcttggacgccatgtcccggtgcctttcaaatctcttgaaaaggatggcactggacaaatccaggtgaacatccaggagtggctgcagctgactatgtattcctgaactggggccccagacccgcccctcaccgccttgctataggagtcacctggagcctcggtctctcccagggccgatcctgtctgcagtcacatctttgtggggcctgctgacccacaagcttttgttctctcagtacttgttacccagcttctcaacatccagggccccaattgtgccctgccgtggaagttcccccctgggctctagggacactctaacaaggctctgtccacgggtctcccccattcccaccaggccctggaaaaaccaaactccgtaactctcccctgtacctgttgccagcctaggcaattgtgatgcttcatgcccgaggggccttttctcaatcgggagataaccaggcctgaagccgggaaccttaaggtggtccaggggccagtccagaggggcgcacaccggccaaagctgttaattgc

SEQ ID NO: 609961 - DNA, 180 bp, Homo sapiens
cgacggctatgggatctgcccaggactacacccgagttcggcagctagtccttgcaggacaggatctgggttctcaccatgtggaatctcttctctgttagcttcttaccagctcaagaacgcccctctcgaaagtacgactcttgcgaaatgaacctagcttgggcagtaaagcatgaa

SEQ ID NO: 609962 - DNA, 779 bp, Homo sapiens
cacggagttcttggggagctctgtgaaggccccatgggacagagacattgatgtcataggggagcacatgctgctgagctgtgagggtgagcaggtgaatagcacccgggccagcctgcgggacagccccagcatggggcagtcccaacgtggccctgaggacaggggaccactgaggagatggagaggaagggcccctgtcgggagcctcaccccagattggagctgggcctgggaaggtgtcctgagcccctcagcccctcgctgggtggctcaggaactcactgctcatctctggtttctgagcagtttacagagaattgctaatgggtttatgaatcatgggaaacagagaatgcttttttatttttctgctactgacctctcaaaagaaatttccagatgcctcatataagtcaattccatataatcgaggtcaagcaatttcacgactgtgactcagcatttaaatctcctaaaggcagatatttaacccaagagacagagagcttcacttcacaggattcacactatgctgaagattctggggtgtgcagtacatgtgcctgtgtgcgtcctctttgagcaagagtcaacatgtaactggccaatcttgaacaagatgctaacaggtccaccatgctctgtgtccaattaagaaacaaaatgaaagatgtccctggtactccactggctgggaatcaagatgacactccctaggggggcattacatcccttaggtctctccggaaaattccagtcatgctagcttccagaaa

SEQ ID NO: 609963 - DNA, 471 bp, Homo sapiens
taccagctactcaggaggcgcggcaggtatcacgaggtcaggagatcaagaccatcctggctaatgtggtgaaaccccgtctctactaacaatacaaaaattagctggatgtggtggcaggtgcctgtaatcccagctactcaggaggctgagacaagagaatcacttaaacccgggaggcggaggttgccatgagccgagattgcaccattgcactccagcttgggcaatgagcgaaactccatctcaaatttaaaaaaggcctaggtcaaggctgggtgtggtgatgcaagcctgtgaatccagctactcggaaggctgaggcagggggatcactttgaccccaggaggctcgagactgccctgagcttgtgatggcaccacttgcacctcagcctcggtgacagtgaaatccggtctccaaaaaaaagccacgtttagacaacatttcctccttaagcaggctggggt

SEQ ID NO: 609964 - DNA, 352 bp, Homo sapiens
aaggagcggaaggcgacccagaggatcaccgaatacatcagccagcagagacgtagctagcagctgccatctagagaagcataactagaatgaggtaataatactagaagatgaactagaaaagctagtagtactaaagaaacacaagaactagtgtacagaggctaatcccatcctagaacagaaataaaagtagattcagccccacgtacaagcaagcaacaatagctagggaagaggccatttctacaggtcgacaaactgctacgaagaaatacagataaaaaaggcaagcctgaaatagcatgtgaaaacccacatagtacagtagtacctatgaagcagccaactc

SEQ ID NO: 609965 - DNA, 266 bp, Homo sapiens
ctgtagttcagagcgcaatgaataggttttacaagcacttatgttagagaaaattagttcagtgaagaagagcagagagatgccgggtgtggtggcatgcctgtaatcccggcattttgggaggctgaggcgggcagatcacctgaggtcaggagttcgagaccagcctgactaacatgatgaaaccctgtttctactaaaaatacaaaattagctgggcatggtggcacatgcctgtaatcctagcaactcaggatgcttcttga

SEQ ID NO: 609966 - DNA, 593 bp, Homo sapiens
  misc_feature (38)..(38): n is a, c, g, or t
  misc_feature (264)..(264): n is a, c, g, or t
  misc_feature (269)..(269): n is a, c, g, or t
  misc_feature (280)..(280): n is a, c, g, or t
  misc_feature (289)..(289): n is a, c, g, or t
  misc_feature (303)..(303): n is a, c, g, or t
  misc_feature (357)..(357): n is a, c, g, or t
  misc_feature (367)..(367): n is a, c, g, or t
  misc_feature (371)..(371): n is a, c, g, or t
  misc_feature (451)..(451): n is a, c, g, or t
  misc_feature (527)..(527): n is a, c, g, or t
  misc_feature (590)..(590): n is a, c, g, or t
aaaaaaaggggaccgcatgctgtcagggcagcgggggngccccacgcgcccaccctgggactagggagcagagtagaaaccctctctggagggtcccagggctaactggggagccagccctcccttcgaggtagaccatcggcggagggaaccgggaagtagctcccgatggtggcagtggcttcctcagtggtactgctgatagctggggtagcctggggccggggtgccatccttagggggcagctggctggggtcctccanggaantgggggcgcanttcggaacntcgcctgggcctgntgtagcgagtcaggaggattgccaaccgccctcaattgatgggccaacaaggantgccccccantcanttgcctgagcccaccatggccagtgggccactgcgggcagccagcacagccccggtcaatgctccactggtgaaaaaatnccagggatcctccttgccccgaagccgcaccaggccacagtcgatggtggagaacaggcccccccacactgcgaantaccctccaatctggggggctcgaatcctcaagcattggcactacctctcaaccaggtgccgnaat

SEQ ID NO: 609967 - DNA, 105 bp, Homo sapiens
ctgagccccagaggtcaagccatagtcaagcccctgcactccagttgggtgacagagcagccctgtatcaaaaagaaacaacaacaagagcgaaactccgtatta

SEQ ID NO: 609968 - DNA, 81 bp, Homo sapiens
gtcgcggacacgggtatatattactgtgcgagagcgggagtctacggtgcctgggatgcttttgatatctggggccaaggg

SEQ ID NO: 609969 - DNA, 371 bp, Homo sapiens
  misc_feature (294)..(294): n is a, c, g, or t
  misc_feature (328)..(328): n is a, c, g, or t
  misc_feature (357)..(357): n is a, c, g, or t
cgcgtccgaagtaacttacccaaagacacacagtttgtaagtggtaaagctgagttcaagtgcaaaatcatctgactctaaagctttttcctctctgcatttagcctctcccatgtaagtccagcactgaaggtcttcattgcacagccccagatgcctttccagcctgacttttaaatatcccctatacagtcaaagagcattatggagggtctagcaggctcagaggaagtcaagaggaaaaaggcagttcaaatatttttttgtgggggaagcaaaaaaaaaaaagcacanctaaacaaagacatggacatggcataaagtaagngacaaatatctgctgaagtgcataaatgntcagagaaaaggca

SEQ ID NO: 609970 - DNA, 781 bp, Homo sapiens
gagctcatattaaatatgggttattgagctgggctaggtggctcctgtctgtgattgcaacactttgggaggttgagacaggaggattgcttgagtccaggagttcgggagcagcctgggcaacatggcgagaccacatctctacaaaaaataaaattagccagcatgatggtatgcacctgtggtcccggttacttgggaggctgaggtgggaggatcgctttagcccaggaggttgaggctgcagtgggctgtgattgtgccactgcactccagcttggattacagagtgagactctgtctcaaaaaaaaaaaagaaacaaacagaacacactgtgtcgggcccgacatcgaacacgagagaaaagcgtggacaaacccaattcgctgtggaagacggggggcccacaaggtacgagctgacactcggcacaacgccgggtcacacaaggaaaacccgggtacacagacaagcggcctcggacccccccaccgaacaaaaaacacgcccctgggcgacaccgcagcagtgcagaaaacaaaaaccgacaggacaccttccatggcggcacacaacagggggcataacaaccaaccagcgtgcccaaacgagacgcccaccacaacataccgccgccatgggtaaacaacagacaccacagacacaaagagacacaacaaacaccaagaacacagagacagcgaccaacaactaccacaccaaccacaaccacagagacaacaccagaacagcacgcaaaaaaaagaaacgacaaatgaa

SEQ ID NO: 609971 - DNA, 922 bp, Homo sapiens
ggagctcggctcttgagacaggagtcttgctgatgcctctggccaaataaacccctttcttctttatctcggtgtctgaggagtttgtctgcggcttgtcttgctacatttcttggttccctgaccaggaagcgaggtgattaacagacggttgaggcagctccttaggtggctttagcctgccctgtggaacatccctgcgggggactccaaccagccagagcgacgcggatcctgagagcgctcccgggtaggcatttgcccaggtgggacgcctcgccagagccgtgtgtggcaggcccccgtggaggatcaacgcagtggctgaacactgggaaggaactggcacttggagtccagacatctaaaacttggtaagactagtctttggaacttgcccactccatttgtgtggaagcgtggtctgatcacccacggcatgcctttatcggcactttggttttggttttgacttggtttgaattgcttgacggaactggtcttgggaacttgcccgctccatttgagtggaagcgtggcctgatcacccacagcgtgcctttatcagcacttcccctggtggtttggttttgacttggtttgaattgcttcacaggactgggtcttgggaacttgcctactccatttgagtaggaacttgcctactccatttgagtggaagcatggcctgatcacccacgggtgcccagttaccggcactttggctttggtttgacttgacttggattgcttgatacttgggattgcctggaattgcttaggttgggtgtgacctggctagattctcgggtactcctatttgggtcgatccgggtgggggttactggcccagcgtgtgtgtccctctttacctgtcctcggtggggggagcgtttgcggtgacgctttgtttggctcacga

SEQ ID NO: 609972 - DNA, 233 bp, Homo sapiens
  misc_feature (1)..(1): n is a, c, g, or t
ncgagaattctggatcctcccctcccccacacacacacacacacacacacacacacacacacacacacacacacacacacacacacacacacacacacacacacacacacatgctgtccttacactggcttacctccctatacacacacacacacacacacacgcacacactgtcctgtacctccctatacacacacacgctgtccttacactggcttacctgcctatacaca

SEQ ID NO: 609973 - DNA, 321 bp, Homo sapiens
  misc_feature (18)..(18): n is a, c, g, or t
  misc_feature (74)..(74): n is a, c, g, or t
aggaatccgcaggtcttntgactgctagttttaaccctttgaagccttgtgagtcactcgcccacacacacccnccatccagtcctcccaggccatctcttccatacggatggtaacatgccaagactgtcctagaggaaatgatcacgatcacgtggaggaggaaacggacgtgggagaaggcccgccaaaccagcagcctcaccccgcggtttactccgctgcccaccccactttgctccgggggctggcaggcttttggccccacgccaagcccagctcctatctgcaacaagatttatgatcagtaaaaaaaaaaaa

SEQ ID NO: 609974 - DNA, 117 bp, Homo sapiens
cacaccttcgccaggggtggaggcacgcatctgtagtcgcagctactcaggaggttgcaggtgggcggattgcttgagacccaggagttcgaggttgcaagagagcatatgagtgcc

SEQ ID NO: 609975 - DNA, 258 bp, Homo sapiens
gtctatagaggatgcccgacagactgcactgactgtttgccactacagattcatacgaatgacgaggttcagggcctgaccctaacggcccataccacctgtagcgaagcgacacatccatttgcacggacctgcttctgcccctcctcaaacctcaccgctttccctctttgggacagctctgatccccctgcttcctctcctccctccccctggaagaaaaacactgggcagaggaatcccccacctccccgcggg

SEQ ID NO: 609976 - DNA, 376 bp, Homo sapiens
  misc_feature (26)..(26): n is a, c, g, or t
aaacttaaagttgtgggatttcccgngcggggggggcttgtggaggtgggcagactttcctggtgggggggaccggcaagagaaaaggaagagtcctgggggaacaaccaggaagccaacaaaataagccccgtgtgattaaccaactgtttctgtatcgcgccgcaaccattgtcgttgaggggggggggctattcccgcctggggaatggccttgtataagggcgggggacacaccgcggaacaaaccgaggacaaacaaccaacgcgtgagacaaaccggcggggggaggacatggagtcggggttggtatacgccgcgccaggggagacaacacagggcaacaacaacgcgggccacccgggggcacaccgt

SEQ ID NO: 609977 - DNA, 138 bp, Homo sapiens
tctagaggacgctggatgacttctgttgactgctgtggactggaactggaactgtctcgagggcgaggagtcacctcttgatatcatagtagtctgggttgtcgatctggtcctggtgacgccgtcccaaagcacagg

SEQ ID NO: 609978 - DNA, 414 bp, Homo sapiens
ccgtcgacctcaagttatgtatttgtgctctttcagcaaataagagccgctattagtacgactcttcatagcataatgtaagggtttccttcctatcatcccagctcgaatgcaccttatcaaggtgacctgaccggcttctgtttcttctcttccctctagcccacacgcccgttcctgtctgccatcctgcccccagtctaagttgcgcccttctcccaagccccgtcttggccgtgccctttccctggcaccgcccaccagacctgccccggcacagccctcgctcagcgggccagggagctcatggtgtagtttcgtgggatcgtggcaaagcccacgtgtttggggaacacgtcaatgtccttaggtgcctgagaggtcgtgaggcagtagttctgcatcacagttgtg

SEQ ID NO: 609979 - DNA, 289 bp, Homo sapiens
gactatagacctgacaaataggaataatactatcaacttcagcgaacagtcgcaaggaactaaatcccatgtcttttaactctcgtccactacaactctttcccaaaaagactcagttcaaatcttgtaggctgagccactatcattttatcagctattagaaacaggctgaaagtatgtaatagctgataaaacgacagaggttcacccaacaagccaactttgatgatgatatcatggttcatcatcaaagttctgaaaatcgtttccctgcacagtaacagcattc

SEQ ID NO: 609980 - DNA, 279 bp, Homo sapiens
actctgaacactgggctcaaatgatcctcctgcctcagcctcccaagtagctgagactacaggtgcatgccaccatgcctggttaatttttaaagtttttggtagagatgaggtcttgccatgttgttcaggctgatcttgagctcctggcctcaagcaatccccctgtcccggcctcccaaagttctgggatgactgatgtgagccaccatgcctggccatcctccattcttttttcttttgagatggagtctcactctttccccccatgcttcagag

SEQ ID NO: 609981 - DNA, 160 bp, Homo sapiens
gtagtttttaagctagagtcaaagaacagaaaacaatatttgtagaacagaagaaaagatctcaccttcattatacagggtgcaacacaggattgcacagattagccattttgtgataaaaagagagatgaaaattggcagcaaccccatatatattatt

SEQ ID NO: 609982 - DNA, 1057 bp, Homo sapiens
gtaacctattagtatgcggtgctttacgcattccgacgtctgctatcgagttacgtaggtctttgggcgtcgaccggctcgatagtccatcccgtactatgcctagcaaggaatacatacatatcgcgtgttcattataggctagctctcatacaccctcaaacccaatccctcttagccaatattgtgcctattgccatactagtcttggccgcctggactttacgggggcctagccatagtagtctcaatctccaacaatatggcctagactacgtacataacctaaaccctactccaatgctaaaactaatcgtcccaacaattatattactaccactgacatgactttccaaaaaacacataatttgcatcaacacaaccacccacagcctaacttattagcatctatccccctactatttgaaaccaaatcaaaaacaacctatttagctgttccccaatcttttcctccgaccccctctaaaagcggccccgtcctaagtagctaaacgtaacctggacctctacccgctcaacaaagtcgattggcaaagccctacaggccacagtatccagggtgaaacacagttattcacggaggaacaagtcgaactcctctaatacttaaattcttcccttaccaatgtctcgctgagattcaatagccatgcacaacaggcagagacgaaaaataaatcgagtactgacatatgtgccaaggaaagacacattataccccagactggagacacagaaaccgaagaaggaaccagcccacgacacctggaagcagtgcacaataactccaatacagaacaccaaaaacgacctttcacggaaaagagcaaagatacacccaacaaccaagctacgaacatacacaaccacaatgccaaaacatacccgaccccaatacataatgacagacaataaagaaatctagcacacaaacaaagaggtaaagaacacaccaacaaaacgaagaacaaaaaagcagaacaacttatatgaatacgacgacaacgaaacagaagaaaagagaaaactaagaaaa

SEQ ID NO: 609983 - DNA, 696 bp, Homo sapiens
caattttcagaggtccgtctaagcactctttaaattgagccctgactgcaaacatacgttggtcatacccataagctgggacatcgaggattgcatcatggttccacccaaatagtcatgatggtctgcatggcaaaatgaggtgggggtggggcatatgatctgtctgaagcagcatctcattagcgctcctgagattttccagtcgcaaattcacgagtatacccactttctggagcaagatcatggttgttgtcagcatggaccaggtaagtgaccagttagccctgcccttcccttatggcgctccaggctctgtctgtcatagtaaagtcaaagccgtggccgtgccagttttgccatttcactgttcagccttaacctatgcaaattatagctcttggtggagggtgcgtctactcatcccataaaagtcttcactcgctaggatcgtcaacccagcgaaaaaggaggggaagccccttcccttgcggtttttgtgtggactcaggaataatggtgttcattgccaatgcacggtccttttcccattgcaatgtcatcccactggaaattggcctatatgtaaaaaaaaagaaagtatacttttatatttaaaatgtacgcagactctgtccatatggctgattggaatgtactcctgtaatatactaagtctctgtatatgcaataaat

SEQ ID NO: 609984 - DNA, 163 bp, Homo sapiens
caccaagacccagcccactgactcaaatgttaatctcctttggcagcaccttcacagacacacccaggatcaatactttgcattcttcaatccagtcaagctgacactcagtattaaccatcacaggccaggagttctagatcagcctggacaacacagcgag

SEQ ID NO: 609985 - DNA, 439 bp, Homo sapiens
  misc_feature (131)..(131): n is a, c, g, or t
ataaacgtgccttacttacggcaggccaggacgtatagacgaaactgctgcatgaccgccatgtcgctggaggcgactgcccttggcgagatgatcgcgtgataacgcgagctcgatgccacaaatacggncaccatgcgccctgtcaccacctggaatagcaacgtgccaaggtctgcggtacacagcgttatgttgggatcaagacctgtgatcagcggcatcaacaccaacgcggccaaatgctacgaagagcatttgtgcgccagacaggatctggcgcccaaagcgggtcgttgaattcatcctgcatgttcacgcgtccttctgcttggtgccgaagatcttgtcaccggcatcgcccaggcccgggatgatgtagccgtgttcatttttcaggcgctcatcgatggatgcggtgtaaatctgtacctccgga

SEQ ID NO: 609986 - DNA, 239 bp, Homo sapiens
  misc_feature (161)..(161): n is a, c, g, or t
  misc_feature (168)..(168): n is a, c, g, or t
cccagactagcccgacagagcgagaatggcaggcacagcagaggatgacccaccaatcacatgcctatcatatagtaaacccagcccatgaccctacagggccctctcagcctcctaatgactccgcctagccatgtgattcacttcactccatacgtctnatatagnctactaccaacacactaccatatacaatgatgcgcgatgtacacgagaagcacatacaagcaaacacacac

SEQ ID NO: 609987 - DNA, 1084 bp, Homo sapiens
tataaaggttaaaagcagaggttaactaggccaaagaaaatagcaatagctctcgtggttgcagaagaaggggttccgtggagaaaagtgggttaccccagagtggtcttattataaagtgggttcaccacatcagaatttaaatttaaatacttcttcttgtgaagaagccatgtgggaaaatagagaaagccaccttaaactcactctccaagagaaaacacatgtttaaaaaagggagagccagtgtgacaagaggtctcttatacacataaatgtatatgtgaatgtgcaatctataagacagagataacatagcgcatatattatagagaacactctgtgagagatttataaaacgagtgaaacgagaaattattttatctattatgcgtgtgtatttgtataacatgtgtggtgtgtgttatacaaaaaaaagagagacatcgagggtgaggtcagtgaggcgcgcgtgagagtggagctcttctagacgcgcgcgtgtaataaaactactctataagcaacactcctatgtgagcgaaagtggctcaataatggtagcgatgagttgtgtgaaattcaacccgagaagcgtctatagagacacgtgttataagatagatcagcactaaggacctgtaggtgcacaccagacaacgaggtgggggacgagaaaaagagccccgctgataacgattaaaaaaaggagaaataacccacgacgaaagcacaacacgatacacaagaagcagaacaaataaaaacgcccggagaggcgcaagagtagtagagcggtaggagatgaagaggaagagagtcacacatgtggatataaactcatccgcccacgagggaggagcagcccaagaatgacagacaaagcggggcaccaatcagaacgcggagcacaagctgaggacgaaaacaaacatccgtcactcctaatggaggaaaaacaaacgccaccaagaagagaaggtgtggactaagaagagtcaatgagcacaaagtgagacaaaacaccccgaaacaagaatatgatcacagaggagcacccacaattgcatgagagttcccaaca

SEQ ID NO: 609988 - DNA, 352 bp, Homo sapiens
atttccactggtgatatgatggggtgatccatatatattttactttagtgctcataaagtgaagcagtgggggtggaccaggaataaagaaatctgtaactagttagtcatcaattagttgtatacaccattgcactttgaccagctttgtaatatattttgaagcttaaatttatcatccttagagttaaaacttcagggaagtatattaaaatattaattattggatgacaaaaatgttactttccaactgttaaaaaaatatattcacatttgttttaaaggaatgatggttatagtccgtatcacattactaatggtatttagagtcactgtgtagaatttataaacc

SEQ ID NO: 609989 - DNA, 151 bp, Homo sapiens
tatcaggcagctgtctcacatacctgagttggttaaacttgttttagtagactgtagaatcatattatagttaccacgggtaaggaccagtgtcaatccattagggtatccggcctgtcttgggttccagagcctgactactttagggtag

SEQ ID NO: 609990 - DNA, 395 bp, Homo sapiens
  misc_feature (17)..(17): n is a, c, g, or t
catttccaacaggatcntgagggctcagcagtcagccaatactccataggagtctcgatcaggtgcaaccgtgcatcaccagtctcggtagatggtacgcagcgacctgtcactcttctcagtagactcatccacagcccagggtgctgcaaaagcagttcctacgtacctcgtctggacatgatcgtcaaatgtacggcgctccagacactgagcaaaggcgttcatcccctaggcctaaggtatatcgtctagcccatcttatatccgactgggcaacaacactccagcgtgcctctccgctactctctcccctgcaataagcctcgctatagatagcaaatacggaaatagaggatacccactgcattgtgccgaatgcgagtaaggttgac

SEQ ID NO: 609991 - DNA, 127 bp, Homo sapiens
agtcctgcaatgagttgagcactacatttgattacacgttcagcttgcgcacgtggtgagtttgatgtaatattggtttctcgccaggcgcggtggcttacgcctgtaatctgagcactttgggagg

SEQ ID NO: 609992 - DNA, 98 bp, Homo sapiens
acagaccccaagttacgcagaaagagattccctgagtagcagcttcaggctagtccctatccccaacacctcagagcagattcccagattaacagatt

SEQ ID NO: 609993 - DNA, 235 bp, Homo sapiens
agtctgtaacgatacacccatagatgtgaattatgtatattcgagaaggagatcagatggcatccagaagatagtttagatttcagcacattcatggttcagatgcaaaatcagatcatcaaatagatccagcaattcacaatcatcatagccatatcgcgtcacgtccgccgcacaaagatccgcaccaattatctatctcccaccccccccaggcattcagcacccgcaaaag

SEQ ID NO: 609994 - DNA, 374 bp, Homo sapiens
gtactttgggaggccaagtcgggtggatccgaggttcaggagttcaagaccagcctggccaacgtggtgagacccagtctgtactaaaaatacaaaattagccgggcgtggtggtgggtgcctgtaatcccagctactagggaggctgaggcatgagaattgcttgaacccaggaggcagaggttgtggtgagcggagatcacgtcattgcactccagcctgggggacaagagtgaatctgtgtctcaccaaaaaaaaaaagaaaaagaaagatgcttaacaaaggttaccataagccacaaattcataaccacttatccttccagtttcaagtagaatatattcataacctcaataaagttctccctgctccc

SEQ ID NO: 609995 - DNA, 308 bp, Homo sapiens
ggtcactgttctgacacaaggggagagatagttttatctccatggtagcagctgacatcaatcttccacgtgccagctcttaatttttgtttttatttgtttttttaagggataatccaagtcaggcagccccagggtaagcggccccgcttagaaacaccaggtccaatgcgcatcaaagggggtcaatgattccccagtggtgtgtcccgcttgggggccctttcggggccctttgtctaccgggtctcggatggatacgggccaccaaggggcctccacaatctcagagacagggtaaagccgag

SEQ ID NO: 609996 - DNA, 223 bp, Homo sapiens
  misc_feature (29)..(30): n is a, c, g, or t
  misc_feature (138)..(138): n is a, c, g, or t
aaatctgcatgaaggaatcccggctggcnngccaagatttactcatcgccaagatttactcatcggccaagatttactcatcggccaagatttactcatcggccaagatttactcatcggccaagatttactcatcgnccaagatttactcatcggccaagatttactcatcgccaagatttactcatcgccaagatttactcatcgccaagattcacttctc

SEQ ID NO: 609997 - DNA, 684 bp, Homo sapiens
  misc_feature (412)..(412): n is a, c, g, or t
  misc_feature (496)..(496): n is a, c, g, or t
tgtccaaacagacgggcggtattcgccctccagaaatgggttgtgcaaacgccgccccggtaccccacctgggtggtgtacgcaccccaaatttggggtggccgcgctcccctcctgtgtgggcgccccccaccattttcgggtgggcccacactcgggatgcgttccccccctttatttatttctgggggtcgataataatactcgtctcttatcgttatgacatgcgtctgtgtggactacaaatagtcgctcctctacgcaccaggctagttcttcttgctgacgggccttctcgcgcgcgacgtcgtgcgcccactccctcgtgctgttgcgcgcacgcgaggcttgagaggtgtggtacaaccacccctgcgtgagcgagcgcccccgggcaggcaataaatttagngttcgccctctctccgcccctcctctgtctcctccatgggtgtctcttctgtgtctaccgcccgtcttctcccgactatgctcncgcttgtatttgtacacccgaggacccctctcacctactgggctgttgagctgggaaaaattctggcgccatggtgtttatagagatttttatcttctgcgagcaacgcgatgatgatggggtacggtttcttatggaagaataacaaacccctgctgtggtaacagccacaacaataagacaaagaa

SEQ ID NO: 609998 - DNA, 246 bp, Homo sapiens
cggcgtgtgcctacaggagagggagagggctttctgacatatggcctacccagaggtcatctttttctaattggtcggatgagaaacaaacatggctttttctaatatggtcctcccggaggaaaggctgttttctaatatggtccttttcctctagagcccatgctcagaatcggatctttcttgggccgtgcaggaagggcacccatgtgccaagcagaggccctaggggtctagaggcagggg

SEQ ID NO: 609999 - DNA, 351 bp, Homo sapiens
  misc_feature (10)..(10): n is a, c, g, or t
  misc_feature (325)..(325): n is a, c, g, or t
ctcgtgcgcnttagaagttgacccaaggatttggtgggagaactggataaattagttttaatctaaaagccttgacactaacaggatgtgggggaaaacataaacttctaggacttaggagacctgtgcagccatcttggttgcctcactagctcttcctctgttggaggataggtgaaattattgccataaccacctcagaaggccatttgaaaatcttggccaggcgtggtggctgacgcctttaatcctactagcactttgagaggtctaggcaggcggatcatttgcagtcaggagtttgagaccagtctggccaacatgnttgaaaccccgtctcttactaaaaat

SEQ ID NO: 610000 - DNA, 232 bp, Homo sapiens
cgatcccccatatgtagcatgggataccttatgtcagcctgcaggaagcatcatcatatctatccggagggacagaccagcacgacatcacgccaggagcaaccacacatggtaatctagaattcagtgtgccgacaatacataagaagataacctaccttcagaaagccaagcacattgaaataatgtggtcataactctactcttcagtcactaccaatcaacatagatg

SEQ ID NO: 610001 - DNA, 285 bp, Homo sapiens
gagacggtatctctcacccagtctggagtgcaacagcgtggtctccgctcactgcaacctccacctcccagattcaaatgattcttgtgcctcagcctcctgagtagctgggactacgggcatgtgacactatgcctggctaatttttttgttatttttaagtagagacgggatttcgccatgttggccaaggcaggtggatcacttgaggccagaatttgagaccagcctggccaacatggcgaaaccctgtatcactcttttaggcccttctgtcgtcttctc

SEQ ID NO: 610002 - DNA, 783 bp, Homo sapiens
tgcgcatgccagctatgcccagtaattttgtattttagtagagaaggggtttcaccatgttggccaggctggtcttgatctcctgacctcgtgatccaccggtcctcatgccttccaaagtgttgggacttacaggcatgagccactgcgcccggctgtcttcttcatcttttgaacagggtctttcagagcataaattttacattttgataaattacaaagtcatacaccagtttcatttaatgaattatgcttttgatgtcaagtttcaagaatctttgcctagcccctaggctctgatgcttctaagaggtctcaagttcaggtattattttatgcccatgacccatttgtgagttgtcgtgtagtgtgaggtttacggatgtcggtgctctattgccattgtctgaaaaagctatccttcctccactcagtggcttctgcacctttgtcaagaattaggcgttgttggatctattgctaggttctccagtctgtccattcaactatatgtctgtccttctatatatccaatctcttgatcactgtaggttatagtataccttgacatcgggtacagtgattcctctcactttaattctttttcacaactttagttattaagtcccttttgcctttccatgcaccttttagaataaattttttatctaccaaaattttgtgctgagattttgatagggcatttgggtccaaactaaacctaggaagatcgatttctttaccactgttgtatcttctaatccacaacatgatatgtctctc

SEQ ID NO: 610003 - DNA, 274 bp, Homo sapiens
gatggtgatagtcataacgggactcagagtggggtacccccatgcaatatagggctctagaatcctcagcatgttaatcgaagccgtagtgagctgtcacgaaggttccactgaagattcgacgaaggcgaagaagctgcaacacctttcgaaccttagggctcactccattgatacctctgattctgatgacaaacgccaattggggattctgcaggatacatagaacgtggccagcattttctggaccagtcctcggccagttcgaagtttc

SEQ ID NO: 610004 - DNA, 798 bp, Homo sapiens
  misc_feature (1)..(1): n is a, c, g, or t
  misc_feature (773)..(773): n is a, c, g, or t
ntgctcacatgcatgtctacccccgttacgtaccataatggaggacgccgctcctgtcaattctccgtttggccgtcaatatcaaaaaggacttgttcatatacacccccaataaggtgatactcctcttgtccgaagtatgtgcttaagccatcctcctcacgcccctctgtgtattcaccccgcatgctgttacgcaattaccccctcgagctctttctccctcggcgccatactttctgtccaatttcttcctccccccgtagctaataaccccccttcagacaattgtgccccctacccgaactccctaagttcgctcccctataaagacgtcatcatactacataatcccctctcataaaggtccttcatacgtcatatctccacctaatagcttcattaagtcgatgatttttcccaacgcctactgtgaagacgtcgccgtcagtcaccccccccttattgacaccccaccggggggtacacttttcttctggagttagtacccaccgttgttcgcctgagacgcaaacattactttgtcgcctctcccactaaggtctacactcaaatgtgttccccgcccttaatacccggttacaatcaatcgcccccaaccactaaacgggggtccaaccactcaacccccccgtctgccaacaagataccccctatgtattcacgtgggaccccccgcccatggtataaaccaccggaagcccccctatgttgcggacctaagtactcctctcgaccctcgacaatctatnttcccgggttttccccgccccacaa

SEQ ID NO: 610005 - DNA, 103 bp, Homo sapiens
tgttcattttgaagacagaggagcagctgttaaggctatggatgaaatgaatggcaaagaaatagaaggggaagaaattgaaatagtcttagccaagccacca

SEQ ID NO: 610006 - DNA, 197 bp, Homo sapiens
cctcacgaagcaagtgtctttcattagttatggatgatgaaactagaaagctgaagcaaaaaaaagaatcacttttctccccaaaaaaattggactaaacttttgaagaactggagcgacaaagacaagaaaaccgaaagaaagcagctggagaggaaagcagaaaacgtttagaaaaagagaagggtgcttttgaa

SEQ ID NO: 610007 - DNA, 397 bp, Homo sapiens
acgaccagctagtcatgactacagtgtctattcatgatttcccacggtccacgttcaggtggacgcttggatctcaagcacagacaattcacacgtctaaggtcaagtaatacaaaaccctagaatttctagagttgcaagagttttaatgagctagtgcaggggaatggaagcagaaagcatggatgttgagagcccagaatacagaagctcttatcttctttaagttattaacttattgcttctcagctccaaatctacccttctttgcctgctcagtgatgagagatgggctctgcaaatacttctcctttgccagttatcaagaaggtaaggcttctcagtgaagggcactgcagggtttggttgtgcctctgtcaccagcctgttgcagtgt

SEQ ID NO: 610008 - DNA, 447 bp, Homo sapiens
caggaggcttcggctcccaggatcaagcgatcctcctgcatcagcccccctagtagctgggattacaggcacacctcaccatgcccagctaattttggtatttttagtagagacagggtttcgccatcttggccaggctggtctcaaactactgacctcaggggatccacctgccttggcctcccaaagtgctgggattacaggcatgagccaccatgcccggctgctgttacatttttaaatgtgaggctccaggtgtaccccctgtagctaggcaggcatacacacaagcccctggggtcagcagggaatgaaagatgggtgcccagggagaagggacatcactgttacagcaacagaaaccaccccagatatttcaaccacagggcatttaacacagggaatgggttacaaaggtgatagaagggctgggaacagtgggaaggt

SEQ ID NO: 610009 - DNA, 272 bp, Homo sapiens
acccggtgttatcgatgccgtattcttctgcacgctatgagcagctcatggaggcctgggagaagaagtgtggagctgcatcgagaacaacccccgtgtggtgggccaatggagagcaaggtgctgcgagtactacgagcaagcagttccctagagatcctgcaagcagcgcgagatgcaggatgcggcatgcagagcatggtgggccagcggggcagagggcttgatcatgtcggccgcccgcagggacgcacgaagggtgtcagagatca

SEQ ID NO: 610010 - DNA, 108 bp, Homo sapiens
attacgaggtattacagcaatccaggaagtgatgatagcgccttgaccacagtgggtatcagtggggaatggggaaaagtagttgaattctgggcacacattatggag

SEQ ID NO: 610011 - DNA, 647 bp, Homo sapiens
tccccgcccccaaaattgccctttgggcttggaggccccgttctttaaaagggactctggtccaaatgggaaaacccccaacccttttcggtgaattcttttatttaaagaggattttcgaatttggcccattggtttaaaaattagttttttacacaaatttttacgggaattttaccaaaatttttaggccttcaatttgccattcgccattccaggtgcgcaacttttgggaaagccgatcggttcgggcctttttcctttttccccacctggcaaaaaggggattttcttccaggggaattaattggggtaccccaggggttttcccattcccacgttgttaaaccacggcccatggatttttaatcgccccccctaagggggattgtggggccgggccccccccccagggtgccgggatcattaaactttaaatcggattcggccccaggggtcttttttttttgtcccaagtgttgaatttcattcttttggtgattagtttttttttgtttttcacagctcaacctttctttaatgtcatccagggagggggccaggtatggaggggaggggttgaggagcgagagacagttatttttgggtgggattcacctcgtgccgaattcggcacgaggcacgag

SEQ ID NO: 610012 - DNA, 880 bp, Homo sapiens
ggcggcgggatcccggatgtggatcaagtggtgggaagcgtgcggtgccgagaaatggcggcgctcacaattgccacggtactgcaattgtttcggtttgggctcgggtgactcttctcaaatgccttctcatccccaatagtaggggattcgcaagggcagccattcaacagatttgtgaagtacacgagaaatggttgtgtatcaactcacaggtgtgccaatatcacagtgttatatgaggcaattcagagtgacgtgtggattacccccctttctttgcatgttggggtatatccgtgtcacattgtgggccaaatattgtgatcaagaaattgctgaatgtcaataattggaataactcacaggtcaatggacccttacttttccagagattttcccgtcatcttaagtggatgtactcttttgtgtatgctgtccgtgagtgctgtaaattgcatttgttggaaaaaaacgggggtaaagaactaacagaaaagcaaaatttattcttggcgggaattacttctgtgggaatttcggttataagtgtggtggaccaatattcattttcacgaacaatgcgtttaattgggtaagtggcacctccagttgcgcggtaatttcggaaaggcctatggacggggcactcctttggtggtccatacttcaggatttacttttgttacaggtatggtgttattggtgggcacactgttcgcaataccgcggtcatcggcgagaggtcgcgtggcggtccgcggggggagagcgcatggcccgcgaacaacagcaagtcccctaggcgtgaagtggcccgggagtgcagcggtcgtgtagtttcccgtgctatcatcgtttgtctttttttttctttgta

SEQ ID NO: 610013 - DNA, 963 bp, Homo sapiens
agcgggggacgggcgcggcgcggggcgcggcgcttctcggcggctgcgtgccggcgcggggctgagtgctgtggtcgggagtggcggggtggcgagatgggctgtgcagactgcggcacgtgggtagtctggctgcgggcgtcctcgcgtgctggcttgatcagctgttgcgggtgcgcgtggtgctgggtcggctgcggacccgtcgcgaccgcggaaggtctagggaccggtagtctgggaacccctcaagttgcctccgaccaagtctgcggccgaacgccctcgcacggcatcgaggtagaaattgacaagagagatagcattctagtctcggctcgatgtagaaaggtatcatgaagtccgatgattgacgcattagcggagagaagatcggtcgaataggtcgggattggaaattgttggaacccataatcatcaacgtacaacggttcatatttggagaaggcaatgggtgactcgaggtctcttattgggagttcaaggatggaaggcttgtgcattctgttactagctatccatgagtgcaggtgtcacatgctctcgagcataggagcacataaaggatttggaatgccaggtgaagggaacctgaagtggtcaggactgtatttttctgaagacagcagatgcagggttacagctgtgtggcctgaaatcatccagaggaggggaggctgtggacatggcaaaaacgtgaatcggggccccgctattgagagcgaagaactacaggagctggagcgagtggggtataagggaggccggcagcctgttactatggggggttgtggtaccagtgctactggaaggatgttctgagtgaggaaccatgaaaggatcctaatgtgtactgaatgattaatgggggaagcattggtaatggctggttaagaatgattcaggggggtccctgatttaaagggttgattagaggagaat

SEQ ID NO: 610014 - DNA, 1208 bp, Homo sapiens
ctggcatcactataactacataacagaccgcaaccatcaacaccaccttcattcagaccccgaccggaaggaggagaccccaattctataccaacacctattctgattttatcggatcacccatgaagatttatattctatatcctaccaggcattcggaatacatctcccatatagtacacattactacatccggaacaaaaagaaccatattggatacataggatatggtctgagctctgatatcaatcgggcttcctagggttcatcgagatgagacacaccatataatacacagaaaggcatagacgatagcacaacacgagcatatgtcacctccgcataccataatcatcgactatccccaccggacgtcaacagtataaaagacagacatcgccacaactccacacgagacagcaactcatgacacatgcatcctgccatgcaagaggctcatgaagcccctaaggactcacacattctcaacccccgctacaggctagacctgcaccgggccactcagaaaaacgccacaacactcaatcactagaacaatccgtaactaaaacgaacacggtaacaaacgctagatacacaccccaacatccaactactcgctcctaaccaatcacgagacatgtcataatgcaccaacactaagagagagatacactcaacatgaacgcacaccaactcccaagagaacacaacactaaaacacaaaaacaaaacgcaaagaaaggacaaataaacacgaaaccatatgtcaactcgccggtaacaccgaaagaactgataaccaacaccagcttcgtcgcgactatccaggaaagccccagaacgataaaccagaccaccccgacaggcattaacccaacagacaaaagcgtaaaacaggaagacacaccaaacactcaaacgcactcaggttacaccaagacatgacaatggccaccccatcgccgcccccaacagcgaacgtcccagaccgccccaaaaggacaaacagcagacacaccaataaccaccgaacaccgatcagcccacaccagggtgtacaccccatgtcacccacccacactactaaaacaaacgagtcagccaaactcacgcgacgagacactagccagcaacaagagatggatcagcgcgaacaagccgcgtgacacagcgcactggcagaccgcaacccgaacgacaccagc

SEQ ID NO: 610015 - DNA, 1143 bp, Homo sapiens
  misc_feature (293)..(293): n is a, c, g, or t
agcggaggggggaaagctgaggtgtcgccggggaccgtcgggctggatggtcgagtggatgaggcagcgagggtaggacagtgaccgtctggttgactgcgaaggacgcccgagccaccatctaggtttcatcctcgctccgcgccgttgtttcacgctgatggagaggctcgtgcgcgtgccgcacgtctggagggggaaactgaaggcagggagtcgggccatgatagggagcatgtccaggccatctccaaacatgggagtgatgggctgaccgaccgctgactccacancacggacttcactggaccgtactgacgcccgctcgtggttcactttgagccaaatcagtcgtgcttcttcgcttgggggggcaacaattcgtagatgcgcattgaatttttcgcggtgacttggcttccctcgcgaagaaggctttgaaggtggtattccatgcaccaggaacttctggcagggagatctcaaacgcgtaggatttcaaccagctggggggaacgccgaggcatagaacacaggggcgcccagggagaagtcgcctcacgggcggaccaacgcacccgagcgcaggtgtctcaatgactgcaaggtggaccctaccaaacaggtggcggaagcggatacgcccgcgtgggtaagcaatgagcgcatttccggaatgtggcggccgccacttggacgaaaagggctccattcgactcgcaagggaaaaccaaagctaggctgaagtggacctctgcaggggcaatggttatgcgtaacgattccccatggacattatagaagcagaagtggggtgcctttgacgaacgggagaacggcccccccaaggagatgaggtggcacggcccagtggggtagcattctttgctctctatcccaagggccttgagccacgcctagacttaacaaaaagcttgggaacgaacacgcgtaggaagacctcccatgtcgtggaacgacgtggggggcttatcaatagtggggtccacagccccgggggacgccccggataggccatgggcacaccgaagccatatatcaatgctcgcccgaaagggcgaccacactcgcttggggaccgcccgtgacggggcgtgtggtgatctcgaaacatgagattag

SEQ ID NO: 610016 - DNA, 302 bp, Homo sapiens
  misc_feature (102)..(102): n is a, c, g, or t
  misc_feature (117)..(117): n is a, c, g, or t
  misc_feature (136)..(136): n is a, c, g, or t
  misc_feature (195)..(195): n is a, c, g, or t
  misc_feature (243)..(243): n is a, c, g, or t
gaatttttgggctggcgaatcctgacgacgtgcggaatatctgtgatgccaaaggaaatagttttgtcgatgcgatgaaggtttgcggatttactcttccgnacgccccactaactncgcgtcaggctattatagnctttgttgaactgcatattgaacagggctgtgtgctggaaagtaatgggcaatcaattngcgtggtgaatgcaattgtcgggcagcgtcgttatacggtaacgttgnccggcgaatcaaaccatgcaggcaccacgccgatggggttatccgtcgtgatacagatt

SEQ ID NO: 610017 - DNA, 180 bp, Homo sapiens
ccaccctttcccaaagtttttgaagctttgataggttgatttataggtctgtcctatatgtaatataaacacgtacctcacagacacttttacaagagttaatactcaaaattacaaattgactgacacttatcgagagcaaagcagtggtaactcgatccttcagatgttgcacatcac

SEQ ID NO: 610018 - DNA, 1224 bp, Homo sapiens
agtacctcatggacagcgaacaatgagtggaagctgccctaagactacctacttatgactttgatgcctgtaatgctgctgaccgacaagcaggatggaggtacagtgaaagcggacagcagcagcgtgaccacagtacactcaagtagagtgatcgacactgccactcgcttccactagactatccaagtttcaacgcaaggcagaaacagagtgatggcagtactcatggcaccatgggttgactgctgatttactcccgaccctaagcacgcacaggcgccgcaagcaaccccatccctggagcaggtgagcctgtggacacacggctcccgctgacctcggacactcctagccatgtcatcttgctgcgatttgctgccgagtgcatgcgcaagcggcgcctccgggtacacacatctcgccccctctccacgtccccttgggcgacgtcccagccctccgtgccgtggcgattccaaagcacgcctggacgcgcacacctgtcggcacacgccactgtgcgcgcatgtcgacgcactcttgtctctgccccttccgcctctaccttggtccccacggtttcgccgacctgggcccaatttccccgtttgtgccccaccgcgccgagcccctttcccccagaaaccctccacccacaagggctacgttcgacctccacgcggacctgtggcactccccgaggtcgcgcgggaacccggccagaccacacacttcctccgcaaggggacgccctggcgctccaagtcccacagagcaccgctaagcaccaaaccgcggagaaaaggcccgccatcgctccgtttccatttccccccccgttttaagctttctcccagttccttgggtggccccttgccccgagcggcaaatccgtggccccccggcgccccaggcttgtccctttaacgtcgggccggatcttacccccaggggcccccccggggccgcctaaccaggccccctcaggcgcccctcggcccattacttcgttccgcacccgcgttgggcagcctccccccccgcgaaggcgtcaacttctccccggggatacccccgtcgggtgtccccatggcaactttctttttgcccccaggacgccccggctgtgcaaggtcgggccgccttgggcgtcagcgcctcgcccgctcctcacgcgcgcgcgatctcccgcttctgagccacgcgggatttccccttgtg

SEQ ID NO: 610019 - DNA, 175 bp, Homo sapiens
cagagaagacaaaatgttgaactgggtaccgtgttatgatgctaagaatcaacgaccagtagtccgttccctatttagagcttactgtcttctggagaacgttgcaaaattggattattcatatttcccactgtaggtactttacttctgagccttgagatagatggactgagtc

SEQ ID NO: 610020 - DNA, 1301 bp, Homo sapiens
  misc_feature (109)..(109): n is a, c, g, or t
  misc_feature (697)..(697): n is a, c, g, or t
  misc_feature (780)..(780): n is a, c, g, or t
  misc_feature (870)..(870): n is a, c, g, or t
  misc_feature (884)..(884): n is a, c, g, or t
  misc_feature (923)..(923): n is a, c, g, or t
  misc_feature (961)..(961): n is a, c, g, or t
  misc_feature (965)..(965): n is a, c, g, or t
  misc_feature (975)..(975): n is a, c, g, or t
  misc_feature (1027)..(1027): n is a, c, g, or t
  misc_feature (1067)..(1067): n is a, c, g, or t
  misc_feature (1087)..(1087): n is a, c, g, or t
  misc_feature (1094)..(1095): n is a, c, g, or t
tccagtcaagtttttcactcttccgttttggccatttgaacagatggaggggccaagatccgagtgaatcaatgatgggggacccgaatttttaaggaaattgatggcnttccattaacacgggggaggctcccaacctcgacaacaatggctgattgatttctggcagctgctggacaagtatgccctggaggcgcttttaaggtcatgtgtgaggatgcgcctctgcagtgaacctgtccgctggagaacgctgccagaaattcctcatcctggccgacctccacacgcgcagatccagttgaaacctcaggcaatggatttcatccactatcatgcttcggatgtcttggagacctctgggtggaaatccatggtggtgtcacatccccccttggtggctgaggcataccgctttctggcttcagcaccacgtgccccttttttgggagcccccaccgccaacgcctgatagccatcctatagatcctgcttgttgtaagactccgtttaatttccacgaagcacgcagccacctgttgctgccacctgagccacccacggtagacacgcgccatctgtggagcttttactctcttgtgaggggaagagactgcacttgtggcccccgactttttaaacagcaactaaataacttgggggaaaacggggggagggaaaatgaaatggaaacccngtgctgcgtcactgtgttcccttggcctggctgagtttgatactgtggggattcagtttaggcgctggcccgaggatatcccngcggtggtacttcggagacacctgtctgcatctgactgagcagaacaaatcgtcaggtgcctggagcaaaaaggaaaaaaaaaaaagaanggacttggagtttnaacagaaggggaaagggaaagaagaaaagattttggcanaatttctcaaaaatcagttgggggatcccagtagtatntatntggagagaancaaattttagtccttctaacggtgctaaaactgggatattggtgaaaactcnttaccaccatacaagcttcagaagagctctctggtggtangcacttatggttggcaagancagaatnncattcctttatttccttttattgaacaaattgacaacgtgacggcacacaaggggaacggttattggatctgggaagatgagtgtcctgatgtggtggcctttggcaaaaactcttcatgggcgtcgaaaccctgcaaaacactacctcatccagaattccatatggtctggacaagacctatggtcctctgtttcagatatggtg

SEQ ID NO: 610021 - DNA, 926 bp, Homo sapiens
gagtgacggagtgaggagatgacatggggagcgtggagctcgagaatactgcccagttactctagctgcgccagtgccgaacctgcagcttcttggcttaggtacttctactcacagctggcctgattcctgaggccaactccagcaaattggctttatgcaaatctgcagtgaaatgtgctcatcagatgacatgcctggacccttgctgcacggacacgactctctgcaaagacctgtgacgtggcttgcacggattggttggacaaactgcagacacccttatgcacaatgacggactgcatgactaaggcgtgacgcttgcagggaccttgtgacaatggaccttactagggttcctgctactgaccacccaaacggatgacctgcatgactgtcactcagactgcacgcttgagaaacctccatggttggttgtggcacgtggcttgagcacatggtgatgagacaaatggttggaatcattgtgagtgcccagatacacaactgtgaacgtggcactccttttgaggttccattgacagcaacctccacaaaatgggagaccaacatggcacatcaagattggcctgaacggaaactccaactctggttgtgcaacatggattcgattgtttagccattgggcaccaagggcatgcatttaccacacacagggccagcaactgtgcatttcgcatttggaaactgtgggacggggcaacaaagttggtgtcttagttgggaaaagggaaaggtaacaattgagggaacacaatggtacggcttggaaattgtggaacatatgatcgcgctgggggtgaattatccttttggggcccttgagggcatggggatttgggtcgaagagaaagtagtaagattaacgactatggggattagacgagggccattataggtgaata

SEQ ID NO: 610022 - DNA, 410 bp, Homo sapiens
tactagttttcaattttgatatttaaaaaaaaaatttttttttttgagatgcagtctcacgctgtcacccagactgaatgcaatggcatgatctcggctcactgcaaaccccgccccccgggctcaagcgattctcctgcctcagcctcttgaatagctgggactacaggcacgcaccaccacagtcggccaatccttgcatctttagtagacacagggtttcaccatgttggccaggctggtctcaaactcctgacctcaagtgatccatccgccttggcttcccaaagtgctgggattacaggcatgagccaccgtgcctagcgtgtggaggcttttaaagggcaacagtatttattcctatgatgttaccattttttttttgggagatggaatctcactctgtcacc

SEQ ID NO: 610023 - DNA, 157 bp, Homo sapiens
  misc_feature (45)..(45): n is a, c, g, or t
  misc_feature (50)..(50): n is a, c, g, or t
  misc_feature (82)..(82): n is a, c, g, or t
  misc_feature (107)..(107): n is a, c, g, or t
gctctccagaaggggatgcaagctctccagaaggggtgtgatctntgagnagtggggagtggagtcaccactcgggacatanagggtggacagttcaggcctgtgtntgcctcctcgggactgtggagtgggtgccctcagtaaagcgctttgttgc

SEQ ID NO: 610024 - DNA, 340 bp, Homo sapiens
  misc_feature (281)..(281): n is a, c, g, or t
cgctcaatggaattccaataatattattaaaatcaatatataaaaaaaaagtaaaaatggcacaaagatgattatattcaacaaatgcaaaagatatcgcagtatcatattctaagttagctatttttagcggcatgacaggaacagcaatgtctttaatcatcagattagaattagctgcacctggttcacaatattcacacgggaattaacagttatttaatggcgcgcctctcagtgcgtatatttcattgatgcgtctagtattagtatcatgaatnataaatagatacttaaaacagatgactaactaagtaggggctaactttatgtgaataat

SEQ ID NO: 610025 - DNA, 892 bp, Homo sapiens
  misc_feature (80)..(80): n is a, c, g, or t
cggccgcggagccacacaacagaatcgtctactaagaccgagacacagccctgagtagccacaatgaaagtactttaagnagcacttgcgaagaagagaaagacaaggcattactctgtcagcagcctgctcggtcagcagctcgagatcaccaacagtagcttaccttgcttctggaagctcccctagagaacatcactgcagcaccatggaacaagcagtgagggcatgcctacaactgctgcacttcatactctcctggaaatagaatatctgaccttcaccccctccatgctcccaatacgttagccagaaccctacattactctccacaaatactccttattacttaggagcaattgacaggcacgaccaccaaccctcccccgaccggccaccacccctagcccgccgctccaaacaactattaccccactccccccgacaacccccactccccgaacaaatgagcgaaaatcctcacctctttcctacccccgacaagaacctcttgatcgaacgcgcgagcgcgccccgccgcgccccccctgatccacacacagaagtggaaaacggaataccgcccaacgtcgcgacagcacccgcgcagcgcgagcggggccggcccacgcacctgccctgtccgctcgacccctccgccgaccgtccgcccgaccgagacgagttcccgtcccgcgcccggcgtcctcgcttacgtatcacaccccgctatcaacatcgaagacacacacacgacgctgcagtcgcacacgcaactcgcggcacgtaatgtataatagaaacacacgcaccgctgccgcagctacgaaccgtatcctctcgtctccgaccctctgaggcgtgcattcgcgccacccaaccccctcggacg

SEQ ID NO: 610026 - DNA, 1008 bp, Homo sapiens
  misc_feature (1)..(1): n is a, c, g, or t
  misc_feature (278)..(278): n is a, c, g, or t
ncacacacaacaggaggcgaaagagggtggacatcgacagtgcccaactaaggtacaaactccgtgtggtaacaagttgtgccgctaagcaggtacactcgcgttttgaaacaatgcccgcacacaaagttgtgtgacaccttgccggatgtgtcccgcaattacccaaataaggcttccggaatcccccggacctgccctgaaataggacccaccgcggtccgtgcataggatgcacaaccaaggcgcccatccgggcacaattacgcacctggtgntggcctgcacgaacggggcacacaaggtgcgacagctccagcggtggcaacaacacggggggcaagacacgccctatatgtgctcggtggccccaaagggttgtgttcaatagaagaaggtggctgtgatggagtcgtccctttctggagtgtgctcctcataaacaggggtaatttccgaggttctgccgcccttcttaggccagcgatttgttccatctggcggcacaatggtgggtgaacaaccggcgtacctggagaaacggtttccaaaaacagggccccgtcggtaagatacgaaacaacgcacgctgtttcctactacatggtaggacccccccccacggagggaatttgcctctcgacacgcccccgtttgaacacccttattggagtagataaaacggcgggggcaaaacacattttaatagagaagtttgtatgcgcgcactatgttgagaggatgaagaacaccacccccggttgttgagaccccaatagagcgcgatttgtcttgcattttttaactcacagaacaactgggagagactccagcgccttcctctgagacagaagccaacaataggtgacgccagccttggtcgccgcaattaaccgggtcatgtcgacaacaacatgggctacttcttcagggatgataatcttgtctgcggtttccgcgtgaaaaagcccacaaaaaccgggttttgggtcagtccaaacaaaaaca

SEQ ID NO: 610027 - DNA, 1767 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatgtaagcttaatcaagtgcaggcctaggagagaatgcaaagtctgctctgctcccatgctgcttgggtggtgaagaactgttgtaaatcacattacctagcccaaagggctctgagaagtgctgataacagttttctggtttaataaggtggcaactctccattaaccaccttcctaccagctagttatacactaattaattaagtagttactaatgttttacctccatcctcctcgtcatccattctgtctagttactcagatgaacccgggggagagtggagatttttgtaggacgatgtcaaaactcttgattttttgtgaataagtaaccttgagattcaagagtgtggcttcaagtacaaggcacagtgctaaaagatgagctccagttctcatcatactcatctcttaccaaatgccctcaaatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatcatggagcctgctggtttctagatagcgacagagagaagcagcagttccttctctgaggaaaagatacaacaggatggtttgaaatccatttctggtccttaagagagatgtgccatgcttggaagactggattttttgttttgttttttgtttgttttgtttgagacggagtttcactcttattgcccaggctggagtgcaatggcgcgattttggctcactgcaacctccccttctcgggttcaagtgattcttctgcctcagcctccagagtagctaggattacaggcatgcaccaccacacccggctaattttgtatttttagtaaagatgggatttttccatgtt

SEQ ID NO: 610028 - DNA, 316 bp, Homo sapiens
  misc_feature (265)..(265): n is a, c, g, or t
tttagataacaaagttgtaagtgcttttatagatttcttaaaaattatatttgtagtcataataattgagggctatgatgcaaagttgtaacaaactgtctctacattgaagataatgccttttacatctataatgaaagctagttttgcacacaaactgtatttcatttaatagtcttagttgagtctaaacagaactgttcaagtaggaagtgattcttagttcaaatgtaaaggtatatgcccaattgaaaggaaacttccnatttaagtactaaacctaaggaaaggtccatgtaaagggagtagggttttc

SEQ ID NO: 610029 - DNA, 151 bp, Homo sapiens
tgtcaatatgaatcttgttgactatagtcttggctggtcataggaaggtgctcttccacttggttccgtgatgattccatgtgttgctgttgtccctggttattatatggttgctggctatatgagctctgcttgtgattctcataaccac

SEQ ID NO: 610030 - DNA, 696 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtctcagcattgctgtattttggcgggtgctgtttgctaatctttgtcagattcacgttcactgtttatcacactatttttctttaaatcttgttcaaacagtctttcctata

SEQ ID NO: 610031 - DNA, 108 bp, Homo sapiens
gctgaaggacatcgcaagaatacactgatgtgtccccgacatcattgaacgagcaggctattccttggagaaggtatttgggattcaattgatggaagcgtcgcgcat

SEQ ID NO: 610032 - DNA, 577 bp, Homo sapiens
gcgtcgaaaaagggtttggtggtttgagccccgattttctcggggtttctttccgggggttggtgcccccgcgagtctataacctttgttacatgggtgaccccaagctcgtggttctcgtctccttccgaaggggtaatgttccctcccccacgattttggtgtctcaccttggcctgttagacggtgccccttcccggtctccccccctctgtgtgaagacgtggcccaagacactgagaatggtgccagcatcccctcctcgtttattacttccctcgcctattacatcccccgtgagatcttttttcagaatcctacccctcgtggcgcgctccctaaatgtttttatagaataaagctttttcgatgtcccactcatgctttctataagaataacacccccagatggttctctcttcaaatattttttaaaacaacatctttgatctctccacactcgggggcaaaataacacttcattcatatttattactcctcctcttagatagaataattttaagtgcccccctgcaaaaagaccccttaaatatattttgcttcccacaataatcaa

SEQ ID NO: 610033 - DNA, 690 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggccgggcagttcctggctccattggctactcaaggctctagaagctatgccccactgcaaaccaaagccgctgcgccttcaccatgagtcactagcgtcgccctgcccgtactctgcccacacttagctacatgctacacccctctcccctgcaccacctgctcgcttgctcgccatttctcctcg

SEQ ID NO: 610034 - DNA, 173 bp, Homo sapiens
tcagctcggaccaaaagaatgaatgtcactattgactttcgcaaattatgtgaaaatgggtggggaggacgggggaataccccgccgcgacagaggcgcacatgatacacaaaaataaattgacgaaaactcttgacagttcccttgtgtgtgctaatctatgtccaacctaa

SEQ ID NO: 610035 - DNA, 326 bp, Homo sapiens
tgagccataggttaaggtctaaattaaatctggggaacaggggccaggtgcgggtggctcatgcctgtaatcccagcactttgggaggctgaggcaggcggatcacctgatgtcaggagttcgagaccagcctgggcaacataatgaaaccctgtctctattaaaaatacaaaaattagccaggtgtggtggcatgcacctgtggttccagctacttcggaggctgaggcaggagaattgcttgaacccgggaggtggaggttgtggtgaaccaagattgtaccactgcactccagtatgggtgacagtgagactcagtctcaaaa

SEQ ID NO: 610036 - DNA, 643 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtc

SEQ ID NO: 610037 - DNA, 992 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatca

SEQ ID NO: 610038 - DNA, 248 bp, Homo sapiens
cggctccttcttaacgatatacggaggtcagctcggtgctcacgtgtcgacggaacttgtacagagaggcatgcaccgcagtgttgaatacacgtcgaccaggctccatatatccgatattaggtcgtaatcacggttctcacgtatccacggaacatgtctatggaggcatgcatcgcagtggtgaatacacgtcgagctgcgagcatgcatagctgctcgggtactgaaagatactctagagtcga

SEQ ID NO: 610039 - DNA, 1340 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatcatggagcctgctggtttctagatagcgacagagagaagcagcagttccttctctgaggaaaagatacaacaggatggtttgaaatccatttctggtccttaagagagatgtgccatgcttggaagactggattttttgttttgttttttgtttgttttgtttgagacggagtttcactcttattgcccaggctggagtgcaatggcgcgattttggctcactgcaacctccccttctcgggttcaagtgattcttctgcctcagcctccagagtagctaggattacaggcatgcaccaccacacccggctaattttgtatttttagtaaagatgggatttttccatgtt

SEQ ID NO: 610040 - DNA, 1425 bp, Homo sapiens
  misc_feature (1390)..(1390): n is a, c, g, or t
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatcatggagcctgctggtttctagatagcgacagagagaagcagcagttccttctctgaggaaaagatacaacaggatggtttgaaatccatttctggtccttaagagagatgtgccatgcttggaagactggattttttgttttgttttttgtttgttttgtttgagacggagtttcactcttattgcccaggctggagtgcaatggcgcgattttggctcactgcaacctccccttctcgggttcaagtgattcttctgcctcagcctccagagtagctaggattacaggcatgcaccaccacacccggctaattttgtatttttagtaaagatgggatttttccatgttggtcaggctgctctcgaactcccaaactcaggttttcctcccgcctcganctcccaaagtgctgggattacacacgtgagcacta

SEQ ID NO: 610041 - DNA, 938 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgcttataaataaattataagtagccatca

SEQ ID NO: 610042 - DNA, 1000 bp, Homo sapiens
ggtccactgcccatactccgcggccggggcgccggaggacgccaagccgtcatggtctaccacacgcttcctggtgagaggcccatcaggtggcacgcctgtgaacaacggaccgggacccagattgccatctgccccaacaagccatgaggtgtgcatatactatgaaaagaagcggtgccaaatggaccaaggtgctcgagtcgtcaaggagcacagacgggcaggtgacgagtgcatcgactgggcccccgagagtaaccgtattgtgtacctgcggctacagaccggaacgcctacatgtggacgctgaagggcctgaacatgtgaagaccgcacgctggtcatcctgacggatcaaccggggctgcccgcatgctgtgcgctgtgagtcccccaagagagaacaagtttgcttgtgtggcagctggttctcgatgtgatctccatctgttatattcgacgcacggagaagtgcactggtgggctccatgcaaagcacactcagagaaggcccatcctgctcaatccgtcctcagcctggcatctgaaaacctccaagcaatgtcgctggctcggctgcccggctccttgtgcccttccactgtgtccgggatcttgctcagcccttacattcaagtgaacgtgcgaggaacaggcctggttgaacaccgaccgctcgtggggtctcctaacgcattgcctcatcaagagggcaccttgaatgtttcgacatccaggcaagtaacgctgcgggtggggctacattggcagtagtgtaatctcactccagcggaaatgcccggtgttgggcctggggttaatgcgccgggacacgcgccgttttgtccttggtttgatgccctacgaacccaggatgcgccggcggccgcgctctcggggctcttgcacccggttgcccttggctggcgctgcccctcctgccaaacaccttggctggtggccacgggccccacctggcttcccgggccgttcccct

SEQ ID NO: 610043 - DNA, 1145 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaaggtgaccccgcggccctctcctgcccctcctccattcctcccgagcgaccatttccccccaacctgggcctctgtggtgaccacctgctgcggccagcttctccgctactcactagctgtggtggcgccaatttagaggtttacaaacaaacaggttgaagaattagccctccaatcaatgatcagttctagaagaggggatgagatgctgtcttctcacactgtacctgaacagtcacatgatatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatca

SEQ ID NO: 610044 - DNA, 902 bp, Homo sapiens
agaggatcccctatttattgtttggaccgagtgccgggccgacagcagcccggaggttggctatgtgaccaggcaacatgctgagccggcttcaggaactgcgcaaggaggaggagacgctgctgcggttgaaggcagccctgcacgaccagctgaaccgcctcaagatgttggtgcatgtagacaatgaagcatcaatcaaccaaacaaccctggagctgagcacaaagagtcatgtgacggaagaggaggaggaggaagaggaagaagaatcagattcctaaaggagggggaaagccaggctggtcagttatacaaattgcatttctaaggctcaggctacttctcctcaaggaaatcatcttgccctgggccctgtgatctgcttgaaaggaaagcaagaactataaggaggatgtgtagttgcaaaaatggctccatcggtaactcaagcttcagaatgttatgacatacagaaaatcaaagatgctgtgtcttagcattgagtaatatgggtggtgctgtctgtaatctggtcagattcagttaactgttcagaacaaaatttcctctgaaatactgttgagaaagtctgtcatttgcaaaaagagcagagtttaaatacaagccagtctttccagtcaacaatgcctctttgaagaaaaccaattaaagactgtttgcatgccgctgaacccttgtgagcagttaggacacagtctaggacagaaagatgacaaggggaaggactgagggccatctgagagcacaagctgtttctacctctcagaggcattgaaatattgcatgctataaactgctttgtgtatctgttaccacctctcacttgagacatcactcactggtaaaatgttttataaataaattataagtagccatca

SEQ ID NO: 610045 - DNA, 206 bp, Homo sapiens
cacgaggactacccccaacatcccatgtgcaaacagaataaacccatattcctcttgtctttcttgaacgtctctattcctacatctccaccactactggaccactcatctaatatcgtggtggaattcattcctccactattacaaattttggtaaagaagctgcgttaattgcaaaaggctccttctgctaatcctgggtcttg

SEQ ID NO: 610046 - DNA, 108 bp, Homo sapiens
ctagatataactgggcatctctagatgggcaggacagcaatcagaacattcactctaatggagcacagacagatggctgccaagccagacagagcccagctagaaagg

SEQ ID NO: 610047 - DNA, 238 bp, Homo sapiens
  misc_feature (185)..(185): n is a, c, g, or t
ataaggagttacactagtccgctttacttggactagtgtaactccttcatgcaataaactgacaagagccatgcaagaaaaaaaaaaaaaaaattttggccggatagggtacggtattggaccatcgggattttggagaattattccagctacgggttgaccaaggcaaaaatttttgccatttnctcgttaaagattgggccgggctaaggacatacccagccattgcaagttccgg

SEQ ID NO: 610048 - DNA, 1450 bp, Homo sapiens
  misc_feature (907)..(907): n is a, c, g, or t
  misc_feature (913)..(914): n is a, c, g, or t
  misc_feature (1118)..(1118): n is a, c, g, or t
tcgcggtattttcctcccggggtgttattttcgtgttggaacacacccacggtgctcgtccgctgtgtgggaaatgaagtgccaccccaccgctgaagctcttgttggaggaggagaaggcgttgtctttctcctcgggggcggaccacaaatctgttgtgggggtgctctttcaccaaaatcgatgaccaacagggaaaatatggtggttgtctcttcacacaagaggaatggttttctcgctgtgacgccggggggaccaacaacgttgttgctcttgtgggtgggtggcaccgcgccaccaagagatgtggtgtcgccccccccccccacttggggggagagccacacctgggggttgttttcaaccgtcgtcttcacggggtggaatttaattccctcgtgggccccctctccctcgcgtctctcacatttttatgtcttccccgcggtgtttattgggcccccctcgttgatattggggaagtttggccccaccacccgcggttttcacacacctgttggagcacaaggccacagatgtgtgtgcctcgaaggctctcgtaagaggggagaactagaagtttttgtagtctcgccccccctttgtctcgggggtggtatagaaaaaaactctgggagaaaaatatgggcgccctcacaaatattcttctcggaaaattactctctggtgtgaagatgcctcgccccactcttgtgtgggaagaaataggggtgtctccctcggggcacaaggcgcacactaagtgtgtgtgttttgagagagagactttttctctcccagagactctataccccccacctctttggggggtctcccctctttggctctgtgtgtcgctgcggataatatagagagagaccacagacacacacttttcccgcnctgggnngggtgtgtgtcgatcaccaaaacaccccgctgggggcacacacagagagagagcgctccgctgggggagacctgggccaacagagtgctcacccacagatctttgcccccacgaggagagctctctcagcagagagcgctattaatagggaatatatatgtatctcctctttatatatcctcgcgccccccccacctcttttanatcaccaatgtggtgggtagagaaaccggtgttccagagaactctgtgttgtgttccacatatgcgccccacatttaagattgttagttgagatgtaaaagaactctggtgttaataggaaacaccacaagccatccgtggaaacctctccagaaggaaaggagaatagttttgtggaccccacttggttttctttttttgcgtgtgcgccacgattttaagattattagatttttaaaacaccaggaccttttttaatgggacaccaacacttggccccaaaatttgttccccaggattttgggaccccctttaaaaagatttaatggaga

SEQ ID NO: 610049 - DNA, 373 bp, Homo sapiens
  misc_feature (23)..(23): n is a, c, g, or t
  misc_feature (53)..(53): n is a, c, g, or t
  misc_feature (58)..(58): n is a, c, g, or t
tgcagtggtatgatcaataaaancactgtaagcctcgatctcctgaagctcanacganccttccgccttggcctcccaaaagtgctaaagaattacaggcaatgaaccttcaatgcctaagctgggactgttttcaaaactccaccaaaccccttttcttttgttccaattccaactctgcccaagaaaccttccgtctggcttcccaagagggcccaaagtcctttgtcttcaagaggtcctggctggggaagccttaagaagcatggtcttccctcactccaggcttctcgggtctccctattggggactgaccgtgggaagcagtgagccactgtgcaccagggcagcccggctcctcggggggtggccc

SEQ ID NO: 610050 - DNA, 376 bp, Homo sapiens
  misc_feature (45)..(45): n is a, c, g, or t
  misc_feature (80)..(80): n is a, c, g, or t
  misc_feature (87)..(87): n is a, c, g, or t
  misc_feature (104)..(104): n is a, c, g, or t
  misc_feature (147)..(147): n is a, c, g, or t
  misc_feature (246)..(246): n is a, c, g, or t
  misc_feature (273)..(273): n is a, c, g, or t
  misc_feature (351)..(351): n is a, c, g, or t
  misc_feature (376)..(376): n is a, c, g, or t
ggctggctgtgggaggctcccgaggtggggacccggccgggatgntgcagcggcggcggggcgtgggagcgggccctcgnggccagngagaagcagttcctgcnggcgctgctgagtttcttcatctacaacccgcgcttctggccngcgggataggagagacctcccagtgccaagtgtataagcgtgtccagaattggtgggtctcactgacttcaagaatgaagccgctggaccctcctggcnggaattctccacgatgttttgaagcangcctcggttttcccaccacctccaaatcatgcaagacacagggcagagcccgggagccatggccagcccttccggcanctccaaagccactggcaagccccgn

SEQ ID NO: 610051 - DNA, 350 bp, Homo sapiens
acactacaaaacgtcttagactgtgcctctatctgacgtcagtgtggcgttgtcccgagccatctgtagacagtaaccccgcacagttctcacaacagtacatggtgagagttgtatagcagaacgacaacttagagaagcaggtcatcacatgcaaagtgtatggaccacattctggtaattaacttcctgtcgaataacagcattcttctgacacatgctgcatttggttgaaatactatttgtatttatggtaacaataggtttttttttttcagttcatatgtagacaaacatgactgactgcaaaaatctatactagtggtggtgttttcaaactgggcactgat

SEQ ID NO: 610052 - DNA, 290 bp, Homo sapiens
ccgggaaagtttgggcccctgccatcccccaacctgggggtatttttggtggattgggataaaccggggcttgggccttcccccaaagcctttgggccagttttttccgccagccattttttccggttataagggttccaaaatcctggaagggttttaacctgctggatggaaagattggccccccaggccccggggcttttggaattgccttttggtttaggttaaatgctagccccgcctgggcgggggcttttttggttttttttaaataaaaaggtggcccgcca

SEQ ID NO: 610053 - DNA, 1179 bp, Homo sapiens
gaccccggacagcccatgcttgcgtcgggtcactgaacgggaaccacggccgctgcgcctgccgctgatggagtgcgtgcagagtgactcaggagtgtgcagaaggcgatggacgagaggagatgtcaacgatgcggttcgagtctcgagggaggagcttatgcgggccaatgctgaatgacgctatcaacgcgatcttggcgcatcaagctgccggatgatcagatcccatagatcaattgcaagcggtacctgtcatcaacgtagggggcacccagtcgtcctgcggatgacactgcaggtccgtagcagctcacgtctgtgcgcgtggcgctagttgccgacggccgacaggatgctcgccatctatgatggtcttggtacggcttcgaccaagggccagtatcagaatgcaaagtcggcctggacagagtgtcgggggctggaccggccaaggaggctccattctgtgggacaataacgcagttctcccgggcgaagtacttggaagagatcgtcgacacagatgcgcacgcacaggatcacacgcgctgctgatcatcggtggattcgaggcctacctgggactcctggagctgtcagccgcccgggagaagcacgaggagttcttgtgtccccatggtcatggttccgcgctactgtgtgcaactaatgtgccgggttccgattgcagcatcggggcagaccacgccctgaacagtatactcgaaactgcgacgcatcaagcagtccgcagcggaacaagcggcgcgtgtccatcatccgagacatgggcggtactgtggctacctggccaaccactgggggcgctcgggccggaagatggtgcgcatacctttcgacgagccttcgacctcagggatcctggcgccacacgtggcagaccctgtccgtgggtacacggcaggaggccccataccaaaaggactgtgtcctcgaaggaacctgccgggacataatcgccagcgcgtatataacagtgttctaacacaggcaccagcgtatgcgcatcccgaacagttgtccatagcgaggggggacctcccgtgacacgggcacatctccacaggggcagcaagaggcgcgggagaaactcattgggtcacgcacgggaggcagtctccagatccgccgctgctcacaggagtcacagccccc

SEQ ID NO: 610054 - DNA, 764 bp, Homo sapiens
ccatcacggaagcttgttgtaacggcttttgaaggccagtaaccattgttgtggttgtgttttgtatgcttgataccatgaaagtgtagaagtactgtaagtgccgtaatctatttatcaagaactgactactggaccgcgagcccacgaaaccatgggtcatagttacactgtgaatgtcgtcttctgtcgaagcaagggaatgctggggcaggtaatcacgcagtagccgccacgtggaacggtctgtccgtcggtctgtcccgcttgccgggcttctgttgcaagtcttgtgcttaaggagacttcctgctgggcttgccgatgtcggcacgctccagttagagtcttgagttctgtacacggtgagggtggttgccaaaggtgataagaaatagcagccaacaggctccctctcacttaagagagttctaattactaacactaaagttcttcctgagaaatgactcctcttggtgcggtccgacagcttttctcacgtgaaggacataggcctgagataggaagcagtgccctcgcttcatgaggtggcacatcttcggtggccgtatggcctggtcgagcttggtcagctgcgtgggtgcctgtctcctgtctccagcggcgagggcgatggttcttgtgcagcctggtgtccacacggtgcattcctgtcgccctcggccgcaggctggctcagctctccagtgctgcggcgcttgtctttgcagcattggcatgtcaccgtaggccccttcactctg

SEQ ID NO: 610055 - DNA, 400 bp, Homo sapiens
atttgtaatgttggtcccatataatcagttttgaatggagttttgcagtgggaaggcagaatcaaagcgcctgtcattgaacagttatagtcatgtgtctcgcctgtagatagacagtggctgtcgacaacatgacttgaaactgtggcaagtcaacgagtgtttgtgtagcattgtccccggggcatataggtttattatgttcagcataagcaagaagatggaataaagaacttctttctgatgtttatgatttatatataaaattttcaatgaatccattttatgaaccaattctccattgatcaaggctttgcagaaaagttcagtttcttggaagaaacaccttttagtgaatggaaaaatccacatcattattccccaatggtgaaaaaaaaaa

SEQ ID NO: 610056 - DNA, 241 bp, Homo sapiens
tgttatacactgaatttggcagtgcttgatcatggacttcccagcctctagaaatatgagaaattaattctatgtttataagccactcagtctgttgtatacctcagtttctcattcaggaggcaaagtgtatattagcagaagttgtttcctgaccctcctaaggaaggtaagggtatgagttaaaaccaattaaaaccaggtaatagtctcaggatagagctcgtcggctaatttttcc

SEQ ID NO: 610057 - DNA, 884 bp, Homo sapiens
ggagggttttgctctttgtgtgggtgtgtagagtggctatgatcctagttgtccagctgctgcgtggacaataagtaaagcaggtctgaatgacaccaggtcgctgctgtcttgcggctgacattcaggtagatgacgttcatcttcactgacggtggaagatgagcgcccttggccacggcacacgggcaacgtggtgcatcacaaactgtcctacggcctgcccacagaccgccaggacttgctgtccttgcaaagatggccgtggaagtatgaccgttcatcgagtccggccaaggaaagtggttctgccacgtggacgatgactaactacgtcaatctgcgtggccctgttgcggctgctggacagctagccgcacacgcgggacgtctacgtcggcaagcccagcctggacaaggcgccatccccaggccatggagctgggtcatgctggagaacaacgtgcgtcctgtccacttctgcgatttgtcacgggcgggcgcctggcttctgcaatcaggcgtgggctggctctgaagatgagcccgtggtgccagcgggggtcacttcatgaatacggttgacgcggatccggactgcctgatgactgcgaagcatcgggctatcatcgtggaggcctgctgtggtgtgccccgcatacgcaggcgggctctttccactcccactgggagaacctgcagcaaggtgccacctcggaagctccacgagcaggtgacgcgagctacggatgcctgaaaacagcggaagcgaccagagaaggggcctttcggggaggcgaacaacaggggcgtccagccatgcaactgaccgaaagcggggtcgcgcaggcagtaagggccggggaaccaccggggccggtcca

SEQ ID NO: 610058 - DNA, 673 bp, Homo sapiens
  misc_feature (147)..(147): n is a, c, g, or t
  misc_feature (205)..(205): n is a, c, g, or t
  misc_feature (304)..(305): n is a, c, g, or t
  misc_feature (472)..(472): n is a, c, g, or t
  misc_feature (659)..(659): n is a, c, g, or t
tgtcttcgcgatctgggtcggcgattaccagaagagtcttcatgtgcatcagtctagtgacaccatgtacagaattatatactgcactcataatagagcaggagccagcagcctgtttataaagtagaacaggcacttcctcctatncaaggttcttcaacgtttttttggggggggacacaaaagaggagacgaccccccgcgnccctagcccaaacctcaattttgggggcccactttaaccactatcataaaaacgcccccaatattttttaaatggccttttttttatgaatgaatctanncgccccctccccaccccacccacctaccactgccaactacacttcctcccctacccaaaaaactggaggggaggtggcgccgcgccctctttcttgttcacctccaccccatcaccactaaacataaattttcatatccccccctcccaccccctctcctgtccctntatctttgtcccctcccccctacctcccattctcacttctcgccttccccccacccctccctcccccacttctctcctctcttccctctccctcccaacactttttattatccacacccaacactctcttatattttcatccctctctctcttcttatcatctcacctcttacctacttctctcctnatacacacagagac

SEQ ID NO: 610059 - DNA, 195 bp, Homo sapiens
ctgcaagtcgactctataatatcctctactgtctcacgtggaatgctggacattgtacgtgcggtatgagactatatcatacttagtatgctagggtgagtggtacgaacttttttacatagcgaggtgtatgaattggtcgtaacggaatcagccgtatgctgttcgaattcataagaacaggcaggttagaag

SEQ ID NO: 610060 - DNA, 215 bp, Homo sapiens
ccccccccggggggggggtttttgggtccccctcctcccaaggggtgtgggccccccccaggggggaacgaaagggggtttcccccccccgggccggcccccccggcccggccccctttcccttcccccggggttaatcctgttttttagttttgggagaaccggggcctttttcccaaaaaaaacccaaacccccccaaaattttcggggggga

SEQ ID NO: 610061 - DNA, 407 bp, Homo sapiens
aagacagtgtctcactctgtcactcagactggagtgcagtggtgcgatctcggctcactgcaacctctgccctccgagttcaagtaattctcctgcctcagcctcctgagtagctgggattacaggcacccgccaccacgcccgactaattttgtgtacttccggtagagatggggtttcgccatgttggccagcctggtctcaaactcctgacctcaggtgatctgcccgcctctgcctcccaaagtgctggggttacaggtgcgagccacagcacccagccaggtccacaattctttagcctaactccaaaatccaagagactctaaagtttttttttcccccataagccatttggcagcaaactgacctttttgaactaaattagtggcaaacctggtcgacgc

SEQ ID NO: 610062 - DNA, 100 bp, Homo sapiens
cccggtgtggcaggtactgtaggtcttcagcaacagcatcacaggtggccttgggcagttgcccaggtggcagtgcagccccgggctgaggtgtagcaga

SEQ ID NO: 610063 - DNA, 1116 bp, Homo sapiens
gagatggaggagggaggccgggacaaagggcgccggtgcagacccagcagtctccagcgggcgtgcccccggctggcacggactgagaagccgagcggcaaggagcggcgggatgccggggacaaggacaaagaacaggagctgtctgaagaggataaacatgcttcaagagtgaactggagatgctcgtggaacgactacggggagacaggatacatccctgtatcgacactagcgctggaggaatcgcggaaggcgtgattcgttcttcatacgaacgttccatgacttcaggtgcccaagccgtctcaagattcctgcgtccagcactatggcaaagctgagaggaagatctatggagaacatggccctctgggggagaatcaagcgtttagcttgctgacatcagtctccgttcccggccatgaccatgagtggggagcgtgagtgcctcaagtatcggctagtgggctcccaggaggaatcgggatcatggggtcatgcagtatgtcatggcatctggcaggagacagtgggctactggagctggcaagcgaactgagatgacgcagagacatgtccagcgtgcgacaccttcatagcttcagccctgcgctgacaggaacactcgtacccctactacacctggcccgcacaatgcctgaagcactgagggctctgcgacacttgccctagctggatcaatagtaccacgtggacgctagacggacaaccgacatcgatcaacagtgcatatgctaagggtcagccaagaatctacaacaaacgatgtcaataacctgccatgaagagcagcaaaaacacacaacccgtaacagagatcgatgccccggggatattcataccggagacggaacaacgccgaaaccccctgcacagacatctgtcacttgtggacactaggatgcacgcacgtgaccagggagaatttggaaaaagaaatatcagagccgccaggcaggagcagcgcgcaagacacgaaagccagattgaatacagacacgcacaggaaacagactatacacgagaccgagaggagaacatagaggaaaaagcgacggacaacaacccctcacaaacgacgagaacaacaga

SEQ ID NO: 610064 - DNA, 117 bp, Homo sapiens
tgctgcgtcggctgcggtgcatggaggcaaggggctgcagagccaggtgcactgtgtgatgatgggagggggctccgtcctgcaggctggaggtggcgtcggcactggacagcagga

SEQ ID NO: 610065 - DNA, 428 bp, Homo sapiens
  misc_feature (207)..(207): n is a, c, g, or t
agagtacaggtatatgtgaagatggtggtagagaaaagcaacacaaaatgttaagggtggcaacaaggagtaattatctgcttccatggggtggagaaattagaacaacttgagtctgacgttcattagggtaagaaaaagtttaaaccagggagatttggaggcaaaggaaaaaaccaatttccatcaacagtggctggttatagncacttgtaactactcaaaaagtcctttctggattcattactccacatttgggcttagcccagaggtgattttttaaggaaaaaatgccttttggcatttttgagcagtgacagcgtataaacagacctttaaaaaacacacacccaaaaagcattactattttcaaatgtccagttgaaaagcaaaaaaaatggtgacacctcagaagtaacaaccttggg

SEQ ID NO: 610066 - DNA, 415 bp, Homo sapiens
  misc_feature (69)..(69): n is a, c, g, or t
ccccggccgcgcgacagacgacagaaggttgggaggctgaggccaggagaaccacgtgaacctgggagnaaccccggaggtggaggttgcagtgagcccgagatcgtgccactgcacttagccccaggtgacagtgtgaaactctgtctcaaacaaaataatacctctctagtgaggtgctcacgcctgtaatcccagcacgggaggccaaggcgggctgatcacttgaggacagaagtttgagaccagcctggccaacacggttaaacgccactactggtggcgggcactagtagtcccagctattcaggaggctgaggcaggagaattgcttgaacccaggaggtggaggttgcagtgagccaagatcatgccactgcactccagtctgggtgacagagcgagacttcctctg

SEQ ID NO: 610067 - DNA, 266 bp, Homo sapiens
agaatcgcttgaactgggatgcagaggttgcaaagagctgagattgtgccactgcactccagcctgggtgacggaatgagactctgccaaaaaaaaaaaaaaaaaaaaaaaaaaagaaaggtccgggcactgtggctcttgcctataatcccttcagttggggaggccagggaaggtggatcaggaggtcaaaatgtgcaaacacctcctttgccaaaatattggtaaaaccccggctctcatattcagttaccgggtcaccgagc

SEQ ID NO: 610068 - DNA, 200 bp, Homo sapiens
cactcggaacccctgtcattttatttattttcttctagtccaattatagttaatatacagggttatattggtttcaagtgtacaatatagggattctatgttccatacattgcacaatgtcatcaggacaggcacactccttaaaccccattccctaattccctatttcccacccacccacccaccttccctctggtgat

SEQ ID NO: 610069 - DNA, 136 bp, Homo sapiens
ccgggtagatctcaaggtgagccatgagacacagagaagtaggagaggtggaagaaaggcaccaccgtggtatgggtcttgttggactccaccaggcggaagccatagggtcgaccagtagccacagcatgaaacg

SEQ ID NO: 610070 - DNA, 145 bp, Homo sapiens
gcgaaatcattgtgagttgactagacgtaatactacgcgacatcatgcacagcgtgagctacatactgtcactagagacacctagatcgatatggatctgctatcttctcctcgctctagtatatcttgcatgacgacatacata

SEQ ID NO: 610071 - DNA, 245 bp, Homo sapiens
  misc_feature (159)..(159): n is a, c, g, or t
  misc_feature (211)..(211): n is a, c, g, or t
gaggatgcctcctacgagcgcagcttgcactagcctaggagtttctcgtccatccttacgtgaagcaattcaacagctcaatagtcaaggtgtactgattagtcgccgtggtgatggaacttatattcagcaattacctgaacaatggccacagcaatngattgtgaatccaatcagtaacctgattgaagaagatccgttataccgtttngatgtgcaagaggcgcgttgggcgctcgtaggag

SEQ ID NO: 610072 - DNA, 406 bp, Homo sapiens
agtacgacaggtctctgatcggcatcactgtggccattcatgagaaaagcagacatattagtccaggcacagtcattcatgtttgtaattccagcactttccaggactttgggaatgcaaggtgggaggatcacttgagctcaggagttctagaccagcttgagcaacatagggaggccctgtctcttctgagccttgaatgattagccaagcgtggtgacccatgcctgtagtcgcatctattatacaggctgaggtgggaggatctcgtgagcccagaaggcagaggttgcagtgagccatgagtacaccgctgcactgcagcttgggtgccacagggagcctctgtctcataaataacatcgtcaaatgaacgtaaaagcctggtcccgaatcctgcagcccg

SEQ ID NO: 610073 - DNA, 171 bp, Homo sapiens
cagcaccacattctcacggatggctctccacaccagagtcagacacaggctctcgtgctagaggaagaaagtgagtggctggaccggcaggacaagcccacatccagcagagactggtgtgatcccacagcttcgcctgttcccggggatgcgtgtcgccatccaccacct

SEQ ID NO: 610074 - DNA, 1692 bp, Homo sapiens
  misc_feature (209)..(209): n is a, c, g, or t
  misc_feature (1432)..(1432): n is a, c, g, or t
tactcgagttttttcctcttattttttagagaagtaaagtcgtttatcatcaaagccatgttgctataccacacggatttgggggttggggagtaggagcttggacgggggtagagggggttgagctggtaggtgtccccagctataggtccagggtgccacggcaggtcaaactcattccttcaaaacaagggtgtaatctatccccnaagacaaagcctggagggcacttgtggaagggagtgtgaccagagcgagtggaaagagggtgtagggtcatatggccgggtgtccacagacatctcgcacaggaaaacttatgcgcgaaatgataccgtagggcgaatcgcagcatcccggtgtaccttacaaagaggcctcgtacaaagatggtccccccaactagaaacccagtgtaagggaatataagggccaacatggaagcctatgcggggattacatctatgacagcctcgtgaaatcgcacctatattataccacgtgagcttttgtttggcaagatcgagtcatcccacaatctatggtgacaagggtccagaaaatgaaaagacctagcgatggtggggccactaaatagaggacctctttactataccgcagcctaacagtggctttacgtggagtacttactaataacccgaaagcccctcttggttgacccccaggagatataactcgcccgttttgtatagagcaaaatggctgttctggtgggaagtggaaagagataggaagtggtggatcgaccccgttgtgtgtaggttccacacggattagactatcgccctagttgcacgctggatgtggtggccaacattgccgagtgggtgtatcatgcaccaccagagaaggtgaaaagaaagaactattctacctcagttacagacacaaggtgaccctatccgatcgagatacgctctcccgaagtagtatatctataggtcgtacaatatgacccgtgagaaaatgtgggagctacccccatgaggtggtgagcaaaaaaaaccattgtacgttgtttaagaagaacatataatacggagcagagggtccaatgaatctctccaatagagtggaatgtggacagaacgacagcaggaacacctattgagataccatctgaaggcggaaatatctataagtgttcactgggtgtgttggctggatgacaaacactgaagtggtataatacgtagacactagtgtggcacaatatttgggtactcaataggcgtagttatatctaatccttagtctaaccccaagatagtttagtcgttgagagtctaccaacaagcggtgaggtagaaagacgattatatgaggcagcggagtaatcatcccaccattaataaaatggagagcgagagcgaccgaggaatggtccacgctagctacggtagatataacnggccccgagtggggctaaacaccacgcggccacattacattgacacgaccatgacggtgacaaaaacgaatagatccgataagacagatgaagtcacgagtgcaagagacagacacggcacgatacacacgctgaatagccgaagagtcagacagaccgatagcagcgaagaccagctaccacatcgacagcactgaacgagacacatcgaaggatcaatcgatactaaagcaacaccaagccaaagcagatgacccata

SEQ ID NO: 610075 - DNA, 692 bp, Homo sapiens
gcatagttttccatggtgtatatgtgccacattttcttaatccagtctatcattgttggacatttggattggttccaagtctttgctattgtgaataatgccgcaataaacatacgtgtgcatgtgtctttatagcagcataatttatagtcatttgggtatatacccagtaatgggatggctgggtcaaatggtatctctagttctagatccctgaggaatcgccacactgacttccacaatggttgaactagtttacagtcccaccaacagtgtaaaagtgttcctatttctccacatcctctccagcacctgttgtttcctgactttgtaatgattgccattctaactggtgtgagatggtatctcatagtggttttgatttgcatttaaacacatttaagtacgtagcccacagacatcataaagccactatacaatcatctacaaaacaatcagctaacatgacaggaacaaaatatcatatatcaacactaacttaaatgtcaatggtctaaatgtcccatttaaaaggcatacagtggcaagttggattaaaacacaagattctacattctgcttgcttcaaaaagaccatcttacatgtcatgacacccataggcttcaagtaaaggtttgagaaaagacccgcatgcaaaccggaaacaagcaccaagaattgtgaaggggct

SEQ ID NO: 610076 - DNA, 289 bp, Homo sapiens
gtgtgtacgacgtaagggcatactgggacatgcactccatgtatattatagtaatattaccaaaaatgggaataatatacagtaataaaagcctgctgcacatataagtgtagtctacatacaggaaaaattacagaagaaactgtatatgagcacattttgtaaatttatcttacccaagaaaatgtacagctacttttctatgtcacatgtccaagacaaaaaaactgaattcatgccatatattgaatattatatgcgcaagtaagagagatgctatactcgtaca

SEQ ID NO: 610077 - DNA, 443 bp, Homo sapiens
  misc_feature (108)..(108): n is a, c, g, or t
gaaaccctccgatgtaaactgatccaagctattgatcacaatgaaggcttcagtttaatatgaccttggacttttctgtttagtacaaaaaccactcgtgtttctctngtgaattcagcacagtgagagttacttctgtaattcttacttataaattgttcactactgtactgatgaaagcccaaaattaaaaactgtgcattaatactaaactgtacagaaccatgaattgtccatcctcatacaagtattgtgaatacattaaagttttactcacaggaattttaagagtttgcatatttcggaaattacctgatgtgtgggtgcatggaaatgttgcttactgtttcttcaatcactggggggaaagactacgatggcctgcccacagtcatttgattatttttccattttgtaaataaaaattttgtaataaaatagtg

SEQ ID NO: 610078 - DNA, 1094 bp, Homo sapiens
  misc_feature (443)..(443): n is a, c, g, or t
  misc_feature (446)..(446): n is a, c, g, or t
  misc_feature (467)..(467): n is a, c, g, or t
  misc_feature (495)..(495): n is a, c, g, or t
  misc_feature (503)..(503): n is a, c, g, or t
  misc_feature (505)..(505): n is a, c, g, or t
  misc_feature (569)..(569): n is a, c, g, or t
  misc_feature (580)..(580): n is a, c, g, or t
  misc_feature (604)..(604): n is a, c, g, or t
  misc_feature (606)..(606): n is a, c, g, or t
  misc_feature (739)..(739): n is a, c, g, or t
  misc_feature (747)..(747): n is a, c, g, or t
tcgaagatggcggaggtgcaggtcctggtgcttgatggtcgcaggtcatctcctggtgcacgcctggacggaccatcagtgggctaaaacagtgtacatgctggagccgcgaatgtgtggatgagtacgtacagctgatgaactggcgatcagagcaattattctggcggaatctatctagcatgacaagcacacgtttgatacgttaccttgtgatcttgtcacgtccgctgtaatgacggtatgataccagccatagcgcgcgttactccgatggaccaccgtactcacgtttcctggtgctccacgccagcaccgcgaatcgttactgtgagcgcgatccagatgacagacgtgctattgcttgcctcgctacgaagaaatcgcatagtgctgatgtgcctagggacgccgacatcgtgagaacgcagtacctcgagagngtntgctttatcgagctggggtanttcgccactagctcgaactctgtaacgnaagccaangnacacaacactagtgcggggcacttgaggtgtgctatgcctctggtattgacacgattgctggangtgactccagnttggcgtgtgcataggagacggcncnttaaccagacggacgatgtttttggcacctatatcttgggaggcggaccgtcggtattcgacgggaagggatttggtccttgacaaaggttacgcacgtgcactgtggatctccgcgcacgtccttgcggagngaggacancgaatggaaacaccgaaggaagaggcgcgaatgaggtccaaggtaacgcagagaacagaaagaacggcgtaggtcattgaagcgtctacgtgaacactattgggccacgagcaatgaaacggtgtggagaagcaaagatctggaccaataccacatggagtgtcgctcaagtaacccgatggggactccttggttcgttgaagcccaaataagagaactgtcagattccgtcatggcgattgggctggccttactcgcatttgttgcccctggaaagtggtacggggacccagggggcagcaaggccagtacagggtgccacaaggcaggccttggggacagtagga

SEQ ID NO: 610079 - DNA, 356 bp, Homo sapiens
cagtcagacatctcttcaaagaatcgagaattgcgtacaaaaacacaccttacatcaattgagaatgcatacatttacaggcgtaaatgcaaaccggttcacaactcaaagccagtcacagaccacggtgttctggccaaagcaatcagctcagacaggaaactgggtcctacggcttggaatttccaaccctgacagacccgcaagacaaaacaactggttcttgccagactctagagaaatcccagaacactcagctctgacacgttaataccaaggggaacagtatacttaaatacaaggtcaaaatcagcaacaagttctacaatccagtgctgacatcagatacaagcttc

SEQ ID NO: 610080 - DNA, 477 bp, Homo sapiens
cacgaggacgacgccgaaggggaccgctcaaggcgtggtcatcggccgcacggtctcagcacttccggccagccgtctcgtcaccgtagcggtctgacacccggcggcccgccgctatccggtgtcggcgtatctgccgtgcagcacgctgagcgcaacgtctgccgccgcgcatcggctctcgagcattctgagcatgtcgtagccgccgcgggaaagagacctgacccgctccaagttgaggatcagcagccggcacagtagcgccttgctcgatgcgtattcgagcaactcggcggtggccgcgtcgttcagttggccttcaaccgacagcaccgcgacatcgaaagtaagccaccgggtggacatttcgaaggccggagacccgccggcgggctgcgggcacgctgtgccccgcggggactgcatcatcctggattgaacgtcggtcatgtcaggctccatctgctggtgcgg

SEQ ID NO: 610081 - DNA, 81 bp, Homo sapiens
aggagtacaagaccagccttggcaacatggtaaaaccctgtctttacaagaaaaaataaaagtaaataaaatacctattta

SEQ ID NO: 610082 - DNA, 144 bp, Homo sapiens
tatggttgaagttgtgttattctcttctttgggaattagctaaatgatgcaataaacctgtttgtttcttttttatttttttttaaaaatcatcaaaataatttatggcagccattggccgactcgatttaagccagttggacc

SEQ ID NO: 610083 - DNA, 503 bp, Homo sapiens
  misc_feature (1)..(1): n is a, c, g, or t
  misc_feature (12)..(12): n is a, c, g, or t
  misc_feature (18)..(18): n is a, c, g, or t
  misc_feature (27)..(27): n is a, c, g, or t
  misc_feature (55)..(55): n is a, c, g, or t
  misc_feature (257)..(257): n is a, c, g, or t
  misc_feature (322)..(322): n is a, c, g, or t
  misc_feature (345)..(345): n is a, c, g, or t
  misc_feature (401)..(401): n is a, c, g, or t
  misc_feature (409)..(409): n is a, c, g, or t
  misc_feature (431)..(431): n is a, c, g, or t
  misc_feature (444)..(444): n is a, c, g, or t
  misc_feature (454)..(454): n is a, c, g, or t
  misc_feature (465)..(465): n is a, c, g, or t
nccccaaaattnccaatncccaaatgnattaaaatccgcaaaatataattgttgnacaaaataattttaaaaattctttaaaattctttatttatattttttaaaggagatttgagaaacataaaaacacaacagagtcacttcatagtaccattttagtacaataaaacaggaaataataacatactttttttatttttattttttattgagacagggtctcactttgtcacccgggctggagtgcagtggtacantctcagctcactccaacctccgcctcctggggctcaagtgttaatttttgtatttttactacagncagggtttcctatgttggccggnaggtctccaactcctaacctcaagtgatccgcccacttagcctctcaagtcagggnttcaggtntgagcactgtgcccggcttctnagtccattttaanctgagggttnaattgtttagntgtttggaagtcttatcatttttgcattttgcaatttt

SEQ ID NO: 610084 - DNA, 618 bp, Homo sapiens
  misc_feature (601)..(601): n is a, c, g, or t
aaaaggcattcgatagggataatctatttattacctcagaagttttatcttcgcaggatgtttgtgagcctattaccactccagcttagcccccaccccccaattaggagggcactggcccccaacaggcatcaccccgttaaatcccctagaagtcccactcctaaacacatccgtattactcgcatcaggagtatcaatcacctgagctcaccatagtctaatagaaaacaaccgaaaccaaataattcaagcactgcttattacaattttactgggtctctattttaccctcctacaagcctcagaggtacttcgatgtctccctatcacacattttcagacaggcaatttaacggtctcaaacattttattgatagccacagcgcttaccacaggactttcactgtcacttattaggcctcaatttctccctcacatatcgtgctttcatcccgccaacataagtattttcacttatactatccaaaacaatcaccttgtggtcttctgaacgcccgcccgcctagattacgtggccattcttagtaagatgtgggtattgactactcttcttgatatgtcttcccatttattgatncgagaggtaattaaaat

SEQ ID NO: 610085 - DNA, 330 bp, Homo sapiens
  misc_feature (12)..(12): n is a, c, g, or t
  misc_feature (63)..(63): n is a, c, g, or t
  misc_feature (76)..(76): n is a, c, g, or t
  misc_feature (102)..(102): n is a, c, g, or t
  misc_feature (111)..(112): n is a, c, g, or t
  misc_feature (132)..(132): n is a, c, g, or t
  misc_feature (137)..(137): n is a, c, g, or t
  misc_feature (142)..(142): n is a, c, g, or t
  misc_feature (158)..(158): n is a, c, g, or t
  misc_feature (161)..(163): n is a, c, g, or t
  misc_feature (167)..(167): n is a, c, g, or t
  misc_feature (169)..(169): n is a, c, g, or t
  misc_feature (178)..(180): n is a, c, g, or t
  misc_feature (182)..(183): n is a, c, g, or t
  misc_feature (190)..(190): n is a, c, g, or t
  misc_feature (192)..(192): n is a, c, g, or t
  misc_feature (197)..(197): n is a, c, g, or t
  misc_feature (201)..(201): n is a, c, g, or t
  misc_feature (203)..(203): n is a, c, g, or t
  misc_feature (216)..(216): n is a, c, g, or t
  misc_feature (220)..(220): n is a, c, g, or t
  misc_feature (231)..(231): n is a, c, g, or t
  misc_feature (237)..(237): n is a, c, g, or t
  misc_feature (250)..(251): n is a, c, g, or t
  misc_feature (253)..(253): n is a, c, g, or t
  misc_feature (261)..(261): n is a, c, g, or t
  misc_feature (268)..(268): n is a, c, g, or t
  misc_feature (272)..(272): n is a, c, g, or t
  misc_feature (286)..(286): n is a, c, g, or t
  misc_feature (294)..(294): n is a, c, g, or t
  misc_feature (300)..(301): n is a, c, g, or t
  misc_feature (304)..(304): n is a, c, g, or t
  misc_feature (312)..(312): n is a, c, g, or t
  misc_feature (327)..(327): n is a, c, g, or t
tttctttctgtntattttgttaatattttttttttttgccaaaccttgtatccgaagtcaacnatcactgcgattnggccatgatttgacaaaattagactncgaatgagnntccctgataactgtgcagcnaggcnctggngagtgggtatgggggnggnnngggngnggggggggnnngnngtttacncnagtgngggngncaaaagtgaaacnatgngaatgaatgtnagagcnccttcttaaatgnntngggcggcngtcagcngagncgggtgacagtgtncaactacngggagnntangccctccnttttttggtgctatncac

SEQ ID NO: 610086 - DNA, 142 bp, Homo sapiens
cagcgcggggttgcttatgagtgaaaatggggagcaggatgctgacaatgaggtacacgatagaagaggaagaatgtggggtaggaagagtggaggaggacagaagaaggtaatagttaggaagaggatggcgattaagatc

SEQ ID NO: 610087 - DNA, 860 bp, Homo sapiens
  misc_feature (86)..(86): n is a, c, g, or t
gaagttgaagctcggagctcggtgattaacctatgtagacgacgaccccccatggatcccatagataggcactgtctgctcccgtnccttttcgactctctcggccgagcaatgtggactacccgctgtacgacttcagatacagagcttacctcattatactaggttcgtacctatactcaggacagactttcatggctgtatttggcacacgagatagatcgtcgcatggttattcgactgtataactcgacaaattgagtttagatcatggaaagcaagagtgatccattggaggtacgagtattgcagaggaatgaatgcattttcaggtttgatggaaaaatcaataaaggcacagagtatgggatagcagcatgggaaacgagcgatatcgagctataacatcagcatattatcgtggagctgtaggtgccgttattggtttatgacattgctaaacatctcacatatgaaaatgtatgagcgatggttgaaaagaagtgagagatcatgctgatagtaacattgttatcatgcttgtgggcaataagactgatctacgtcatctcagggcagttcctaccaggatgacgcaagagctttgcagaaaagaatggttggtcattcattgaaacttcggccctagatctacaaatgtagaagctgcttttcagacaattttaacagagattgaccgcatttgtttctcagaagcaaaatgtcagacagatgcgaaaatgaccgtgtctccaagcaacaatgtggttcctattcatgttcccagcaacactggaaaacgacggcaaagtggcagtggttgtcaggaacatctaaggcgttctgcttttcccctagaa

SEQ ID NO: 610088 - DNA, 1569 bp, Homo sapiens
  misc_feature (457)..(457): n is a, c, g, or t
  misc_feature (820)..(820): n is a, c, g, or t
gcgtgagcgggggctgcctgcacgctcatctacccttactctctgtgtatatcgggatggtgggaacactatccacattgcccttgcctcatagtagatgtgcgtatactctccccggatagacccgtatgcaagggtcctcccagtgtgtgagtgagaggactcaaggaagaattcgtagaggactgggggatcgctgcctgacctggtcatgttgaaccagccactgcctgtcgcataccgatgcccgaaatcctacgacatgtgggatgacccgatcattgtgcagcaaaatgactagttctcctacccacgtcagtgcacccccctcacctcgtgtgaccacatgtaaccttgagactctagagtcaccttgcgcatcgatttggcgaatagcaaaaagcatcgcatcttcggcaacgcaggggacgaacacgctgcgcattgaattgtcccntctagcgaatcagtgcttttgatcgctagatgctccttgcgcaagcggaaatcgtcaatcgcgcggacccttgagagggttctctcccgttctcgaaggctacactgtttggactttggactgaacgccgcaagggaagcacttcgagtgagaattacccacattcgatttgtttggtgccccccgacttagaggtgcattcgcaagttcgcgcgcgaatttgctgacattaacccccccgccttaaaatagacacccgcggtagaatcgtcgaaccggtggagtctgaacgctttgaggccttcaaagttggcccatatcgtgtcccccccgaaaggaggcccatcactccgtcatagggtnacagcctacgagaggaatggagtcctcccccgcaattctttgtggaaattcgaaaccgtagttgggaggcccatacattgtcgaattccgtctgatgggcaagatacgtgcccgagaggcttgggtcccagggtcgctccacaattggttatattcgcgcacaaattggcccacgcaaatttgccgaggaacagtaccttttgtggagacagatacgtcccactgagtgctccttctgtgtccctacttcggttagagaggagattggttagcggagaacgcccttatgttgcgaagaccatccacgggaacctcgtaacatccccaactcggtgaattcccatgtcttgaagtgtcgtccggtcctagctccttaagacttgtttcaagcacagctataatcggccgacccgatgacgggccttggatgtgcatgcaccgaagtaagaggcggcgtatgtccccctctcatttgtgtgcggggttcagtagcactctgtacagtgggacgcaagaggcttctgtcccatggcttgtggcgcagtgtgcaccaaattccacggtgagggcggccattacctgacgttcacccaggggtcccatcgaaacctgtgaatggtgtcccgtcgatggagaggtgggctttaacacgcggtgggtggtggtcctggggtcgccgaccttgagggagacgtggtagtacccccggtaaccagagaaagtccagaggcgttgtggtcccctgcgag

SEQ ID NO: 610089 - DNA, 442 bp, Homo sapiens
gatttcggccttttgggccggggcattaaaccattttggcctggaaataaaaaaaaaaaaaaaaaaaaaaaaaaaaaaaaaagagaaaaaaaaaaaaaaaaaacctggggggccccttgggcccagcggattttagatttgggcaggtttttgcttggggccgaatttggggctccttgggccaattccccctttgggggggcgttttccatttcctgggccgcctttttccaaggtggggcttggaaaacccttggggttccccattttaatccctttgcggacattccccttttggccggttggggtaataccaaaagggcccgacccggtggcctttcccaacatttggccaccctgatggggaatgggaatttgtaggggttaatttttgggtaatggggaaattcctttttaattcaaaggatttgcccggggtggg

SEQ ID NO: 610090 - DNA, 473 bp, Homo sapiens
  misc_feature (59)..(59): n is a, c, g, or t
  misc_feature (61)..(61): n is a, c, g, or t
gagtggcggaggcttcaggggtggagcaaatttggacaagagaaggatgctcctcatcnancacttgattttatcgctacctgttctctgccatttcttcagtctccctcaactccagatgaccctggcctgcttctgcacttccctgcatgtgctttctttggacacttcctgcttcctctccctcccagtgtgtaaagtgctggatggcaggaacagagtttttcatcttttatcatcatccaccaacaccttccttcctatgaccacacacacacacacacacacacactcacatacacacagcatctagcaccatgcctcgctcacctaagacagtcaatacttgtgtgttgaacaaatgaagcaaaaggtcctgagttcttatctcagtttaacaatttcacaggttcttttgggtatcatttctcaggtactgtgcacatccaccgccccgaaaagcatcccagacc

SEQ ID NO: 610091 - DNA, 246 bp, Homo sapiens
gtagacccatcatgggaccagcatcttcaccacagtgaaaatgatctcttgataagtcagttaaaggaatctctcaaggtgcgtagaattcgggttcgcaagaaagaccttgtctccttttttagtttcatttttaaaacatgtccatggttcccccaggaagggtctattgactcccgtgttaggggacgtgttagtgattgtctgaacgagtattaccgtgtttttggtccgagcggaccggtt

SEQ ID NO: 610092 - DNA, 555 bp, Homo sapiens
  misc_feature (187)..(187): n is a, c, g, or t
  misc_feature (193)..(193): n is a, c, g, or t
  misc_feature (318)..(318): n is a, c, g, or t
agtcgtgattgtcacttgttcaggaggttgacggaggatctgccaagccaaaggccgcattggacacagagatgggatgtgagtgaggtgggcagtctccctgcctccgtgagctcaccatctgggttggcctgtggtcggggggccctgtggggttgtggggtagggtcagaatgccggcttctgngggtgngggtgcttcttccttctgaggaggctaaagctctctctctgatttcattcacgtgccggtccacaaaggaaagactgtagtttcaaatccaggtgctatggtgtcttgtaccgagcgagggctgncactcagctgcggcagcgtgttgccgagtgacagtgcagccctctcacggcgaacccagggggtaccaagcagtgtcagacactcttggcacatgaaacaaaaccatttttccagctcaggcgtgacccgaggagtgagtatggcttttctttgggtccccgcagtaggggctcgtgtccggcagcgtgtctcattgcctgtgctgtcttacagatcgtgacgtcgctttccaccag

SEQ ID NO: 610093 - DNA, 878 bp, Homo sapiens
taaaacaaggaaaagggttaacttcccccctacgggggataaaaatcaaaactacgggccaggcgcgggggctcgggccggtagtcccagcacttggggaggccgagggggggcggatcgccgtgaggctcaggagttggaaaccagccgggccgacgttggtgaaaccccggtctcgtgctaagaacacaaaggttagccaggcagtgggggccggacaccggtggaccccagctacctcaggagggtgaggcaggagggctcactgggaccccgaaggtggaggtggccaggggagccgagatctgggtcatggcactcacagccggggtgacaagcagcgaaactccatctcgaaaaataaaataaaaatgccacaaaaaaaaactcttgttgcgcgcccctttggaccccacaagaaaaggtctttctaaaacacacctcttgtggggggggcgccgggccaccccaagtgtgggaccggcacacaggtggcgccaccaagcgggtccctaaaaacaacccggggcacacgaacccacggtggggtgcgtgtcccccccataaaaaaaaccgccgcgggtggcacagcgcttgtctcgtcgaaccaaccccgcaagaggctgagggaggcccgaggggtctccacaccaaggggaggacacaggggagtccgtaaaaaataagacccgaggcggggggaaggagacgagtgagaaagacgcaagcaacacagacggcaagagacacgagactgatgcgcagcccaaacagacgaacacgagagaacacgaggacaagacccacacgacgagaaagcaacacacaaacgcagaagagtgagcagacacagacaagaagagagagagacacacgcg

SEQ ID NO: 610094 - DNA, 331 bp, Homo sapiens
tggaggcagggtctctccgtagcccagcctggactacagtggcaagatcacggctcactgcagtctcgaattcttagaatcaggtgatcctcctgcctcagcctcccgagcagctgggactaccagggcataccaccacgcctggctaatttttgtactttttgtagagacggggtttcatcatgttgctcaggctggtctcgaactccttagctcaagcaatctgcccgccttggcctttcaaagtgctgggattacaggtgtgaaccaccgtgcctggctgactacagattttttaatagcacgttggttctttgaactgaccactgtg

SEQ ID NO: 610095 - DNA, 123 bp, Homo sapiens
tttatttgcattctcagccaccccatcaagatttttcacataaagattcacaccctggtatctggtgatcctatcttgtttcatctgttcaaatttgcgcttaagttccgcctgccacaacct

SEQ ID NO: 610096 - DNA, 849 bp, Homo sapiens
  misc_feature (564)..(564): n is a, c, g, or t
gggttccccccccccttttgtcccgccctttccttacgggcttttctctctttgggccccccgcacatgggttgccctcccccgcagccgctccttttatgggcgtgggcgccgaccacgggacaagattacacacaggggcgcgtgtttcctcctcggggcactaatctccggccggcccccacccccccccgttcctcaagagcgccttttttttcgcgggaggatttcttgtttttttccgcccccccgcggggttttttttttcccaacaagaatttgtgggcggtttccaccgcccgccggtctccccctcgccccctcctattgggggggcgctgtcgcccccccacgagtgtctgtcccccccggtattccccccttagggtcgcccccttgtccttgaccacacccgctgtgtttttgcgctcctcagggggggtctcttacctcccccggggctcctccccctgtgttttaaagtagccccccccgccccccctaatgttctacgccgcgctgttgtcacacacttttctgcggtgtttttttgttctcctcctncccagcctccgcgccgagtcttttggtggttctccctccccctctttcgcggcgggggttgttcgtgtcgacccactctctttttgggacgaccagcggtgttccccggcgttttcctacctcactatttgggtgggtcatcgcttccccgcccatgtttcgtttctccgcgccccattttctcccttaacccccaacacacccttgtttaaccccccccctttccgcccttttttaaatggttttttttttttttttttttccccttttttttggggggtttta

SEQ ID NO: 610097 - DNA, 1312 bp, Homo sapiens
ggttgtatgaagtttggtcccccccgtgttggtgtcccccttggggcgcccccttggcgaccgaatttgtcgggggggcgagttccctggtggcccctcgttgtgcgccccgcggtgtgtgcacgggttgcgacctggggaggagttttctgtggtggaacacactcggccgcctgcttcgccccccacagtgagtgggtcgtgcgcgcggaccatcgtatggggggcgctctgtggttagccaactgttgtcgttctgttgtggcctctttgggggccaaggggggcccttcctcggtggtgtccctacgcctttctgaggggcccaccagttttaatgctttggcggctcctcttctgtgaggggggatatttttccctcccccccccgtgattgttttctgcccccctctgttgagacacacgcacttcgtggttggacgcgtcggtgtgtgtgttttggtctcccccactgggggtgagcgcaacacgcccgcgctggagggagttggtgaggttgtgcgcgcccccgggggccatggtcgcccccccgcagcctgctttccaccgctgctggtgtacccacggggcctcgctgtattcccctccaggcggtggagagagacagagggagtgtactcccggtacgtctctctctctcttccacgcggggttaatgaacgcgctctgtatgtacgcgtcggactctcctcacactgcatgggtacagactaggggttttctgcccggcgacggttctctcctgtgggcgccgcctccgcacggttctgttgtctatgtgaacaactcacccccccggttgtgttttcgtcacagtctctctctctctcccgcgacgtaacaaaatatgtagagtgccggcctgcccgcgccccccaccaagttttgttgtctacagggagttaagatatgccgcgtatatatatctcttctctcgcacagatgtctccccctctgtcccatcagtggtcacaggagctaacaagattttgtcttccaacacccgttttgtgcaccagcagatgagagtgttcttccacttctcatcactccttttatctacaaaatcaaagatgtatcttatcgctcgcctccttgtagcaaaaagaatagatgatgtcttctaccccctgctcgccccttcattatagcaccaggatacctttgaatttctttttttccgctcacaacaagaaagagaagtctggtgcctccccccccccccccccgggggaaaagatccccacacctttttttttttcggggaaaaaaacctttttttctcctttta

SEQ ID NO: 610098 - DNA, 199 bp, Homo sapiens
acactaatgtaatgctcgtctacttcttagagcctccattgaatatgatggggtaaggtatgagagaagggaaagcattctataattaggtctcagtcttttagtgagactatgcccctggactgtgaactttgcaagtgtgtctcagttttttttctctcccatttagggtgacacagcatggcatgatgggcgggtc

SEQ ID NO: 610099 - DNA, 249 bp, Homo sapiens
  misc_feature (136)..(136): n is a, c, g, or t
  misc_feature (240)..(240): n is a, c, g, or t
gtctggacagggcacaggtgaccgagacaagtcttatttaactgatttcacaagaagggtccgagttttattagacaacccatgtcaaggtacaaaatgattattgtttttatcagccatattctattagccaagngccacctgtcactatttttctatcctggaggacatccctgggctctcagttgctaggtgggcccctgaagaaatgaatgtcctcaaatcgagaaaaaaacacanagagattcc

SEQ ID NO: 610100 - DNA, 343 bp, Homo sapiens
gcgtacttgcagctctctctgatggtgtccattcttattcaaaagcgaattcattatttttctctcttttgctctacgggattaagtgttgattcatcaacatcgaaccaatagttgatcaaagtatagaatatcatcaggtcttacaaatggaagatttccagatggccggtcattaacacttttcatagttcgatcttcagtttgcatgtggaaacgagtcataccaccacaaaggtgatggagtagctgtcagttttcgagtctgggttcgaataggaacataaacagctggaggaggaagtaccttatatccttctgggaacatagcatctaatccctg

SEQ ID NO: 610101 - DNA, 425 bp, Homo sapiens
  misc_feature (110)..(110): n is a, c, g, or t
taaaaaaaaaggtttttaaattgtaggagcaggatggaaatactttgctgcccctcccattttttaggatgggcccccaggagaatgaggtttttctgggccctcattgntgcttattggaccccccctcccctgcacatggggcagaccggggtggagggtggccttggctgtgttcgtccccacaaaaaagctttgggccgcctctccctgttcccttaagggggatgaagggcgatgcctcgcccgaggctttggggttttgccctgcatgctggggctgctcctactttttgtcccccccctccccccactgtggtccggctttgggaaagtggtgaattgccctgccccaactcggagcggagcagggtaggggccgtgttcagctttataaccctttataaaaagggggtttttcccga

SEQ ID NO: 610102 - DNA, 346 bp, Homo sapiens
ttccagaatagcattccacaatgggtaaaaaaaaaaagggtagaaacatcctcaaatgtgccatcgggtggatgaatagagaaatgtgatatgtcctatacaatgggatattactcagcaataaaaagaaattaaatactgacagatgttacatgtaaatgaaaggaaccttgaaaactttgttgtaagtgaaagaagccagtcacaaaagaccacatagtaggctgggtatgatggctcaggcctgcagtcacagcactttgggagccaaggcaggaggagcccaggtgttcacttgagcccaggaatttgagatcagcctgggcaacataatgaagccctgtca

SEQ ID NO: 610103 - DNA, 356 bp, Homo sapiens
caatgctttgaaggaataaacgaaatgtttaaacagggtccatccctttgaagaaaaagttgggcaaaataatcagccttgctccctcttttatttaatatttggggactgattatatccccatggaagtagaaggtaaggagtttaggaaaatactagaatttactctgcttaccttcttgtttaagggtttaccccgtttggttcaattataaacctttggcctttttctatgttatttttattttgtatgaataccttatcccccctatttatttttgttacctttattacttatgttattttgttatgcctttcccaccccctttttaaataaagtgtttttggaactttta

SEQ ID NO: 610104 - DNA, 128 bp, Homo sapiens
ttattgccaccattgcagcgaatctctctttggcaagaagtacatactgcgggagcgagagcccctactgcgtgtttgtgcttctgagaccctgttcgccaacacctgcgcagtagtgtgggaacgcc

SEQ ID NO: 610105 - DNA, 246 bp, Homo sapiens
ccccccaaaattttttgggatcccgcgggtttccccccggccccccttaggggcccccttccccagaatccccgccccatttttttgaggggtttccggggggccagaaaaaagcggcccccaaaaaacccccaaaggtatggggccccggggggttttggttcctttttcccccaaaagggaggggttttttttttttttttttttggtatcccccgggttttttttaaggttttttttttccca

SEQ ID NO: 610106 - DNA, 296 bp, Homo sapiens
taataatagtaaccctgctctacataggaggactgcctccagatcaggatgatgccaaaggtgagtaataatgcaagaaataacaaaaaatgaaagctcatcatgccaacgctcatagcaataacagcagctgataaagctctatttctacatacgactagcctactcctcctcactgactatgtacccatttcaccaagaacataaaaataaaatgacaatgcgaacacacaaaagcaaataaaattactgcccacaatagttgcctgatcaacattagtcctacctataacacc

SEQ ID NO: 610107 - DNA, 408 bp, Homo sapiens
  misc_feature (12)..(12): n is a, c, g, or t
  misc_feature (127)..(127): n is a, c, g, or t
gcgtctgtctgntgtgggggaggttgtggcttaatgggggagagggaccaagaacaggaaattagccaatgaatgtcctgactctggttctgcccctcctgtcccctctgctttcattcctgctctngctcacaaactcctacacatcctacaagaacccggcaggcccaggtcatctatctgcgggtgggctttgatagaatactgaccttcgcagattaacggagaactggctccccttggggggggcctgggaagctccataggtccccactgagggctttccttcccctgtggaatgcttctccctcttctgtgtctgccattgtcattcaaatcttccagttaaattccaaaggcatcttcaaggtgccggtttgcatcggcagggcttggggttgaggcacc

SEQ ID NO: 610108 - DNA, 537 bp, Homo sapiens
  misc_feature (470)..(470): n is a, c, g, or t
tcacactagaagatgtggtcagagatggaccccaggctgctgaattttgtgactttgggaccataaactcttttgagaatcttatggaagttatggatcctttctttctcaccctcacatacacatgccattcagacttgcatatattttagatggtttctcaaacactagaatttcaaaagtctaaaccatcccaatacctttatatcatcaccagggttttagctctataggacttctctggagagcagtggagtgtgctcagtgacctgcaaaccgaacctgctccccagggagcccaaagttctggagtcagaagatctgggttctactccaggccgtcgcatatcttagctttgtgaccttgagtgagtccttcaatttctctgaccttaattttctttgtctgttaaatggggttggtattctctgtccccaggagctgtgaactaacatttataaagtcattntgcaaattgtgaaattacaaacaaatctaatatattatttctccctgctaggcctggagcaggtgag

SEQ ID NO: 610109 - DNA, 108 bp, Homo sapiens
  misc_feature (35)..(35): n is a, c, g, or t
gcgtggtgaagcgctacggacccatggaggagccnctggtgatagagaaggacctgccccactatttctagctccacaagtgtgtggccccgtcccgaaactgagaca

SEQ ID NO: 610110 - DNA, 150 bp, Homo sapiens
  misc_feature (145)..(145): n is a, c, g, or t
gctcgcgcgcctgcaggtcgagacttccaggttgtgatgaacctatgaatcgcaccactgcactccgccctgggcaacagagtaagaccctgctctcgaaaaaaaaaaccaaaaaacccaacctcctaggtttacaaaaagcgtnaaaat

SEQ ID NO: 610111 - DNA, 200 bp, Homo sapiens
tggtcttgaggacgcagaggttacaaaccacagtgctgggtcaggcccaagtaggacttgatggtcataaccagaggactgaagggacagcttgtcctggcaccatactggagaagtgcttgttgtgtttgggggagaaggggtgcattgcccaagtcaaggctgaaggaggaacgcttgtgccctggagcctgttccca

SEQ ID NO: 610112 - DNA, 162 bp, Homo sapiens
ggtttggtttgtgcagatgctgttagtttcactttgtctacaaatcctaacaacaaatcccatttcaggttcagatgattcgacagataagcagtgaactttcagggcctgagattgttgaagaaatgtttcagtaaaatccacatctgtgacatgcaaata

SEQ ID NO: 610113 - DNA, 801 bp, Homo sapiens
  misc_feature (5)..(5): n is a, c, g, or t
  misc_feature (109)..(109): n is a, c, g, or t
  misc_feature (140)..(140): n is a, c, g, or t
  misc_feature (147)..(147): n is a, c, g, or t
  misc_feature (163)..(163): n is a, c, g, or t
  misc_feature (169)..(169): n is a, c, g, or t
  misc_feature (171)..(171): n is a, c, g, or t
  misc_feature (184)..(184): n is a, c, g, or t
  misc_feature (190)..(190): n is a, c, g, or t
  misc_feature (202)..(202): n is a, c, g, or t
  misc_feature (222)..(223): n is a, c, g, or t
  misc_feature (226)..(226): n is a, c, g, or t
  misc_feature (228)..(228): n is a, c, g, or t
  misc_feature (236)..(236): n is a, c, g, or t
  misc_feature (241)..(241): n is a, c, g, or t
  misc_feature (243)..(244): n is a, c, g, or t
  misc_feature (246)..(246): n is a, c, g, or t
  misc_feature (248)..(248): n is a, c, g, or t
  misc_feature (261)..(261): n is a, c, g, or t
  misc_feature (269)..(269): n is a, c, g, or t
  misc_feature (271)..(271): n is a, c, g, or t
  misc_feature (294)..(294): n is a, c, g, or t
  misc_feature (296)..(298): n is a, c, g, or t
  misc_feature (302)..(302): n is a, c, g, or t
  misc_feature (304)..(304): n is a, c, g, or t
  misc_feature (307)..(307): n is a, c, g, or t
  misc_feature (330)..(330): n is a, c, g, or t
  misc_feature (332)..(332): n is a, c, g, or t
  misc_feature (337)..(338): n is a, c, g, or t
  misc_feature (340)..(341): n is a, c, g, or t
  misc_feature (349)..(349): n is a, c, g, or t
  misc_feature (364)..(364): n is a, c, g, or t
  misc_feature (370)..(370): n is a, c, g, or t
  misc_feature (373)..(373): n is a, c, g, or t
  misc_feature (378)..(378): n is a, c, g, or t
  misc_feature (390)..(390): n is a, c, g, or t
  misc_feature (392)..(393): n is a, c, g, or t
  misc_feature (396)..(397): n is a, c, g, or t
  misc_feature (399)..(399): n is a, c, g, or t
  misc_feature (401)..(402): n is a, c, g, or t
  misc_feature (405)..(405): n is a, c, g, or t
  misc_feature (413)..(413): n is a, c, g, or t
  misc_feature (415)..(415): n is a, c, g, or t
  misc_feature (417)..(417): n is a, c, g, or t
  misc_feature (419)..(422): n is a, c, g, or t
  misc_feature (424)..(426): n is a, c, g, or t
  misc_feature (428)..(428): n is a, c, g, or t
  misc_feature (435)..(435): n is a, c, g, or t
  misc_feature (444)..(444): n is a, c, g, or t
  misc_feature (446)..(446): n is a, c, g, or t
  misc_feature (451)..(451): n is a, c, g, or t
  misc_feature (458)..(459): n is a, c, g, or t
  misc_feature (463)..(465): n is a, c, g, or t
  misc_feature (467)..(467): n is a, c, g, or t
  misc_feature (474)..(477): n is a, c, g, or t
  misc_feature (479)..(480): n is a, c, g, or t
  misc_feature (483)..(483): n is a, c, g, or t
  misc_feature (486)..(486): n is a, c, g, or t
  misc_feature (488)..(488): n is a, c, g, or t
  misc_feature (493)..(495): n is a, c, g, or t
  misc_feature (497)..(497): n is a, c, g, or t
  misc_feature (502)..(502): n is a, c, g, or t
  misc_feature (506)..(506): n is a, c, g, or t
  misc_feature (508)..(508): n is a, c, g, or t
  misc_feature (510)..(510): n is a, c, g, or t
  misc_feature (512)..(513): n is a, c, g, or t
  misc_feature (517)..(517): n is a, c, g, or t
  misc_feature (530)..(530): n is a, c, g, or t
  misc_feature (535)..(535): n is a, c, g, or t
  misc_feature (542)..(542): n is a, c, g, or t
  misc_feature (545)..(545): n is a, c, g, or t
  misc_feature (552)..(552): n is a, c, g, or t
  misc_feature (554)..(554): n is a, c, g, or t
  misc_feature (573)..(575): n is a, c, g, or t
  misc_feature (588)..(588): n is a, c, g, or t
  misc_feature (593)..(594): n is a, c, g, or t
  misc_feature (605)..(605): n is a, c, g, or t
  misc_feature (798)..(798): n is a, c, g, or t
acaanatggccttcatggattaaaaaaaggaatcaaaccacaaggaaaaagaaattgctggttttcactcaagattaatctagaaaagtgtactgactactggaataanagtttacccctgggttgtaccacagaatganaaattcnacaagattatacaacncttttncnacaagattacacnacccanattgtttttatnccattccggaattagaaatnnacntnctaaatancattntnntncnccaaaaaaatccncttaccancnaacctggatatggacaaaaatancnnnattncngtnaaggtctatctccctagtaaaantnaatanntnncccttgantttattcaaggcaancaccancanccgtngaacacccaggnannccnncncnnccnggcccctncncncnnnncnnntntcccccnccgtccccncngggcngccaccnngggnnncncccggcnnnncnnccntcncntcccnnncnccccntttncntntnnggcnaccgtggcccccnggtcnccattcntcnacccagncnacggcagaagccgcaccannncccggcccccccncccannacgccgccccngccaggcgcggcggcccacgcctgccaccccagcacttcgggaggccaaggcggacggatcacaaggtcaggtgtttgagaccagcctggccagcatggtgaaaccccgtctctactaaaaatacaaaaaattagccgggcatggtggcctgcacctgtaatcccagctacttgggaggctgagtcagaattnctt

SEQ ID NO: 610114 - DNA, 409 bp, Homo sapiens
gatgtccagccaccaggtagacaaattatgtgtgtaatttttttttcgtcaactggactgggccgggcagggggctcggggtgcataattctaggtgagtcggtgagggtgcttccggatatgatgaaggtttgaatctatggactcagtagcgtagatggccctcccaaggtggatgggcctcatccaatcccctgagagcctgaagagaacaaaagaaatggatctcttcctggcctggatggcctggaatggtacatccatcttctccagcttagttctcagaccttcagatccagatgggaatctacatcatcggctcggcagtgttctcaggccttcggacggggactacataacaccattgggttgcctggggttcccagctggctcaagaggggtaccgagc

SEQ ID NO: 610115 - DNA, 147 bp, Homo sapiens
cccccccggccggaaaaggggggggaggccccccctcttttaaggggggtccagggcggctttttgcccttgtttgggggccccgcccacccccggggttgggggccctgtcctgggtggggggaagggtttacccttgttttccca

SEQ ID NO: 610116 - DNA, 270 bp, Homo sapiens
  misc_feature (241)..(241): n is a, c, g, or t
  misc_feature (243)..(243): n is a, c, g, or t
  misc_feature (245)..(245): n is a, c, g, or t
aggaaggagggagatgacaggagggttgaggtagatgggtggaggcaggcgtcgacgatgacaggagggttgaaggagatgggtggaggaaggagggagatgacaggagggttgagggagatgggtggagggaatagggcagaggaaggagggagatgggaggaggtaaatgggagatgggtggagggaggagggagatgacaggagggtcgagggggatgggtggtcgacgcggccgcgnantnagtagtagtagtagtacgcggccgc

SEQ ID NO: 610117 - DNA, 370 bp, Homo sapiens
  misc_feature (341)..(341): n is a, c, g, or t
  misc_feature (343)..(343): n is a, c, g, or t
  misc_feature (345)..(345): n is a, c, g, or t
aggaaggagggagatgacaggagggttgaggtagatgggtggaggcaggcgtcgacgatgacaggagggttgaaggagatgggtggaggaaggagggagatgacaggagggttgagggagatgggtggagggaatagggcagaggaaggagggagatgggagatgacaggagggttgaaggagatgggtggaggaaggagggagatgacaggggggttgagggagatgggtggagggaggagggagatgggtggagagttgagaggtaaatgggagatgggtggagggaggagggagatgacaggagggtcgagggggatgggtggtcgacgcggccgcgnantnagtagtagtagtagtacgcggccgc

SEQ ID NO: 610118 - DNA, 319 bp, Homo sapiens
tctcgaggatccccccgtattgcacgcggacatcccagaagtggttgtttcccttgtcattgtgacgaaagcttgggtcctaagcatccaggcgtcaggtaaaaacatgggctgctattgcagaataccagcgtgcattgcaggagaacgtcgctatggaacctgcatctaccagggaagactctgggcattctgctgctgagcttgcagaagaagaaaaatgagctcaaaattggggtagagcagaaggtacaggagtaatagcaattccctgtagctctcaaagcaaattttgagctcctttctctttttctgcaag

SEQ ID NO: 610119 - DNA, 100 bp, Homo sapiens
aaagctccaatgggcgagagaatccaataagaagagaactctgtaaactacaggtgacaaacaatatcctagcaaaaaagcaggggcgggcgaaaccgcg

SEQ ID NO: 610120 - DNA, 197 bp, Homo sapiens
gggaggttctctcaactttattttctaaaacttttaacatatgtacaatttctgctattttaattgaataaaattgagctcttcctgttctttgaatatcctttttccagtctcctgttctttgaatatcctttttccagtctcctgttctgtccattataacaatatctctctcatctctgaggatatctagagag

SEQ ID NO: 610121 - DNA, 342 bp, Homo sapiens
  misc_feature (160)..(160): n is a, c, g, or t
gggattcgttggattgatggtggttttaagcccacagaagttccctttttcaattgtgtgaagaagtgtgttctgatcaggtattttataatgcttgttgatttatgggaaatttaggggaaagtaatggggaagattagaaagaattagccaacagggntacagttgatatttaaaagatccatttaaaacaaggtgatagtgttttgttaagcagtacattttgtgcatgcaaaaatgaattcacccctcccacctcttttttcaattaatggaaaattgttaagggaagttgatacagagagacaacttgctcctttccatcagctttataataaactg

SEQ ID NO: 610122 - DNA, 591 bp, Homo sapiens
aattcgcataaagtttaattcacacagagccagctatacaggagaccaggttttattattactctaatgaatctccccaagaattcggggattggagtttttagggataatttggtgggtagggggccagtgagtaagagtgctgattggtcaggttggagattaaatcacagggagtctaaactgtcctcttgcgctgagtcggttcctcggcaggggccacaaaaccagatgagccaatttatcaatctgggtagtgccagctgatgaagccatcaagtacagggtctgcagaatatctcaagcactgatcttaggttttacaacagtgatgtcatccgatgagcaatctggggaggtttagaatcttgcagcctccagctgcgtgactcctaaaccatgatttgtaatcttgtggctaatttgttagtcctaccaaggcagtctagtcctcaggcaggaagggggtttcttttgggaaagggctgttatcgtctttgtttcaaaactaaactatataactaagcttctcccaaagttaattcaagctataaccagaacaaggacacgttggaggtagaagccagatgg

SEQ ID NO: 610123 - DNA, 132 bp, Homo sapiens
caggctctgctctattgctcaagtcttcatcaagcttcttcttctacaacattcggtgctggagatctgcttcctgatggcctgtgaacgtgatcgggcagcgcatgtactttctggtgaccctgcactggt

SEQ ID NO: 610124 - DNA, 152 bp, Homo sapiens
  misc_feature (45)..(45): n is a, c, g, or t
ccgcaagctggcggtcggcggcgtgaacgacgggggcggcgaagnacgccagcattgcgaagcgcaagattctcattatctcgatcggaatggttgcttcatggatgttcgcaggtgtcgcctaccaatccaccggacgcgtttggacgggt

SEQ ID NO: 610125 - DNA, 849 bp, Homo sapiens
agcgggggctgacgatgacccgagtatcgtcgaggccagttaacccctgtgggccctgagcagaggccgtatcttgcgccgcacccgcgtccaggcggagcctaagatgccggcttctgcatgcgcaggcccggcccgggtcccgggcatgcctacacgactctgctcttccctgctactgaccgtgctgtcgtgtgctgatcgggccggtatccggtccgcgtccctccgctcggtgcccagaacctcgcgttcaatctctgaggctgagttcctgtatcagcccggtttcgcagtcctctcacacatacaattactctgtgctccttgatggatccgtgccgtctgcacacactgtatgtttggcgcccgggacaccatcttcgctttatccctgtgccttctcagggtgaacagacccgcgaggattgcattggcatggtacctgaaggctcacagaacagaactgtacggaagtacacggcacgtaaagaggacgcaactgtcagcagaatgtgtccagattctcgccattgccagtgcctctcacctcctcacttgtggcaccttcgctgtagatccgaagtgcggcgttattgaatgtgtccaggttccacgcaggttgaaagacttgagaagtggccggtgcgacatgtccttgcgagccagctcagcggtcagccagctgtaagtggctgggtaggtcctctatgcttgccactgtgaaataactacctggggacggagccaatatcatcagagcagtgggtctagccgaggactggatacggacagatacttgccttcttggctgaaccgcccaagctttgtaacagcgtgccttgagcc

SEQ ID NO: 610126 - DNA, 133 bp, Homo sapiens
actcattaatccaacatagcagctgtgatgtcataactgtatttcagggggacaggcaggagcatcatggaaaggtctcttacaaggactctagaatacaagctcctgataacttcaagatcataccactgga

SEQ ID NO: 610127 - DNA, 437 bp, Homo sapiens
tcgagccggtacccggtcccatgcacagttaactctgcagaaaagcttttgaacacaagaaagagtccatagtcacagaccccacagttagcaattgcttattatcagccttttatttatgtattcatttattttatttatttatttttttgagatggagttgccctcttgttgcccaggctggagtttccttgaggagaccagcaccattagtttgttctcacattgctataaagaaataactaagactggataatttatagagaaaaaagactccatctcaaagaaaaaaaaatgagaaaaaccccaaagcttcaggagacccagggtatgaaaccacagatccactgggcaaggaagatgatgcctcagtatcccaattcttcagatgttcttcttcttcttcttcttcctttcttcttttttttttttttttt

SEQ ID NO: 610128 - DNA, 433 bp, Homo sapiens
cagcgatgttctcagcttcactgcttcgctcaccagcaccgaggccacctcacacagctctctcagctggacttctgtgattgccagcaccaagatcacttcacagagtactcccatgctttgacttctctgactcacgaccaccgtgaccagctcacacaataccctcggcttaagtacttcagtcgacaccaccaagacaacctcacacagtactggcagcctcacttctttgattgccaccactgagaccacgtcacacaatactcctggcttcaattcttccatcgccaccaccgagatcacctcacacagtactcccagcttcacttcttcaatcaccaccatggagacaacctcacggagttctcccagcttcacttctttgatcaccatcactgggtccacatcccacagtactgccagcttcact

SEQ ID NO: 610129 - DNA, 575 bp, Homo sapiens
ccgttatttccccacccatgtattttccccacccataaaaaaatgctggttggagaccccccaagtaagggagaagattaccccctgaaaatttgtatttttcatgaaataaaaagggcctctttttggggccatttaaaggagaaaaaaacccttttctccccttgcctttagtccaaaaaaaaaatgctttttagccaaattaaaaaggaccttgaatgcttcttttcccgtttattgggtgaaaggggatccatttgagtctggaaaaaaacaaagtgttttaaaaatagtttagtttgtggcttcaaggaaaccccctgttaactaaaagcttcaggggtaaggctatgttccttccaaaaaaaaaattccaaccatccccggattttaaaatttgttattctcccctgaaaaaaaatttttgttgaagccaaccaaaaactttttccccctttaaaaaagaaaaaaaccttttttggccccaaaatcttttgttttttaaggtaggggaaaatttgttgggaatatccttttgtggggggaaaaaatcttttttctttaatggtataaga

SEQ ID NO: 610130 - DNA, 170 bp, Homo sapiens
ctccctaggttatgcactaagtgacatgtgctttacactaataccatgatatgtagtggctccccagccacatggaactgtaagtcccataaacctctttcttttgtaaatctgcgcagtatcaggtatgtctttatcagcagcgttcacacggactaatagcaacatag

SEQ ID NO: 610131 - DNA, 186 bp, Homo sapiens
gggcgattgaggatcctatatgcgtctcatatcctaactcaggaccactgctcaataagacaatccaataaaatggacaaaagattgaaaagatattaaagaagatatacaaatggaaaataagtgcaagaaaaaatgctcagcatcattttagtcattaggaaaatgcacatttaaaaactacag

SEQ ID NO: 610132 - DNA, 128 bp, Homo sapiens
gggtcagtagagaactgggattcctttatctgtctggtctaccatcctcaggaggggactttcattctcagggtcattcatggtgcaactggtcctaaatcttcaccgaagggaccaggggcggaagg

SEQ ID NO: 610133 - DNA, 483 bp, Homo sapiens
cgcttcaacttgatgagatttccatcagtcactcccaatgtgtcacagcttctgcagccctaaaattaaaaggtgagtgagtctctgaggcccctctccacttctcggatgctgagtttagccttcatgtgaatgtggaaagactaggaatacggctgttatcacacaagctggcccaatagtggttcagttgagagagccccatccttcagagtcagctccagctaggagtgactggtggccttgagcatggtgctgggcttagtgttgccatctgtggaatgggtgtgggtctgttgccctgcctcctcccagagctattctgaggctcagaaggggtgatggatgtgatggtgctcccaacactagaaagcatcttaagaatgtaagattttcatgatgactgttgctcagagtggctattatagttttgctttattgttctataacctatgattaaaatttttaccttaaactttgaaa

SEQ ID NO: 610134 - DNA, 116 bp, Homo sapiens
cccagactgaagaaaagccaatcaagagcgagacagcgctcctgtggccatcagcaagccttaacgatcatccgaaaggtgaccacaagattctagaactctccgacataatcacc

SEQ ID NO: 610135 - DNA, 476 bp, Homo sapiens
gcaaggggtgtcccaggaactggacaaagaccaaatatatatttcttactgtatcacagtaggagacttgccaaggtcccacagtgactcagttttatgactcttacatgtcttcctatttagctcacagcctcttgccagtcatttagatatttgtatatgggcagggagggtaagcatggggtagtaagtctgtcattttaatggagtggaaattttcaactcagcctcatgaaggtaaatacattttatggtttgaaagttagtctcctgtttttgactgggcttggttgggggtactatttagctctagatttgatggtttaaatgaaattagctcataaaatcaccaatggtcttctgttttatctactttttctggcactggtccagaccagagaaaccaatcccaggctaggactgggaaagtctgggactgttcactgctctgctgctgattggctgtgagactttgg

SEQ ID NO: 610136 - DNA, 500 bp, Homo sapiens
ggtctgttacccctacgacgcagaaggcgctgcgcaccactgacttctgactcctaaatcacgctggaaacctatgcatagtcttcttcctgggaacggtataaaattcgcgtagcattgcagagaggctggtacgagatactgcgcgagttggcgaacacatttggcggtatagacttggtaccacatatcgaatctaaaccgctgtccatgtctatcgaggagttatgcgcccgctctccaatgccattccaaaaagcagagcataagataaaagttgaattcgcaaagttactcaagcagatcgagtcggtcgaagctcacactagggtcttgtggtcaattcaacgtgatcatgaccacgaactatgactttacgattgaggaggcatatgccgggacacttcactctccaggatcccttgctcgcgaatcgcgatacagcctatatcgtcggcacactgcgggcaagaagggattctggcatgtacatggcgacg

SEQ ID NO: 610137 - DNA, 128 bp, Homo sapiens
agacttgaaacagttatgcagttatccagctgaagacaggtgtgctagaactagatagaactctgggagccactctgtcttctgagggccagtgtgatgccctttcttctggacactttgcatccaga

SEQ ID NO: 610138 - DNA, 280 bp, Homo sapiens
  misc_feature (109)..(109): n is a, c, g, or t
  misc_feature (138)..(138): n is a, c, g, or t
  misc_feature (203)..(203): n is a, c, g, or t
  misc_feature (208)..(208): n is a, c, g, or t
agcatcaagtctccagaaacatggcagagcagacaggccgttaagtttcacagacatcatagatccttttcttaaagaagaaaaacatgtataaatagttttagtagtncaaaatgtcaactatctgtagctgctttngtgtgtgtgtcagtgaacaaataataatgccttgctcaatcaatgcattcagccatctcaagtgnaattngtgaaggagactatggtttccaaaagatacatttttttacaaagttaaacctgtaaaaagtctttttttttt

SEQ ID NO: 610139 - DNA, 794 bp, Homo sapiens
  misc_feature (210)..(210): n is a, c, g, or t
  misc_feature (240)..(240): n is a, c, g, or t
gggccgaaggctttttttctttaaccttaggatccacctcactaaaccctgtatcctccagtctaaaaagttctaaacgtaacggatctccttttttacttttatataaagcactgtcaaaagacgccacactgtcatgatcttacagcatttctttgtctttgaagtctcagcaattccctttacacttttcccacttccttccttgantgcattctgcacttgactaactctgattancagcaaaggagctgaaggctcttattagaatacagtatgccagcacattctgtatttatggtttttttcaggggaaccatttaatgacacatttcttaggtttgtgtagatacaacaggtcacatagagaaatagatgcttctctggttcctttgtaggtagaagcacttggtgactataactgacataattaaaacatttaaaaataggttctgcaggtgcggtggctcgtccctgtagtcccagcactttgggagggctgaggtggaggcatcacttgagcctgggaggcggaggttgcagtgagccgagattgctccattgcactccagcctgggcgatagagtgagactcagcctcaaaaaaaaaaaaaaaaaaattcgccaggtgtggtggtgtgcgcctataatcccagctactcaggaggcagaggcacaagaatggcttgaatcacttgaacctgggaggcagaggttacaatgagccgagatggcaccactgcactccagcctgggcgacagagcgagactccgacttcccatcttaaaaaaaaa

SEQ ID NO: 610140 - DNA, 215 bp, Homo sapiens
aaaatttgggggggtggggtttaaaccccaaatggggggggccccccgccttttccccggggggccccttttggccccaaggggccggttaggggggttttttttaaatttaaaagttttattaaaaatttttttttaaccccggcccttaggggccccccttttggggtttggaggggggggccccctaataaaccaaagggggctttttttta

SEQ ID NO: 610141 - DNA, 87 bp, Homo sapiens
tttttttttttcagtatatgttataggaccacatttattaataatatacgttatgagaacaatcatttgcagtctcactgtgaaggc

SEQ ID NO: 610142 - DNA, 917 bp, Homo sapiens
  misc_feature (19)..(19): n is a, c, g, or t
  misc_feature (68)..(70): n is a, c, g, or t
  misc_feature (117)..(118): n is a, c, g, or t
  misc_feature (156)..(156): n is a, c, g, or t
  misc_feature (182)..(182): n is a, c, g, or t
  misc_feature (185)..(185): n is a, c, g, or t
  misc_feature (202)..(202): n is a, c, g, or t
  misc_feature (290)..(290): n is a, c, g, or t
  misc_feature (295)..(295): n is a, c, g, or t
  misc_feature (311)..(311): n is a, c, g, or t
  misc_feature (315)..(315): n is a, c, g, or t
  misc_feature (465)..(465): n is a, c, g, or t
  misc_feature (469)..(470): n is a, c, g, or t
  misc_feature (472)..(472): n is a, c, g, or t
  misc_feature (474)..(474): n is a, c, g, or t
  misc_feature (484)..(484): n is a, c, g, or t
  misc_feature (490)..(490): n is a, c, g, or t
  misc_feature (497)..(497): n is a, c, g, or t
  misc_feature (499)..(499): n is a, c, g, or t
  misc_feature (556)..(556): n is a, c, g, or t
  misc_feature (562)..(562): n is a, c, g, or t
  misc_feature (577)..(577): n is a, c, g, or t
  misc_feature (595)..(595): n is a, c, g, or t
  misc_feature (611)..(611): n is a, c, g, or t
  misc_feature (624)..(624): n is a, c, g, or t
  misc_feature (640)..(640): n is a, c, g, or t
  misc_feature (648)..(648): n is a, c, g, or t
  misc_feature (652)..(652): n is a, c, g, or t
  misc_feature (681)..(681): n is a, c, g, or t
  misc_feature (693)..(693): n is a, c, g, or t
  misc_feature (706)..(706): n is a, c, g, or t
  misc_feature (714)..(714): n is a, c, g, or t
  misc_feature (719)..(719): n is a, c, g, or t
  misc_feature (730)..(730): n is a, c, g, or t
  misc_feature (736)..(736): n is a, c, g, or t
  misc_feature (741)..(741): n is a, c, g, or t
  misc_feature (751)..(752): n is a, c, g, or t
  misc_feature (761)..(761): n is a, c, g, or t
  misc_feature (775)..(775): n is a, c, g, or t
  misc_feature (822)..(822): n is a, c, g, or t
  misc_feature (904)..(904): n is a, c, g, or t
caagaggaggcgcagggangaggagggggaacagcgggggaagggcaggagcaccacccccaggggannngggggggaggggggggggggcgggggggaggggagggccggcagggnncccacaaaggggacagcccccggcccgagaggccgggngccgccaagcgacaagaccccgcaangcngcagggagcccttgagnccagacgccccagccagggcgccgggggggggaggcccagcccaggggccagggagccagcggagccccccgggcccccaggcccagnccagncgacgccagaacaggnaaanggcaggggcggcgccggccccacggaggccaggcccagcagggggcagcagcggccagggcagggcagcagcgagggggcccccgcaggagggggggcaacaggcacggggcagagaggaggcaggggcacgggagccgggaggagcgcngggnnangnggggccaaangggacnccggggngngcgacggagccgcgggcgaggcacgcacccgctctgagcctcaacgatcacatctgnctccancctccaaggacaacnctgtatccagggccagcncaggggcacctcaggnagctctgtctgcncgagaggctcagtccnctcgcctntgtnccaggacatctctaccaccagggcctccngcagggatgccnctgcctggaagtncactgggntgatncactgccaagnctcctnccctncagggaactnnatggcggantgggcacagggtgngggcagcggcgggcacaggtgccgtgcggccctgtgcaggccaaggnagccaaggacgcccacgagaaggatgctcaggaagcgccccagggacgcgaaaagatgagccatgcagaaactgcacgaggnggaagcgctgggg

SEQ ID NO: 610143 - DNA, 306 bp, Homo sapiens
ccgctttctcccgcctcagctcccgagtagctgggaatacaggtgcccgcaaccatgcctggtacttttgtatttttagcagagatggggtgttagccaggatggtctcgatctcctgatctcgtgatccaccctccttggcctcccaaagtgctgggattacaggtgtgagccaccacacctggactgttcttttctcttacgtttggtcacctggtgcctctgaactccctcttccactctctctacatcctgatgcacaatttatttgaaaaggaggaaacattttccgtcccaagttgcgtg

SEQ ID NO: 610144 - DNA, 885 bp, Homo sapiens
  misc_feature (1)..(1): n is a, c, g, or t
ncgcgtggattcttcttcgcctgtgagtctcccgccgtctgtccgcctcgatttttagtaacccatgatgggtttgctccctcacccctcaggcgctagcatctgttgggggggtgcgccgcatctatttttgtcgacaaatctaataatggtgattctttcgtggctggtggaacatgaatgatgggtgttctctcctcgcctcggtgcgcgaaataatcttgtggggccgccccccacccctcgtgtggttgtgtgtgttgtttgcggacgccaccaatatggtggtggtttctcttcggtgtgcgtcgccccccacccgtggtggggggtgtttagtatggtgttcacttctgactcttcttttatgtcgtgtaggtgctgctctataaataaatttatatcgcgggctggacctcccttcgtgttttgtataaagaggagatgtgtaattatgcatgacctgtctgttcggcccggcggccgctggcgggcggttagttcacgccaccgagaaggaggggggacgaacaaactcccctctttctttctccccccctcctcgcgtagatgaggcaccccacctcacttcttcggtcgccttacttattagattacatacacaaatcgatgcattctgcgaggaggagaggagcaacactactcttttttttcccccccccaccaaattagttttctttttttcttcaaaaaaacctggccgtttggctcacaatgcttcatttccttgctgttatccccctgattcttttgttattatctcgttatttccgccttacgcattgtaaattacttccgttctgttacgatcctcgtctatcactcaactccatctatatgctcgcagcttaacatcaaacaaca

SEQ ID NO: 610145 - DNA, 255 bp, Homo sapiens
  misc_feature (63)..(63): n is a, c, g, or t
  misc_feature (118)..(118): n is a, c, g, or t
  misc_feature (127)..(127): n is a, c, g, or t
  misc_feature (135)..(136): n is a, c, g, or t
  misc_feature (155)..(156): n is a, c, g, or t
  misc_feature (214)..(214): n is a, c, g, or t
gcaagggggctcaggatgggggtcagagaagagggatgggaactgaaggcactgggacttagncaaacaaccaagactggccaaacctggtggtgccaggctcagaggccgaggctgntttttcccntttacaanncggatgaacgggagaaccnngtctcgctcagagagtgacctgtcattggctgaattcacgtgcgccctcaagggaggnggttggcatttctcgctgtcagccacctgtcaaggggggta

SEQ ID NO: 610146 - DNA, 140 bp, Homo sapiens
gagggggcctggggtaatgtgagtggtgcagagggagtcaaggatccctaagagagaggcaggtgtgtatcagctctcccacctctgctggatagaacttgcagagcctccttggtgctctggtctcattgttgcctctg

SEQ ID NO: 610147 - DNA, 1022 bp, Homo sapiens
agcagttgcaggcaagataggacgattagcttctgacatgtgtgcctcaaatctgttccaccccactcacagtggttctgttttgctccagacgtggggctagggcctatgtctttgaagttggttctttggtattgatgtgggtcagaaggagcctcatcctaatctcactcagagccttccatggatccatgggggagtgaaaccgaattctcagtagaacaacccaccagagacttttaatagtagaggccaggcttgggaatgggtagggtaagaggcgatctgttcattggagctatgaagtggagtgccagaactgtaggttataaggcagtcactttttctctctactccccatgcccagatctgcctccctcttacccctgctcccccacactgcaggaggatttgtctctaagaggtgctgacccaaagctcgccaagcattaatactcctagggctcaggacaagtggactcccctggcctggagagccacagccatgatacaagggctcttatggagccctggagtagtcagggcaaggatgctgtcatttttctgaaccataagacaaagcaggtgtatgacggagaaacaagtaatctgaatacccaagtgactacgctgtgtattccccttgtagatcccatttccatgtgactttgtagaccttggcactgaggcgtcccaaaggacacaaccagtgtgggggaaaggcggtggtaaacgaaagaccgtaccaggtgaatgcggctgggtgaccccgatttcgcccaagcggcctgacagccacggagtgcctggcgcctaccaatccatcgcacttaccagcacggctctcggaaggcccaaagacaacaagtgcgaggataacgaacactcagggccgaagaagacgcgcatcagcaaacgtggaccgaacacaacccaaatataaaaatcacacaacagccggatcaagagaacacatcgaaacacacacacacaaagaccacacacccaaatctacagctaaa

SEQ ID NO: 610148 - DNA, 661 bp, Homo sapiens
gggggagcgcctcctgctcctcccgctgttgctgccgctgccgccctgagtcactgtctgcgcagctccggcgcgctggctccccatactactcgccgatgtttggagttgcttactagaaaatggcagtagcattggactaacaaagatgagacaggtctgtaaacttgatcgaaagattgaggattgatgtagaaggaattagaagaagaggagaagtgtgtgaagaatataatgatgtcaagatggttacgtcagcataagcatgtgtcagaatgagtggctcaatagtccatcaggattggtgtagtcactttaaggaaatgactgtgatggtctcggtgagaaacatgaaacggggatgacatagaagagccggcctaaggagtagtgtaagaagacgaggggaatggctgctacaaaagaccgtgaagtgtaagatgtggcacgagatagaaagccaacattctatgacggaggttcatgatgcttgaggaggaagtgatgctgtatctctatacagcctctgattgataagcggattgaaattgattaatgaattgatgaacctagggaagaagaatgtgaatggaaaccagatgagagaagatgagattgcggaggaatggaagaaaaggccaagatgggatgagaaaaaggt

SEQ ID NO: 610149 - DNA, 115 bp, Homo sapiens
ttatacaccctataccaccctataccacaccttaaactcactccccaccttcaccattttacagtataagaaaagcactacctccatgagaattcacgtgtggggtggtatcagt

SEQ ID NO: 610150 - DNA, 138 bp, Homo sapiens
actactcgctcgtcactggccatgactagtcatactcctggaggcaacaacttattatgaatagcttacacaatagcttttatagtaaagatagctctttacggactccacttatgactccctagagcctcatgtgta

SEQ ID NO: 610151 - DNA, 272 bp, Homo sapiens
aacactcctcccaggttcagggtattctcctgcctcagcctcccaagtagctagggattacaggcattcgccaccacacctggctaatttattagtaatatttagtagagacagggtttcaccatgttaggccaggctggtcttgaactcgtaggcccaagcggtcctctggcctctgcctcccaaagtgctagggattaataggtgtgagccaccgcgcccggccacaaacagcattttctacggaggcatactgttgcagagtgcttccg

SEQ ID NO: 610152 - DNA, 236 bp, Homo sapiens
  misc_feature (209)..(209): n is a, c, g, or t
  misc_feature (223)..(223): n is a, c, g, or t
tcatttagcaaatcacgaggtcaggacttcaagacctagcggcaacatagtgaaaccctgtctctactaaaaatacagaaaattagccaggtgtggtggcgggtgcctgtaatcctagctacccgggaggctgaggtaggaaaatcccttgtaacccggagaggcggacggttgcacgtgagcctgagactcattgccagggtaacagngctgtagactccgntcatcaaaaaaaa

SEQ ID NO: 610153 - DNA, 363 bp, Homo sapiens
  misc_feature (23)..(23): n is a, c, g, or t
  misc_feature (41)..(41): n is a, c, g, or t
aagggggggcgggccgttttggncgttttcaaggggtttgngggcttccccccccccttcgccaaaaaaaaagggatgggggttccttctgcccccaaggttgggggtttgaagcctccaaaaaagtttgcctatttggggggcctggctcccgaggttggctggaagttcccggcagtgcccccccccctgggggggaagaggaaagagaaagcccagatcccctcccggaaaaaaaaaccggtcttgggggttcgggaaccggccgagaagaacgtggggaagaaaattgcccaattccccggggtcctccagacccccgggctcttggtttgggccccataaaggctgttttttccccca

SEQ ID NO: 610154 - DNA, 198 bp, Homo sapiens
agaaaatgaggcttagcaagcctgacaagacgtagagctaggccatctgatcccaactctagtgtctgcatttggagacagtggttctccaccccggctgcacactcggatcactgggggagctgaaacacgctgtccgaagtccaactctcgacctattgatcccaaaccctgtcctcaggggggattcccgcttgc

SEQ ID NO: 610155 - DNA, 641 bp, Homo sapiens
  misc_feature (418)..(418): n is a, c, g, or t
  misc_feature (435)..(435): n is a, c, g, or t
tcgggatatacaacatagcaacaggtcacccacgtgttactcaaaactgttggacggcagtgagggcttgctaatcccagaacagaggtgtaacctggctgcatatccagcctcgagaaaatgtctacagcagatctgatggagaacctcagggaggaactcacctgtttcatctgcttagactatttcagcagcccagtgaccaccgagtgtgggcacagcttttgtctggtgtgtctcctcaggagctgggaggaacataacacacctttatcttgtcctgagtgctggaggaccttggagggcccgcatttccagtcaaacgagcgtctggggaggctggccagcatcgccaggcagctccggtcccaggtgctgcagagcgaggatgagcagggcagctacgggaggatgccancatgccaaggcgctctncgatgacgagcagggtggaagcgccttcgtagcccagagccatggtgcaaacagagtgcatctctccagcgaggctgaggacggcatcaacagcagagaaactccagggaaatgctggaatcctctcagccgtgtaaggagaacacggaagctccggctggactaacccatgagaaggagagaggtgaaaatgtgccacgacagaa

SEQ ID NO: 610156 - DNA, 578 bp, Homo sapiens
  misc_feature (330)..(330): n is a, c, g, or t
actcagtagagccacgacagggtggagagaagcagggaccattgtcttcctcaggagcgtgacagctgaccccacagaccatgcttgctggtacacactggtcccagacccaggcctgtcggacatcagcagtgtgctaaaaacgtgtaagatgtggtcactactcaccgtgtgtcctatctagttgacatgggtggagtcagctaaggggtgaatgttcatatgctcccaattcacgttgaagccctaaatccccaaaggaaatggtattgggggtgggggttcttggaaagagtgattaggttaatgagggctggacgccctgatganatgggattatgtgctcttataaggaagagacacacagagaagagtgatttcttctcttccagccaatgtgagagacacaagtgagatagacacgccgtcttgcagggcccgagaagaagagcccctcacccagtgaaaatgaatactgtgtggacacctgtgagatcttccacagctctcccaaggacattgtaagaatagtaagatgtttagattaatttacaaaaaataacaaaagaataaaaaga

SEQ ID NO: 610157 - DNA, 712 bp, Homo sapiens
  misc_feature (9)..(9): n is a, c, g, or t
  misc_feature (114)..(114): n is a, c, g, or t
  misc_feature (155)..(155): n is a, c, g, or t
  misc_feature (220)..(220): n is a, c, g, or t
  misc_feature (241)..(241): n is a, c, g, or t
  misc_feature (262)..(262): n is a, c, g, or t
  misc_feature (280)..(280): n is a, c, g, or t
  misc_feature (290)..(290): n is a, c, g, or t
  misc_feature (481)..(481): n is a, c, g, or t
  misc_feature (534)..(534): n is a, c, g, or t
  misc_feature (541)..(541): n is a, c, g, or t
  misc_feature (574)..(574): n is a, c, g, or t
  misc_feature (581)..(581): n is a, c, g, or t
  misc_feature (617)..(617): n is a, c, g, or t
  misc_feature (638)..(638): n is a, c, g, or t
  misc_feature (703)..(703): n is a, c, g, or t
ctacagttnagcgtgggaagagggttatgtgtggacatgggggtggggtggtctccccacctcctctacattttgcctacacgaacacagacacatgcaggtgcctttgcaganacaaagttagggttcttcaagttacaaagggaagggcaggnacaacttttgcctcttagtcccacacaaggcagctgtttcacactttacaagctgtgagaaaaanatcaaagccctgggcactgtnactgcttgcagcctgagagtngctccctccttttctatnttagctcttnctcctccacatcacagcagcgaccacagctccagttatcacagctccaaagagaaccaggccagcaatgatgcccacgatggggatggtgggctgggaagacggctcccatcttagggtgaggggcttgggcaaaccctcatgctgcacatggcaggtgtatcttttctcctgttcagaaggcaccaccanagcggcccacttctggaaggttccatcccctgcaggcctggtctccacgagcnccgtgtnctgggtctggtcctccccatcccgctgccaggncagtttnatctccgcagggtagaagctcagggcccagcacctnagggtggcttcatggtcaganacagcgtggtgagttatatgcgttttgggggcgtccgttcgctgcagcgtcttcttcccgttctncaggtatct

SEQ ID NO: 610158 - DNA, 207 bp, Homo sapiens
ctagaggatcctataacggagctggaactgaaaaattacaaaatcacacttatgaagaaatctttgccagtgttcttggtatatgaaatgctgacgttaagaaactgggacccttttaagttgcacgctgcggggtcttattatgacgactatatgcaatgtgggccaaagggaaacagcgagggcacgagctgccggttgtatctg

SEQ ID NO: 610159 - DNA, 1356 bp, Homo sapiens
gcttcctccggtcccaggtccccggaccctcgcctcagccccggcaccctggtccccagccctcgtcgcagccccggacgcccgcacgacgcacatgctccaacggaggagcgccccgagtcggagaccgagatccatggacgtgccaggctgactgtgggagacctgacagataacgaagaacacgcatgatggacccgcccttcctgggtcggcatgtggtgcgccagcctgccgtgacctggacagactggacggcgcttatgactgaccaaagactaccaacttggatcacagcctgcagctacatcatacacgaacattcctggcgaccagacgatatctggaaaacatacacagtcgcgaacatcggtcatatcgtaaacgatgatggtactgacctgcacggttgatgcgcacccccactccgcccagcgcgcaactcagacagcactgatccacacccagctcgagcctccaccacgggcccagccccgcctccacgcccacctcccagcacacccccctcccctgacgtgcacaccacaaccaccgacacctcgcacccctcccagactgcgacgcaccaataacaaaccgaaatcagccgacacgagacgcaaacgacgcctacactccgcacagagaacgaatcttacgaataaaccacagggtcgaccccctcgatagcatctagccgtacccacctagactacgaggtaacgatcgcccctcggacactgccaacgcaccgcagcaaagcgcaaacctccatcacacttcacgtcttgacatcgacacacacacccatagcggagcatacgtatgcatcacgcatcgactaggagacagaaaaattgacgccacaatacgactaaagtgcaacaacgacacataaaagaccaacaatacagcccacacgtcaaagcactctaacagctgtctacgcacagacgccccaatcgacctgacgcacgagagatgagtcaagaagcatacttcgcggacagacgcaaagcactgccaaatccagggcaccagcaccagaccacacacacaactgcagctcgtagaagaaacacactcaatagagatagaaacaccgaagctgaaataggcagcatcgtcgaacacaagcttgtgcagccacgctagactgacctacaccctcgtacgcacatactacgacgacaccccacgtgatctgcccccatcactacccgcccacctcacacaaacacgcacaacagacaacgcgatccacgcacagacaagtatactcccgaagcactacacgggcttgagaaagaacacagcagaaaaacaaacatcacgcgacagccaacacgacacaac

SEQ ID NO: 610160 - DNA, 319 bp, Homo sapiens
  misc_feature (32)..(32): n is a, c, g, or t
  misc_feature (275)..(275): n is a, c, g, or t
  misc_feature (287)..(287): n is a, c, g, or t
ccacgtcccaacccctctcctgtgtgtctgtnaccctgtgcgctgtctctgtgtgtaccccccacctgctccccccccctttttttttttgagacggggccttgctgtgtcccccaggcgggaatacagtgccatgatcatagctcactgcagccttgaatccctgggctcaagtggtcctcctgcctcatcctcctgagtagctggggttacaggtgtgtgccgccatgcccagtctcttttttggtaggggcaccactcactgggtttagggntccccaatacantgtgacctcatcttaactaattatatcatcaa

SEQ ID NO: 610161 - DNA, 117 bp, Homo sapiens
ggttagagcggcaggctagtggtgaatgagtaggtgatggttccgataataactagtatggggataaggggtgtaggtgtgccttacgggttgcagcggggccaggtcttggtgagg

SEQ ID NO: 610162 - DNA, 194 bp, Homo sapiens
gggtcctattccctttcctattagtctcttaggtaagatgacatcatgcgacgcattccgcggtggcagtgagtgcaccctctaaatcaccaggatcaataggaacaagcatcacgcaggcagcgagtgctgctcgacatcgcttagcctagccagacccccatcgggagacagcagtgattaacctttggcaa

SEQ ID NO: 610163 - DNA, 978 bp, Homo sapiens
ggtcttgcccttcctcgtcagcgggctgatctgatctcttctgatcacctacctcctacaccgtcaattcctggaagatacttcttaacatacacccatctcttttctcactagtgatgtccttgttccacgattcaatctcgaggacaccgcctcaaaggatacctggtcgtctgttcatcctaaataggatcttccctcgaggtgagactgtagctatctagatctctatgcggatatatagaaccaccatgatgggagggtttgcatgagaccgggacaagaggacttccatttctgaggattatggtccttcgcgtgcctatgtaatcatgacgtaaataagacatcgtggttatcgaggcctgatagctttatgcgatctcattcgccatttatcaggcttcttggaatgtgcagagatctattgccattttatccccaggcccagctctactcaggggtttgtactaaaatccctattattggtagtgaatccgctcccagagttagcggccaagaagagcataatctatcggtatcccttacaattaagcgttcgaattttaacttgctgttaaatcttttctttgccaaacgaaaattgtacctttattgtgtgcctaggcccctcttttgtgacaatggttccctgtctggggtggttggccccgttgtttgaaagcttggacacttttgtggcaatagcgccccccggtgttcaaattgcgcttctcacacattggattatgtgggcgggttcaaccgaacccgcaaacggtaagtaaggttacattcggtcgcgcatttaacgttggcgggtataaacacttctacccggaagttgtaatacggaaacttctagcgctaagttttagctaccgtgtggtttggaccaacaatggttgggaatgttcgccgtctgggttgacgacacccttacaaggccctagggagctacaaatagcctactgaaca

SEQ ID NO: 610164 - DNA, 822 bp, Homo sapiens
gcaggcgcggacttcggagcgagggcaggtgcgcgggccggaagcctcgggcgctcacctggcacctacctggagctcacctggcgcccgggccccggctgcgcccctgccagccgtcggcccgaacctctcggtccttgaggcccagagtgagcacttctccatcagggtcagcgcgtttccattgcgcgatacgcccattgatcagtcagtctgtcctgcctcagttgctggcaggctactgatgcgcttgtcccatcagacttgcatagccaggcaagccgactagacacggaccaggcgcagaatcacttgttcggagggagcagatatgaagaggaagggccctcgagatagcggccagaatgaatcacaaggcacgagaggaatagacgagcatgaggctcaagaagcacgggatcacttgggtttccacagacgctgaatcgtagcccagaagcccgggggacggcagaaggggtcccgccaagcgaaccagagagccagggagtcaacacgtcccgtacatccccacggcaggcagagcacctcccgacagtcccggggactaaacatgatggattaagaagtcgcgtgaaccacccgtgcgagacgagaccgtcgcagaatacgcaagcacgacaagagggccagaggtgtgctaggatccatcgagggagagcacacgagatcaggcggccgcacatgcctaggagacttcgtgcgcacgacggtgatccggcggcgggacaagcgaaaaggcaccgcgccgttccacatgacgtagtaggaccagaaaggaagaccaccagaaaaagcgcc

SEQ ID NO: 610165 - DNA, 308 bp, Homo sapiens
ctgctttaccctctccttttgcatggatacgctgcactgatctcctatataattagcctcagactccagagtctagccatcactccacatcatgccctctggatgctgctactgagttcatttactgcacatggtatcttaatcatactctccacagttcaaactatatcttcactgcccgtcacttccagcataaatccatgtcctctgtgaacacttttttgacaatttccatgccagatccaaatgacacttcccttccttgtgctgtcatggccctccacacagacttctgcccatagacccca

SEQ ID NO: 610166 - DNA, 465 bp, Homo sapiens
cttagtgatgttacctagacatgttaagatccctcttgttaggaattccatgaagcctgaaaatgaagccagcgtagtggagaatgaagagacagagttttgattacaaggtttgaaccgtttaactgagatccgcctctgcaggctatccatggacttttaaattatgtaagccaataattttttttattcgttttggccattttaagttggattgtctgtcttatgcaaatgaaatgatcatgttagagatggtagactcagctcactttcttaaataaattattatagaatccatgatcagtgaatttcttaaaatgttgctggctataaagatggctgtgactaataaggccaatatgcaatcaacatgtataggagaccataaaacctgtgcactggtttgattgaactatttgaatcatagtaatattacatcttttgagaattctaagaaaaacaaag

SEQ ID NO: 610167 - DNA, 815 bp, Homo sapiens
  misc_feature (385)..(385): n is a, c, g, or t
tagctgccccaagggcgtttcctacttttattaaggggcccgccccgcaaattcaataataaaaacacaaaaagctcccatcagtttaataacaataaaaacaccccaaaagtggaaaattgaggggggcagggagaagaagacccctgtgtggccaggggcacagaggagccctgttgcctcatgtggcaccaggcctgtggccgcagggttcccccggtatttgctggtgtgcatacagagtgttttgggggcgcagcagatttgttccgtggtgggagccaccgttcctcctgtgggctcggggaccctctcaactttcttctcgtgagggggtggtgccttcagcttttttgcatgtgccaccggattcctttgttcacangcaggggccacaaaatgtgacagggccctcgtgtgtgggtttgtggtaccacgtctcaaccacaggcgagcctccttttgaccccccgtggacaagccgcggggcattcggttccacctcctccagtgtccagggagcttctctccgagcgttcaatctttccagagttctggggaactctccttctttcctgtggcaggtcgttaaaaggcgcgttgaagcgtgcctccaggactccacgtccctttaggtggaggcgcttccgtagctccttaggggacatacttgacggtgaccttcccgttggggcctccaggggccctattgtccgcccgccgggacctctcgtgcggcccgggggcccttaagtaacgctgtcctggccgatgccgccgggccgggcgaagcggcccgagcgcttttggtcgcg

SEQ ID NO: 610168 - DNA, 1108 bp, Homo sapiens
  misc_feature (1108)..(1108): n is a, c, g, or t
agcggacgtaacctctgggttctcttgtatcgacagatgtggtttgctcttccagtgtagtccccgtggctactagctcatcgtttggcaggaaggcagaggtttcctgccggttacagggtgatgtcctaagctcagcctgctgtcacaagaggatacactgtcgcggtgtcctggtgccgtgatccaagacgtccatgtttgcttctaactgctccccctgcccagtccggtgttgtccgaagtgccctcggtgccaagtcaatcgggaagtgagccaagaacggcgaattgaaggctggtatccatgatcagtccgagtgatccatggactagtcaggccatgctaggcgcctggtgcgctggagcactcgcctatgggaaacgattcattccctgagggtgaggcgtcaacggcgtgattacccgtacattcgaccatttgtcatctgacgccgagtgcgtgctcgagtcgttttacccttccctcatggcttgacgttaccctctgacgagtggaaagcgaatgtggacaaacttccgcgtagaacacacagccagccggacgctaggacaggctagttacgacaatctcacacacagtgtcttacgcttgtaagtccgttcagaactgaagtcctgagttagataagcctcttgcttcgactttgccggcctaatcgagcattgggaaccccttcgcgtaccgttataggatctgggtaaccctttacacgccatttcagactacggacttctcccccacgtcgctcggcgagtaagagacttggcagctcctaggatacaaagccgagacgacacgcgcctccgttgctggaacgtggatcccataagtgcagtgggcagaaacagtctgggcggtgcactgcttatacctcggttctgccacacacacccggagtgtgtgcgcagttccacaacgcgtcattcgcgagtagcggtaaggagctcacgaacaaccaaaccagacggggacccattggttctctagaggagcaccgagctttcgttttccttccggtggaaccatatcatggagagggaaggggcacacttggattccgcttccggacgaggagttccccgn

SEQ ID NO: 610169 - DNA, 117 bp, Homo sapiens
acggtgaggtacagttcataaagtccaatgggcagatgcctcatcgagtgatcaggccccataactgatgtcatcgtcaacgaattaggcacatggttggccgggcgcgggtggctc

SEQ ID NO: 610170 - DNA, 1442 bp, Homo sapiens
  misc_feature (615)..(615): n is a, c, g, or t
cttgtaacatattgttttctctgacacagagacggggaaatattctttttcacagaagtattttgctattcttgatggctgtacaaatgtggggggcgaactaactagtaacggattctccttaaagggggctgtcttacaaccaacgcgtcgttgtttaatctgcaccagttaaggggagatattgagaaccccaagcggttgaagaaaatataaaattttgaggcgggtaccctctgtgtattttaggccccccggaggattttctgtaatatggtgaataagcaccaacgactttttcgcccgcaccgggtggtaattggcttggtctaagaaaaatgtcttttggggctccctttgacaccaaaaagatttctttggggcccacacaggggggaccacaatttcttggggacgctcgtgtggggtgggaacccagtggggtttaaggaagaccaaatggcgtggaaaccaaaaacggtggggtggaaacaagcacacaggagggaaccactaggccacgaatgggggaaacctcgcctggggagagaaacacaagggcccaaatcccaattgagccactcggggggaataaggccgccacatggcttcttntttccaaagtcccacttgagcgcacacaccttgggaggagaaaatgggttgttctataagatgtgtgcaaacccccgttttagccacaccccacttcacgcccaaaatccggtgatacatttttcacgggttcttataaaaaaaagattcacgcgcacatggtgtttacagacttttgtgtgtttttttatactatatcctccacgggcacatcccacatgtgccacacatcacacgaaaatcgtaatggggggtgcttctggcacatacacactgtggtttcacgagcgcctcgtggttaataacacataataagagatcacactcacagggagagccttctggagaaaaattaataagagatttgttcacagccctatatcttcacaaacacttgagaatcacaaaaatttcttgtgggtggtgggcaccacaataaatctgtgtgaatattttctcttgtgttataaactttcgccctcgataggccacactcggtgttccgatagccacactcgggcttggggggcgctcgctcttgagaatagctttgtgtcttgcacagagagtgtcaccacgcacggccactgagataacctctaatgagccgtggcacaaatgaggctctgcttctaaaaattgttgaacacattcacatgttcttctgaggttacacaaaagtgctaaattcacctacacacatgtaaattgtgtaaagtaaaacacttgggcccttaactaacttctttatagtaatagaagttaaattacctaagcttatataataacatggggaggattaaataaaggaataaagatgaatggga

SEQ ID NO: 610171 - DNA, 146 bp, Homo sapiens
cccgcagggagctgctctcaacagtgtcacctactgacatctccactatccatcacccatgcatcacaagggacaactaagctggtatctcagtcaagagtgccacgctgcagactaaacatgacacaggaaaatgttcagagaga

SEQ ID NO: 610172 - DNA, 1047 bp, Homo sapiens
atataaatacctgagccatgtgtcactcgtcactctctaatgaataatgaatgtattctctcacgtctctaagttatcctacgattcctcatatggaataatcttattgcagatccccacttcatactctaattaatctcagaaggcagatctccctctcagtgtatattgcgcttgttgccctatactagcttttcccgctgctttgcttaaacagacagcgtgcgttcactagtctccatatctgtttcgtcgaatgcatacccatgcatttgtagcgtctgatagctgtttaacataacctaagacctctcttccatttcgtaatctcttttcatcccgtgtatgttatcagtaactccctgtacttattgtctaaatgccttataaatctgatatctattcaaagcaaacacgactagaacgccaattaattactggttcattctgcatctaatgtcatgatttgaacacgatgactccaaaaaagaacacatattaagtcaggctaccctcgatacacttggcattgcagctgccttaccagatccactctgcacatcaatgttacagaccatcttgcctgactctttcacatgcgcgtccaagaggccctctactcttatgcgagggtttcccctattatgcaatatagaaacctgcctactcatgtattgctcactctctatatgtcacctgtgcccttatgttgtgcgtgtattctgtgcttttctgtgggacattcccttcacgacacaaatagcaccatggatcccacttctgtgtgtgtgactaccccttcctgagttggtttgtcggctatcgtgggtaccccaataccgctctccctaacaactcatacattgcgccccagtcggtgggaatagaattacccatttcagaatatgggcgtggccaccaaatacacacagccggccttagcccacccggccacaccacacctttcacggccccggggcactaacacgcgctaccgcggacactcttcgccgacccacgtcatccacacaaacggcaatgctaccc

SEQ ID NO: 610173 - DNA, 880 bp, Homo sapiens
  misc_feature (821)..(821): n is a, c, g, or t
gaggtagtggtgtttgcgtgggtagggcgcagatctatacagcgatgtcgattcttggtttcctggtggacttgcggtccactattacttggtgtcaccctaaggctgctagaatgcgcgtcgtgccgagcgagggtcccactaatatactacgcggggctgatgtcggcttgcctccatgagccgcgtgcgggctgtgactgttgagccaggtttctcttgtgaaaagacctgttggcgggctaacttgtgaagtcagctaccgacgctgcgtggcttctagtttcgttcaagacgcgcccctcgcacaatagaacaaatatgctctttcattccgcttggacattgttgagcttacctcccggtatgaagggggttagatcaataagaaagaggatacccatacatgtcctaagcagaagcaaagtcaagcatgctatcatctacgatcaacctcgctttagcgtgctttgcaacactcatgtccatcagtagacaccatacgtccagataaggtccgctagtccctcaataacgacgtccctcgtgccagccttatgtgtccgcgcagaccagcccaaatgacatgcttcaagttgccgcgcacagcgagggccatgcatcatgcgccgtacgattgccttgagtctcatgccatagagcgaagctgaaccccgtaggaaggatgcgatttcggcacgctaaggcctcgagtaatctcttctacatcctctttcgtgactatcaagaggtcctaacgtcccccgagcgtacctcaggtacacccgatagaacgtcgcgtaccctatcgtacgtagccntcatgcgtcgctcagtacaaacccactggtaacaggtcgtgggatgagccacgtgattg

SEQ ID NO: 610174 - DNA, 310 bp, Homo sapiens
  misc_feature (176)..(176): n is a, c, g, or t
  misc_feature (253)..(253): n is a, c, g, or t
catccacgcatagctgggcatggagtggtgtcatggagtggcaggagcccattgcctgagcccaacactctggtccaagagggtggctgccattcctcaccgttctacgttaaccatggtggagatccttactgaccgagtcagtggcctaggtatgctgttcattcagctcatcnccgtcatcagctgctgcacctaccctcagttgccgctgtttccggaactcgcgcctggtctcagttccatttcaccnaaggaccgtgtagacacttgaatcagcctgtgcctgcatctatggacaatcgtgctt

SEQ ID NO: 610175 - DNA, 238 bp, Homo sapiens
gcaatcacctttccaagtcgtaatctaaagcaacagcccatggtatattgtaggtggtgtttacttaccaataataggtaacggtgttgccaactaatacatgagggatgatcaatcagaccaattgagcatatacattaaataaatggctacattaacggtaagtaaacgaatcactatatttagtaaaacaaaaaatgaaaatgagacaccagcctttctcttccagtgtcataat

SEQ ID NO: 610176 - DNA, 110 bp, Homo sapiens
ttaagtggggaaagcctgggcatacctcaaaaacctacgcattgagcagggttccatggagcatgatgaagccgttgccgacctgcaaaactggtgggcaggggacgcag

SEQ ID NO: 610177 - DNA, 202 bp, Homo sapiens
agcttttttgcccatctgtagggtatgtgaagatttcaaaacctgaaagccctttttctttgtttaaaattatgaaaaaggccctaaatgactttaggatttgcatttttccctttattgccccatttcttgtgaccccctgttggggagggaaatctgtttattttttcccacaaataaaaagctaagattttatttccca

SEQ ID NO: 610178 - DNA, 398 bp, Homo sapiens
tcgatgaacctgagtcagcttggtgacacgcgtacaatcagcaatcaaaaaacgaagcaatttgctgaagaatgtctcatttacccaggcagggctgcatatctgagcagcaactgcactacctccatcaataatgaatacacctccagcctggcagatgggcaatgcgggcgctcctgtctttgtccctcaatctttctgggcccttgcctcagccttcaccagcactcttacacggggagaagtgacgctcactacggcagcaaaacgagcccaggagacagcccgagccttcctgtttagctgacagatggctggcttctcagatcggtttaaattaaaaaaaaaaggaaaagaaagaaacaacggggaagatgctgcccttcgatgaccatagt

SEQ ID NO: 610179 - DNA, 197 bp, Homo sapiens
ctgggaggctgcaggcagccttcatttgtggcttaaggtctgagagcccgctggtgtatgttcaagcagtccaaaagctgaatacttggagtctgactgttcgagggcaggtagcatccagtaatggagaaagatggaggccagaacacttagccagtctagcccttccatgttcctctgcttgctttgatcctatc

SEQ ID NO: 610180 - DNA, 570 bp, Homo sapiens
ataataatgctgagtaaaagccacaccaataaaaaattggtttttaaagacggagtctcactccgttacccaggctggaatgcagtggcgtaatctcagctcactcactgcaacctccacctcccaggttcaagcgactctcctgcctcagcttcctgagtagctgtgaccacaggcacacaacaccatgcatggctaatttttggtatttttagtacagatggggtttcaacatgttggccaggctggtctcgaactcctgacctcaggtgaactgcctgccttggcctcccaaagtgctggaattacaggcgtgtgttaccatgctctgccaaaaaaaacattttttttttttggagacggtgtctggtcctggttcgcccaggctggatgtgcatgggtcaatctcagctcatggcaacctccgccgggaaagtctctttttatcttggcccttaagctacagataaggcacccacggggcaagaaccttacggggtttggaagagaaattcccagttccctatccaggctacaggcagggcccattgctatggcctggagccccct

SEQ ID NO: 610181 - DNA, 900 bp, Homo sapiens
ctttgtcgccatccaatgggcatagtgtgggtgcttggaacccgggatgactgagggggacacatggagtgggtgcttgtgtctgctgtctcagaggccttggtcaggatgaagtcggctgacacagcttagctctggtttgcttattcaaaagagaaaataactctcacatggaaatgaaactagctgaagccttactcttgtattagcaactgaaaatagtacatatggtcactttagtgcttgaggaggcccattttctgcctggcagggggcaggtctgtgcccatcccgctgactcctgctgtgtcctgaggtgcattatcctgtcgtacacaccagggccaggctcattctccctcccttatccaccagtgccaagcctcgtctggaacaaggaacaccagggagtcccggaaggaacccaatatgtgctctcgctctggaacaaggcaggacctggacactggcgacgcgtgggggtgagccaccttcacaagaactcggcccctctaacccacaggactggcaaacactgactcgccatatgaccaagagagacgggcacgagacaccggctaactgtcaccttcccctgtggaacatcgccgagaaatctaccaacttgacatgcgagctcaggagaagcggaggagcatctgaaactcacctggccatccagatgcccaccaaggaaggatcatgcgccaggcggaacaagacccaacaacaaccacatacaagcctaacatagagagggagaacgaagcaagcgcacgagcgcagctcccagcacagaatctccccaagcagagcgactgacggagacggacgaacccccaaaaaggcaaggagacaacaccagaacacaggacacacaagcacaggcagcgaaaaaca

SEQ ID NO: 610182 - DNA, 125 bp, Homo sapiens
ttccgaggattcccatgctgaagaatgttgttggagactttcagaacttctgcacaaagcaatgaatccaaactctccatcaagttcttcatgcacagctccgcctgtcaaagcccatcagcacg

SEQ ID NO: 610183 - DNA, 152 bp, Homo sapiens
  misc_feature (97)..(97): n is a, c, g, or t
ctttattgtgccgtgcggtacatcacgtttactgatttttgcgtgttgacccatccttgcatccagggatacatcccaggtaattttggtgtacagnccttttaatatgctgttgaattctgttttctatacatcgctgaggggttttgttt

SEQ ID NO: 610184 - DNA, 463 bp, Homo sapiens
caatggttctagatcggggacgagcaataatagggatgtaaattagataggaaatagtgtagacagcatgacatagactaatccaggacagctaacaaggagcagcatagcaatttaaatcgcgggtaccctgacttcaaagcctatacccctacaacggggccataggtaagaggatgaagaacatatgccagacagtactggattcaaatagtgtttcctgttaaaagttgagagggttgtggtaagttttcaaacctctctgggccccatttaattatctgcatgaaatagtatctatcaaaaagtgcctccaagacttaaaaaaaatatgcaatgtgcctttactggtgggcaagatagaactgttatctcctgctcactcctggccactttctctgcacttgctttgataggctactcgaagtcacagacctatgtatattattagagtgtgagagaa

SEQ ID NO: 610185 - DNA, 157 bp, Homo sapiens
agttcacaaaggtagaaatgtataatctgttcaatgcccagacctctggcatagaggagccttctgagacaaagggttgtcgcaaaaaagcaaattcaaatataagtggcttcctgaatgatgaggaccagaataaaggtttttgatcaacctcaaa

SEQ ID NO: 610186 - DNA, 498 bp, Homo sapiens
  misc_feature (296)..(296): n is a, c, g, or t
  misc_feature (383)..(383): n is a, c, g, or t
  misc_feature (391)..(391): n is a, c, g, or t
  misc_feature (398)..(398): n is a, c, g, or t
  misc_feature (419)..(419): n is a, c, g, or t
  misc_feature (435)..(435): n is a, c, g, or t
  misc_feature (446)..(446): n is a, c, g, or t
  misc_feature (462)..(462): n is a, c, g, or t
  misc_feature (484)..(484): n is a, c, g, or t
  misc_feature (491)..(491): n is a, c, g, or t
cttgcagggtattcggagtacatggatccggtcatcgggtcgggtgcagctgatgaaggccctcctggcgggccccttcgccgcggcgcgtcgctggaggaacccgattccctttcccgagacgtttgacggagtataccgaccgactcccggagttcatcgtgcagtacgtgctccttactatgttcgtggacgagtacacgttctccaacgacgccctgaagacctacgctaccactgccatcgccatccaccgcatctcaccaacagactgtggctcctagtgatgtggactnacctcggaggtatccgagctggacacagcccctgggacagtgatccagacagttggccgttccccaagggagccttgttcaactttnagcgaganccatttncttccccatttcccagagaanttttgtgttttcttgncaaataggttnccaggggtttaaagtntttcttggggaaaccaattggnatttttnatttttt

SEQ ID NO: 610187 - DNA, 1089 bp, Homo sapiens
ggacatcaaatattagccatttcccattttattttatttttctatgctaggttcatgttccatgcttcatttatttaagaaatacatttttattggtaagcttatagagctacacttatggaacttttctaagtacggtaacataaatggttaacgacaaaatagtgcttatagccgtctcattctctgcaataggccactcttatgactcataaaattcacccttactgctttattataactctcagaagtacatcttatagttctgaacctatagtatctttctaccctgttcccgaagctaacagactggctgacttctatctagaaaatgattcctctatccccatgacctcacaaacactgctgcagcgaacaacatcattcacagtggccatgccaagtccctatgaaggcacagggctgcctatcaaacctacctttctttgcagcccacactgcagactaacacttctctccttttcaacaattgctgtcactcttccctactaactccctattactcactaactcctttccccttctcgcccagctatcaaccaccatccactccttcgactactgctgacgcaaccactctcatcacttctaccactccacgacgtatacccttatcagctacctcccacactcgcacctctgcaacatcatactcattctcccaccaagccccttcgcctccttttcaactcacccttcataactctcctcttaccaacacaccctctgccatgtcccctccaacatcaacgcactttccggccacactacattgacctcaccccttaccccacgcacacgactccacccacacacacccgccaccccgccccaaccaccacacccacacacaaccccaacagacgaactccctcagcaagctaccatagacaaacgctaacaacaccccaccaccccaaacacaaagaacccaggaatccaaccggcaaacaaggcacatcccgacacacccccacaacaccgacacacggacaaccacccatgacacacgaatcccccaccagcattgcacaccacaccccgaccagcagccacacaacacttccg

SEQ ID NO: 610188 - DNA, 200 bp, Homo sapiens
  misc_feature (45)..(45): n is a, c, g, or t
tgcaagagactcaggtggacagaatgtttagggttgactttgggnaactacgagctactgcaagtgcaggcaatgaaggcttggtggtatagatttcagtagctcctcagataaaaagagtgataaaacgggaacaagaccagaggatagtaaagctctgaaggatgaaaatctacctcctgtcatctgcaaggaacggg

SEQ ID NO: 610189 - DNA, 123 bp, Homo sapiens
gtcacatgacatctgccagacctctgctggacaagctcgtctccctgtgctgcccggggcctccaggcgaggcctgggcctcacacacaggatctctccgagcagcaattccccattcctgtg

SEQ ID NO: 610190 - DNA, 1147 bp, Homo sapiens
  misc_feature (419)..(419): n is a, c, g, or t
  misc_feature (1147)..(1147): n is a, c, g, or t
tgcagatcatcaggccgcctcttccatctgtcatggggggccaggccccgggggtgccggagccagagctgtcccccatcactgaggtgatctgaatgtgccaggtcagtggcccactgttcctgtcccaccgatgctccctaattccaccctccgtgaccctagtcctgatgtagcccatgcgatgagcatgccgtagatgcttattggtagagtgctgctcttggtgcatgcaggacagtgcagtggcttcccgcgcgcgatggccctgcgaagcgcggcctctaagcacatcgtggtgcttccatcgcgtggtactgcctgtgcggcttgtagccagagtgtgcaagtctggtaccgttggctgtcaggccagagccgtgtcgtagaggcgaagagtgcatagcgagcgccgtagntccgagaccccatggagggacgaggccattacagtgtcgcttgcaaacaaagcgcccaatgtctgcagggcgggctcgagagctttaacttcttatgtacggtggggaagttttcccacggtgccattcaaacgccgcccgagtgtagtacttcgaacactaggtcccacaacgtttcccactccctgatagaaggtcgctacccagggcctttggcgtaggccaattgcctcgttgtgcgccaccgatgacaggccggtgaccgttcagataggccaataccggcaagaagactacgcttcacttctttagccgaatgaggcaggcctcgcgattgtcggagtgcatacgagagttcgaggcgtaggctagattttcgtatccgttgccaaccaccgattggccatttcgtgacagaagcggaagccggtcacgagccaagtcctaatactgtagaacaagttttcccgatattccacttctattcaattcctaggtagccaacgcggggcgttaacaattggcgcgttagaacgcattgggtagcgcccacaccgttgttaaggcccttaagatctagggtgaaaccacgcctacagcaagggcaattccgaaagggtgaataagggtgggtgccataggtaaatagcacaatcatattggagagagatgggcgaacccgctatgtatataaccacagcttaccgttcctctggtcgccggtaacn

SEQ ID NO: 610191 - DNA, 378 bp, Homo sapiens
catataaacccatcaagaatggggcacagtgtctcagttggggaagatgagaaagttcgggagatgaaggggtggggatggtggcaaaaaaaaatagtaaatgtacttaatgtagctgacctgtacacttaaaaagggctaaaatgttaaattttatataatgtgtatttaacaacaataaaaaaacaaaacaaggggctgagcatgggggttcatgcctgtaatcccagcatttggggaggccaaggggggcagatcactttcagctcaagaccagccggggcaacagggtgaaaccccatctgtataaacatacaaaaattagccaggcttggtggtgggtgcctgtagttccagctactcaggaggctgaggggg

SEQ ID NO: 610192 - DNA, 276 bp, Homo sapiens
gcgaccaagcgttcgggccaaaaaccgtcaagtggatggtggcggccggagcccaagggaaccaaatggccggggccggagccgccaaaccagattttccccttacccaatccctgccgttgaacccgatttcctaaaaagtgtgctgcaacagcgtttgattgcattaggaggggttatcgcagctcgaatttcagtttaaacgaacccctttcctttggccctcacttagcttgtgaacaggcctttttaaaatccttttttggggtagcagca

SEQ ID NO: 610193 - DNA, 160 bp, Homo sapiens
gcggtgtctcaggatcccaaacaccgcatctcagatgaacttgttacctgagtatataggacactagaccaatcatatttaacaaggactgtgacatgtaaaacttaattttgccgtgtaaggacttttgaaaagacgactactaatcttccccttacca

SEQ ID NO: 610194 - DNA, 150 bp, Homo sapiens
  misc_feature (46)..(46): n is a, c, g, or t
  misc_feature (53)..(53): n is a, c, g, or t
  misc_feature (135)..(135): n is a, c, g, or t
cagaggtgggagatgactggtgtatcatgaactgggagcctcctgnctctgtnacagtcggtgccactggagaggcacatgcaagcatcaaggttaaagttgtggacttccctgatcctccagtggcaccgactntgacagaggtgggtg

SEQ ID NO: 610195 - DNA, 375 bp, Homo sapiens
caccttgtagtaaaaccgaaaatccttcatctgcaccagctggaagatgggatactccggatggcacacgtctcgatcatgtccttctggtgtttgtactgtatcagacactccatcaggtccccagagtctatctagttatctgccacatcgtgacagaagttctgaattatgggctcacaggctctcattagcaaggcttctattataatatcctctgattctaactcagtgaggttgccaactatatctctacgctccaccaccgagtcatccagactgtcctgaaggcactccagctcctgtccagtctctgtgttctcactgcaccattttcccagatcaatcaggcacttatcctggagggcaggatcc

SEQ ID NO: 610196 - DNA, 920 bp, Homo sapiens
  misc_feature (84)..(84): n is a, c, g, or t
  misc_feature (528)..(528): n is a, c, g, or t
ggcgagacagcacccgtcctcctcctgacaaggggcgctccccgcgacccccgtgggtgccacgcacacacacaacactcgggnggaacacacctgctgggcacaaccaagacactgtgtgggacgacacctcgcgcctcagtgtgcccacctaggccgcacacaggaccgccgctcgccccctcgtagacagaagtgtcagttgacaaatcactggcgcccaccacaattggggggtggtgacacccggtcgcgagagtgcgtccctccacggtacgactgccaccagccgtgggtaacaaacaccactgctcgccgcagcggagagacaccccccgcggtcatacaaattcgcacgcgcgcggatggggccaccctcctctcatacagacaccatcagtgtgccgatacttgctccacacaaacgaagtggtcaactggagcggcccaccacgcttcacccccaggaggtgtggacatagagagggaacccaccctcgcctccaaggggggacatacactgcgcgngggcctccctctcccgtgaataagaacacacaaccaggctgcggtcgcctagggggcgagagcacacctccgacgcactgcgagctcaaccacggcgacgtcttcggagggccacccccctcgagtgctgcacccacgccagaggagatcagctacctgtgatatctcacattggcgcgacaccacaccgatgcgttcagcgcctccatggggccaaacaaccccacgcctgtaaggcccacccgcgagtttctcactctaggtggtctcaccccgtcttacgtacacgctgcggattatgaggaggactcctcctcctagcccctcctgttcgatcccgacgccccaccgacggacgcacgatctgagctgggtcctcccaccaacccgga

SEQ ID NO: 610197 - DNA, 791 bp, Homo sapiens
gagcgtgttgtggcccgggatgcctggcgatgctgctcccgtgttgaactctgccttgctgctgtgcgtgcatgcgacctgtgatgtggccagtgcccatgcacgccggagcgtggcctgcgtgtgggtgatgtggtgcgtggatgtgcgctgctgcgtggagggtcctgccctgtgccatgtggcccctggtgctgctcgcagagtgcctgtgtcctgctgctcccatgccctgctcctggagcccatgcccggcgggctgtgccagtgcttgctgtgcagaaatgtgtgggtgccctggctctgcatatgcccctgggctgctgacatgacttctttgccactcggtgtcaaaagtcggacggactcctgccttctgggcaatgccggctggggggacgggctctgtgtgccatgcccccgagctgccgacaggtgggcactggcaggcactggcattggtggcgctggactgagggacgtgggggccaagcccaagatgttgtctcccgttctgcgttcctgcgcgctttcagccgttgggaggggcgcgtcagttggacacggagtcagctagtgtaatgctcagtggttgccagatgtgtacgatgctgcccattgggcggccccgttccgtagtgggccggttgcaaggtgccgggcagaggttgggcttctgtggcggctaaggccaacttaggaggctgttctcccagccagagggagattcagcagttgcggggaggcccaccagtggaacgtggcggcccgcttcgttttcgcggcggagt

SEQ ID NO: 610198 - DNA, 191 bp, Homo sapiens
ttcagaggcacaaggagggtcgggctggtagcgagggcgcctcttctcgcggacgggtcagccagcagtctcaccaggagctgcttagcccaggttatgccaaggcgtgaggaaacaggttcgtcccagaacctgagaaacaggaacgcaggcagctggcgctcaggcttggtggcccgccaatttcgagc

SEQ ID NO: 610199 - DNA, 151 bp, Homo sapiens
acagctgggttcatgcgccctctgtgactcagaggcacgaactggaatctgggcaaacccgagacttaacagtcaatagcctaggagggtcgcagcgtcctcaggtctgcaccccatgaccaacatcagtgggacgggcgcactctgggag

SEQ ID NO: 610200 - DNA, 287 bp, Homo sapiens
ataacctctgcgattgcaacctccgcagaccatcttgtcaagcatctcctgcttctgggacctgccagcaccgttattgaggctagctccttattgtcaaccaaccatgacctcccagagacggcacaatcatttcatcgacgtagatgcatccgacgacagcctgatcacttcgtccctgcacgccttctacacctacctgtctatgagattctatatgcaccgacatgatctgactctataaggcgtgagccagttcttacacgttgaccgagagccgcgtggct

SEQ ID NO: 610201 - DNA, 614 bp, Homo sapiens
gtggcacagcctacactgccgcagcctgcacaaggacgatggggcagccctgcggggcctgacgcgaagacggcgagggaaggcctagctcttcgctgctactcttctccgtgcttgtctgcaggagcgcaggccacgagcccgtctgcgagccgggccgccgagccatgggcccgtcttccgcacgccagcaaggaatcgcaagcgcattgagtgcagaggcagtcgtctatgcgagcccctgcctcccggctggacatggagccttggctcccctcttcgttccttgccgctggctgccggaggagaccccactaacccagcctgcctgggctgctgaccactaagcactgctaggcaataggacagccagcagcaggaccgcactgcctagctcttaggccactgtgctcccatttgctgtgccctggaccatgggagtagctgagggggcagacaagggagtagggctggcaggggagggggcagacagaactcgcctcgcacccttcatgcctggctgccggtccataccttggagggacctaagctgggggtgggggacatgagtccgccagctgcaccgtgcaacatcccagtgggctctgaccacc

SEQ ID NO: 610202 - DNA, 518 bp, Homo sapiens
  misc_feature (14)..(14): n is a, c, g, or t
tttcggcccgggcntatctttttacatttggcttgtctagactcatcctccatcccctcatgcactggtgtggtgcagaccagaatatcacccacctagactgcagaatggatttgggtggcatcttggctttctgcacaagacttgcctgttccccaccacatccccctggttctcagggtccaggattccaggaggcagggatgttggcaggcagggtaggtggcccacccagttcactcccacgctgggacctgcagagctggctgtccgagacaggttgtttggaccaacatctgggtttctggatttccatttgagcacagctggactacacaggctgaagctctctctgccgagatatagatatttccctggtgatgatctttcaagctgacatgaagacatggccacccactggaacgtcgtgtgtctgccgtggcgctcttgtaatttgtgagggaggctcctgacgaatgcagtgcgtaagtgggaaatggtgggaagttctcgcatcc

SEQ ID NO: 610203 - DNA, 159 bp, Homo sapiens
  misc_feature (10)..(10): n is a, c, g, or t
  misc_feature (28)..(28): n is a, c, g, or t
  misc_feature (55)..(55): n is a, c, g, or t
  misc_feature (110)..(110): n is a, c, g, or t
cgcgctcgangaggggacgccaggaggnagcgatctccgggctggtgcaggcttnctgggggatgtcggctgatgcgagctggagagcgcgtgtggcggccgcggccagntgttttgtgtcgccatcgtcttcaatgcttctctgaacagcctttatga

SEQ ID NO: 610204 - DNA, 192 bp, Homo sapiens
ccctcaaggcaatataccgtccaggagaaaatctgaactctcctgacacgacagcctctaacccacatgtcacagtactcttggttaatcaatgggaagtgccagcaataccacacaagagctctttatccccaacatacactgtgaataatagcggatcatatatgtgccaagcccataactcagccactg

SEQ ID NO: 610205 - DNA, 81 bp, Homo sapiens
ctcttggggaaccttattccctataaaaaaatcaagctgggggatactgctgccccgtacctcgtaccgggcgctaaactc

SEQ ID NO: 610206 - DNA, 220 bp, Homo sapiens
  misc_feature (71)..(71): n is a, c, g, or t
  misc_feature (83)..(83): n is a, c, g, or t
  misc_feature (164)..(164): n is a, c, g, or t
  misc_feature (216)..(216): n is a, c, g, or t
gcgggatcttgggggcctcggcgctgaccagggggactgggcgaccctccgttctgttgctgccggtgagngggagagcgcgnggccgacacgcgccccactgtcagaccacggaatgatgtggccccaagcagctctcagcttttggagagtatgtggctganatcttgcccaagtatgtccaacaagttcaggtgtcctgcttcaatgagttanaggt

SEQ ID NO: 610207 - DNA, 568 bp, Homo sapiens
tcaccccccatccctgcttactttgacctcagccggcgccggacccggtatggggccagtctgggcaaccggaaagaagggcccgcgtcccctccttcagaggagcgctttgggttggggcctgctcccccatcccccccagcccccccagcactctccttgctgctgttgagttcagctgttgtacccggacctcagttgtggaggctccatccccgcatacaggcctggggcttggcacggggccccactgggctgggccctggcgttttgagcactcgctggcaccacccgtgggcccctggacccggccgcggcaagctggtggactgtaggggctcctcactgggcacccggagcttcccgcttttgtccccggcccgcacggatgggctgtctgtgtatatatgcttggggcgagggggcaggcccccacttgtcagaccacaacggggtctgagggcacccggctgtgttcccacctgagggagggctcgggcgggggccgggcttggaacgatgtacgataccctcatagtgaccctttaacctgatcctcccccgcgga

SEQ ID NO: 610208 - DNA, 251 bp, Homo sapiens
ctcagcacatttagtcacagtgagctttgggctaactatatacattctgggtggataaatggtccatcggttttggaagtgtaaccttactatttggtttacagaatagtctatggggtggattcaggatgtaacaaatatattcagtaccattcctggtgtggtatggtgtggtgcggggttaggttttaacatacggtagtggtatggcggtatatgtgtggggtaggatttcaactaaatggtgctga

SEQ ID NO: 610209 - DNA, 203 bp, Homo sapiens
ctaaaatatttccaaattgcatataaatgacaaagcctacaaatcttgacaaacccccaagacacacacatataccctaaagcttatctaattacagacaaccagggataaagagaaacaatcaaaagcaaccgcagaatacatacatgctgactatcatgtatcagtcaagcgatagaaccctttaacacgaagaatgatac

SEQ ID NO: 610210 - DNA, 208 bp, Homo sapiens
ccccaagttactatttcaatacaacagaggtaagaaagttatctaaaatcagagaatcaatggtacagcagcctggttgatgtacttgagtgccataatcacataatcacattcccttaaggctcaaaatattttaaagttccaacagcttaggttttgaattatttattttcacatccccaagtctcacaaacatgagctgttgtaa

SEQ ID NO: 610211 - DNA, 261 bp, Homo sapiens
  misc_feature (230)..(230): n is a, c, g, or t
  misc_feature (249)..(249): n is a, c, g, or t
catcggttcctgtgaacaatcggagggtagatcgaaagatgaagggagggacagagggagggaggaacgaatcctgtcgaaaaggatgggccagactgagggagacagaaaaacatgttcggggcacaagggtaattctcaagtggtggaatgccacagtgaccggggtgcttacatagcgggcacacatattccaatatcagccacagtgggtttgaggtgagtatgangacgccacgttggttgaantgatgggacagt

SEQ ID NO: 610212 - DNA, 834 bp, Homo sapiens
gaagggtcgacgctttagccactgtggggcctcaccccagcctcgttgttgaaagaaggggacccagaagctcttctggggccatcgtgctgttcagtggcctcagccagactgggcaggcacctacaacatctctaaaatgtggacttctcattagaatgaagattgggcccctggtgtggacattcgtgagaatgacactctgttccaagggtcacttagggacccaggctggtggaggcttccagggcacatgggcactgatcctcaaaggcagaagggggtaggaagaggagggccgcacagagggggttacgggtcagtgcccacccgccatctcccagaactcggtcacatggccacaccagggcagctggccacacagggagcctcgcgcccaggaggaggagccagtgggtttggggaagcgcttgctggtcctactggaccacccgacccgcctgtctctgtaggagcctccattcgtggggacgtggcttagttgcctggacaagcggaaatacatcctgcctgccgtggggtcctgtgccttctccttgggcctcagtaggctccaggtgggggtggaaggcccagctccatggccatggcagcaggaagtggctgttcagtggtaaaaagactgtgccgcctgaccccatcaggctctctcacggtgatcagcaaatggagaaacggccagtaccacgccctccccctgtcctacagctggggaggtgcgctgtgcctccaccctcacctcctctcccctgatgacaagcatggggttttgctttttattttggtaaatacacatcagatgaaaaaaaaaaa

SEQ ID NO: 610213 - DNA, 361 bp, Homo sapiens
agttacgttagtgatgctctgacggttagagcatttaatgggattggcagtcagtgcatgtacagaaatgacagatatgctcggacacgttggctcacgcctataatcccagcactttgggaggccgaagtgggtggatcgcctgacatcaggagtttgagagcagcctggacaacatggtgaaaccctgtctctgccaagaatgcaaaaattagccaggcatggtggcgggtgcatatggtcccagctacttgggaggcttaggccgggagaatcgcttgagcccgggaggcagaggttgcggtgagccgaaaatcgcaccattgcactccagcctgggcaacaagagcaaaaccctgtc

SEQ ID NO: 610214 - DNA, 309 bp, Homo sapiens
atggagctccagtgttttcttgcctcccagcgtttgttgctttgacccccgcatagaagattcactgtgcagttcaggataggctctcggctgcggtggtacttcggagttctactacaggctctgcactggccatctctagactgactagtcctccaggctaggatttaggggggctggataccgccctcaggactggtctgagggctatgggctgccatcttgtgcgcacaatacaactgtttggcctcacagcagaaccaacccttgcgttatggcgttattaccagcgccctcaaaattagaagt

SEQ ID NO: 610215 - DNA, 156 bp, Homo sapiens
  misc_feature (43)..(43): n is a, c, g, or t
caggctcggacctgatatggcaagccagtagctgggactacanggtgcccactaattttttgtatttttagttgagacggggtttcactatgttagccaggatggtcttgatctcctgacctcatgatccgcccaccttggccttgccatatgcaa

SEQ ID NO: 610216 - DNA, 717 bp, Homo sapiens
agcgtcagctgactcacttctcaaaaacggagctccccgagtgagcaattcctgtcccttttaagagcttacaactctaagggggtccgcgctgagagggtcgtgattgattgagcaagcagggggtacgtgactgattaccggctgcaccggtaatcagaacggaacagaacaggacagggattttacacaatgcttttccatacaatgtctggaatctatagataatataaccggttagagtcaggaggggtcgatcttcaattaccacgcctggaatgcatcgccgggctgtctgacctactgatttcacttctgtactttctttaaaactcctacattatctatgaggcaagaacattgggcataagaccaatatgaaggggctgcgtctgactccacattcacttacgcggactattcgcagatatagcacaaacacaagattaactatgataagaatcagataattaaagggagagagcacagcgtgagacccttacagaatctacggtccacaaacagaacgtaatcgcaccataattatgtacgatcgtcgatgtaacaaaccacactcctcggcaaggtctttcaccgagtaggcatggtacagaaccaaggggcgaagggatcggacccagggatcaatgcccaggcgcacaagtgcacatagcgaaaattacaagcgcaaccacgcggaccagtgactagccacac

SEQ ID NO: 610217 - DNA, 346 bp, Homo sapiens
ttttttttttattggcccctttcccctttcctggtttttttaaagggggaaccttcccttttttttcgggttccccccgggaaagccctttgggttggggggttgaatttttttaaaggggggcggggagttttcccctttttttttttttgttttaaaaccctcccctttttggatttttgcccgtttccccctccccctttatttttttttggattgggttttcttccccttggggggtaaaaaattttccctttggaaaactttgggtttaaccccccttttatttccctttttttttggggaacccccttggtttttaaaatggttcctttttaaagtttga

SEQ ID NO: 610218 - DNA, 518 bp, Homo sapiens
gcactgcagcctgggtgacagtgaaaccctgtttataaaaatcagggctgggcacggtggctcaagcctgtaatcccaaaatgctacggttgtatgagtgagccaccaggcccagcctttgtagccattctttctaaatatgtctttccactatagcagcaaacgcctccatcatcccttcagtgaacaaatacccactcccatgttcccactataaaggagagacaagtttaatttcaggaggctccggggccacctgaaaacgatgactggaacctttacaggattaatcttccatcaatctttcatttcttggacatcaattgaattgaaggtgggctacaatagggttcctttgaactttataactgccctctcctcctgaatccagaaccttttcatcctgaagagtttttctgactgtggagggaggtcctgtggaatttattccagaggtgaatactcagctcactttctcatccttactctgactgaatgtgaagcctgttagcctggcc

SEQ ID NO: 610219 - DNA, 460 bp, Homo sapiens
ggggggggctccccttgttgtgtgggggggacgggcgcccccctccccctcccccacactttttattcttctctttgttccccccagaggggggggggggggcggggggaggggtgtgtttttcttttttttccccctcccttggggggggggggggggaccccttttttttccccgggggttttttggggggggggggggcccccctttttttgggcccccccccccccccccaaaagggttttttttttcccgggggtttttggggggggggggcccccccccctttttttcccccccccccccaggggggggggggggttttttcgccccggggcctcccctcttaaagggggtccccccttttcccccccccccccgggtttttccccccaggttttgttcctttgggggggggggggcccccccccttttttttttgtgtggggggaagggggga

SEQ ID NO: 610220 - DNA, 468 bp, Homo sapiens
gcactgcagcctgggtgacagtgaaaccctgtttataaaaatcagggctgggcacggtggctcaagcctgtaatcccaaaatgctacggttgtatgagtgagccaccaggcccagcctttgtagccattctttctaaatatgtctttccactatagcagcaaacgcctccatcatcccttcagtgaacaaatacccactcccatgttcccactataaaggagagacaagtttaatttcaggaggctccggggccacctgaaaacgatgactggaacctttacaggattaatcttccatcaatctttcatttcttggacatcaattgaattgaaggtgggctacaatagggttcctttgaactttataactgcccggagggaggtcctgtggaatttattccagaggtgaatactcagctcactttctcatccttactctgactgaatgtgaagcctgttagcctggcc

SEQ ID NO: 610221 - DNA, 752 bp, Homo sapiens
taaaattggcttcaacaagctctccaccagttgactttcttgggctaattttactttgcatgatatgccttaatatgccttcataaataaccatttaagtcataattggtccttaagctgcttttttcttctattaatgggatcatagtaaagagtagtcaatagggtctccagctattaatggtagaggtgattaaaaccaacaaggagtttcatgtgcaaaggagatacggaaatgatttataaagattggctattggggtggctcttattaaacggtgtatttggtacttatcactacacgtttcccccaaatgcttacatgggagttggaggtaagtatttcacttccttggtgtaagtactctattcacattcttatggtaaccttcctcatttcacagatagggacatcttgggggattaaccaacctcctttctgtaagggtaatcattaaaataagtcctatggataaagggtcacaaacaaaacaacgacgacaacagaaaaacaaaaaccttgttgtgcgcagcgctacccaacccccgcaaaaaatggctttgaaacacgccaacttggttggggagccgggggcaccaaaaagggaagagtaaaccgtgtgcaaacagggtacccacaagagaccctggggcacaggaaacacgggcagggagattcaccacaaaaaaacgggcgggtgaacaggagtttgtagaacaaccacagggagttgggaccaaacgggggccaa

SEQ ID NO: 610222 - DNA, 226 bp, Homo sapiens
  misc_feature (115)..(115): n is a, c, g, or t
  misc_feature (153)..(153): n is a, c, g, or t
gagccgggagctgctgaaccctgagcccaggagacttgagcccagagttgaggctactgcctatatgatcactctgggcgacgcgtgcacaacttcgccgacggctggccgtggngccgccttcgcgtcctcctggaagaccgggctggccanctcgctggccgtgttctgccacgagttgccacacgagcttgggggacttcgccgccttgctgcacgcggggct

SEQ ID NO: 610223 - DNA, 380 bp, Homo sapiens
  misc_feature (50)..(51): n is a, c, g, or t
  misc_feature (336)..(336): n is a, c, g, or t
  misc_feature (374)..(374): n is a, c, g, or t
cgaaaaaagaactttgatttggttgcagaacatctcagatctaggcttgnntttgtcaataagtgactatagacaacttagttattcacctgagattttctatttcctcatttgtaaattaaagggattaaactaagtgacttctaatatccaacttagttttaaaatgttattccctgataacttactttatcttctcttgaagcaatattttggtgtttaagcttggaggaacatccttatctctcagcgtcatggaagttaacagtggaatatatcgggttctttcaacaaacactgatgataacatcggtggtgcacatttcacagaaaccnttagcacagtatctagctttctggagttcccaaaagancctttc

SEQ ID NO: 610224 - DNA, 169 bp, Homo sapiens
cggccaggggagttgaggggtgggggtgagtaccaggacgggaccaccagcgagaccccttccagtcctcacattctaggatcccacaaacctgcagaactgatttgattggtggtgttatttttagtcttcagcatgggaaacaattcttatgggcctctgctctcca

SEQ ID NO: 610225 - DNA, 1186 bp, Homo sapiens
  misc_feature (795)..(795): n is a, c, g, or t
tcaaacagtctgatttaattaggaagttaaataagtggaggggggggggagggggatcatcaaaaggctgactggggaccgcgttggagttgggcaactcatagcagtgtggtgaggtgggcaaggggagcaaccccctttcaagaacagggcacaaacatattgggcaaggagagatgagggggtgggacctcacgtgctcaagggacagtgcctcagggaggccagggggtccaccagtggcaacgaggggaggactcatctcaggcaactctcagcctagtgaagggcggggccatcgtggtgaagggcgtgagagggcctcaggcgtggtccctcaagagggctgggtgaatctcaccgtgggaagaagtgcctcacgcccgtggtgaagtctctttctcccaaactatctctcgtgagacgaggcgagagttataaaatgtgctcccaggatacttctcccacagtatccacttgtgggggtgtgcccccccatgggtctccccactgtgccggtgtggagacaccaggggggtgactcatatatagaggggctcgagaccacgtcccaaggggaggacccccccttgaggatatctacccttctgggcgccacctcttgggggcgcaaagtcttttctctctagaagccaagactatttgtgcacagcggcttgtaggagcacggctctctctttgggggtacacccatcgtcttgggagaaagggggctacacactagcgcgccttatatctgtgtgggggcctaaatttctaaggtctcaccgaagncctcttctgccgagatactaccggaggggtcctccgcagggggggccccccctctattattgggtaggccaagaagagcggcgtcttcacagaagatctattccccccccccaacgccgagcaatattcccctggcacaacaaaagaaagccgtgcggggggcacaatatacaggtggcacacctaccccggaccgccaggggaccgatataaaaattcaaacgggtggggggagaccactctcccatcagtggccaccatgcggggaacaacaaaggcgggcgggccaccccaaacagcgctggatgataaggcaggactctcccccggaatttccgcgagggagggagggaacattaccccgggaacaacccccgggggcgggcccacc

SEQ ID NO: 610226 - DNA, 134 bp, Homo sapiens
tggtgctggattttaatgggagtcgtccatcttccggcggggtcaaagaatgtgcgtgttgaggttgcggatctgttagtagtatattgatgccagcagctaggactgggatagataggagaagtaggactgct

SEQ ID NO: 610227 - DNA, 502 bp, Homo sapiens
tataaaattttacacaggtgcacttgttatagaggcatgggaagagagtgcgctaaaaatatttaatataggagtgtggtatacatcctgttattgagttagggaagggggactgacattacattactgagtgtgatgatgttacatgaagctctggatccgtgatggtctgtggctgctccgaggcgattgggcagcgtcagtcttcagccagtaagctaagaagatctgggaaggaatcagagagccttggggcagagttccaggggctctgaaagtggcctaccaggtgagttgaacagtccgagttttcagtggggtccgcacagacgggacccagcttaggaggaatcctggggctggcgggatttcccttggcttgggtgggacagattttttgggcaccttgtatgccagagctcctggggggaggagggttctggaggaacacctgtgaggctgcgggatcaggtggttcggaaagttcttgtgttgctggaga

SEQ ID NO: 610228 - DNA, 149 bp, Homo sapiens
tcgtcacctcgggccggcatactggacttctggcatactggaccttctgcatatgaattaactagtaaataagctgttgcaggggagccagagctaagacccccgaaaccagacgagctacctaaaaaatcccaaacatataactgaac

SEQ ID NO: 610229 - DNA, 273 bp, Homo sapiens
cctggattagatgtgtgagtcgttcatcactgtcaaggcatcacagatttgtgagttgttaaaggttaaaattcatacaaacctgctgtaaataagacaaggtagattaaatgcgtcattgtctgtctctttacataaagtaatgctttccataaaaagcaaaggtgggctttttgccttgtattgccgaacaaacgcttggtctcttagaaatttttgtgccagaaattgccccagaatttctaagaagaacgggtacccgagcctcgaaat

SEQ ID NO: 610230 - DNA, 334 bp, Homo sapiens
  misc_feature (3)..(3): n is a, c, g, or t
  misc_feature (10)..(10): n is a, c, g, or t
  misc_feature (35)..(35): n is a, c, g, or t
  misc_feature (125)..(125): n is a, c, g, or t
gantttggcnttaaaataggcaattacattttttncccctcaaatttgaaaagagaaaaaaaagtcttttttttttttgagacgggagttttgctgttgttgcccagactggagtgtaatggcanaatctcagctcactgcaacctccgccacccaggttcaagcgagtctcctgcctcagcctccctagtagctgggattacagacacacaccaccgtgcctggccaacatagtgaaaccctgtctctacgaaacatacaaaaattagctgggtgtggtggtgggtgcctgtaatctcgattgcacccctgcactttagtctgggtgacaaag

SEQ ID NO: 610231 - DNA, 344 bp, Homo sapiens
cccggaatttggtggccaagggggcccgggggggcccctttacttttaagttccccttcccgttggccggggggttccttgggggaccagttccctcccatttttgggttttttccaggttttctttttgcggttccccttcccgggggtgttttttttttgggtgcaaattccttttccggtttggatcaagttttgcccccccttttcccggggggcctttccggggtttctcccttggggtcttttggtttggcccccccggggcccccgattttcacctttttcctgggaattgggccttttttcccttcccggggaattaacctgtttttggcccccca

SEQ ID NO: 610232 - DNA, 409 bp, Homo sapiens
taggagtatggcctttgccatgtggctacagatgtttgactaagaaaaagatgctagggctgggcacagtgtctcacgcctgtaatcccagcactttgggaggccgaggcgggcagatcatgaggtcaagagttcaagactaggccgggcacggtggctcatgcctgtaatccctgcactttgggaggccaaggcgggaggattcattgagcccaggagtttgagaccaacctgggcaacatagcgaggtccctgtctccacaaaaaatttaaaaattacctgggcatggtggtgctcacctgtagtcccagctactcaggaggctgaaatgggaggatcgcttgaagtccaggagattgaggctgcagtgagctatgatcgcgccactgcactccagcctgggtgaca

SEQ ID NO: 610233 - DNA, 108 bp, Homo sapiens
cggcccgcccgcggccgcgcacccccgtctcgggaccctgctctactcagcgcccttttgttttgccttatatgggcacccccttgcgtgtccaaaccaagcctgtct

SEQ ID NO: 610234 - DNA, 342 bp, Homo sapiens
aaaatttttttttccccccttttttttttaccttttgaaaggattccccttttttttccccccattttgttttttacccccccctttcaagggttctctcaaaaccaacccgttttttgttttggtttaaatttggttttggaaaaaatttttttttttggggcccttctttttgcccttgaaaaacccttttttgggttgcccttacccaccctaactactttttcaatttttcccctttttatttttttttttttcccctttggccctaaacccaagccccttttttttttccaatcccctttttttttaaaggggattaattaatttttttttccttta

SEQ ID NO: 610235 - DNA, 489 bp, Homo sapiens
  misc_feature (11)..(11): n is a, c, g, or t
  misc_feature (23)..(23): n is a, c, g, or t
  misc_feature (55)..(55): n is a, c, g, or t
  misc_feature (75)..(75): n is a, c, g, or t
  misc_feature (153)..(153): n is a, c, g, or t
aaaaagggtgncctcccctttanggaatcaagctggacttgcggagccaaaaaangggagaaaactggccctcanacccttggcctacacagccccttgtacagggctccctaaccctgtgatgagtaaagaatgtcactttcctaaacaggncccaggagcccccaagttatccttgggacctcaagaagagaggaatttacccaactcataggtattggagggtacaaacccattgctgggcttgactttaaaaagtcttttctgatattccttatggaacagaattccatcagagccaattttaaaagcatatgtgaaaaataattattcttgctgtactttatgcaaataatcaggccaagtataagactaaagtttattttgcaaacaatcctattatgatttgtttttaacaaaaatgaagactggagagtttcaaaacttatcacacttgtcattaaattctagttttattaaaaaaaaaaa

SEQ ID NO: 610236 - DNA, 266 bp, Homo sapiens
gaggatcccgtgtgccggtttcgtgcgacggttacgcgagtgttgctagaagtcaatcccacagctattagtgggagtagagttttgacagtccttgcgcgcggcttctgatgcgactgtgacgtgcgttcgtagttagagtttgctaggcagcctagtcatgaggatgtaaagcccgtgggcgataatgagaatgactgcgccggataagcttcagggggtaaggctgagaatggctgttactacgagggctatgtggctcattg

SEQ ID NO: 610237 - DNA, 578 bp, Homo sapiens
ttttctttcttgtagagacagggttttgctctgtcatccatgctggaatgcagtggtggcatcatagctcactgcagccttggactcctgggctcaagtgatcctcccacctcagcctcccaagtagctgggactacaggcatgttacacctggctaattttttaaataatttttttgtagagacggggtcttgctttgctgcccaggctggtctcaaattcctagcttcaagtaatcttcctacctcagcttcccaaagcactgggattacaggcatgagccaccaggaccaggtggcccatttctatattagattatttgtcctttactggtgtgttgtaagggttttttatatattctagatacaagtcccttatcagatacataatttgcaaatattttccctttcttatattaaaccctacattttattagtatttttgtttggttttagtaaaagaaagcatctcaccagctcatcttaccctgctactggatttagaaatctatgtatgtttttacaacttctttttttacttaacaatatatcataaacatctgttcatgacaatccaga

SEQ ID NO: 610238 - DNA, 642 bp, Homo sapiens
  misc_feature (61)..(61): n is a, c, g, or t
  misc_feature (68)..(68): n is a, c, g, or t
  misc_feature (79)..(79): n is a, c, g, or t
  misc_feature (95)..(95): n is a, c, g, or t
  misc_feature (118)..(118): n is a, c, g, or t
  misc_feature (125)..(125): n is a, c, g, or t
  misc_feature (156)..(157): n is a, c, g, or t
  misc_feature (164)..(165): n is a, c, g, or t
  misc_feature (173)..(173): n is a, c, g, or t
  misc_feature (175)..(175): n is a, c, g, or t
  misc_feature (179)..(179): n is a, c, g, or t
  misc_feature (181)..(181): n is a, c, g, or t
  misc_feature (184)..(184): n is a, c, g, or t
  misc_feature (190)..(191): n is a, c, g, or t
  misc_feature (198)..(205): n is a, c, g, or t
  misc_feature (209)..(209): n is a, c, g, or t
  misc_feature (211)..(211): n is a, c, g, or t
  misc_feature (217)..(217): n is a, c, g, or t
  misc_feature (227)..(227): n is a, c, g, or t
  misc_feature (238)..(239): n is a, c, g, or t
  misc_feature (254)..(254): n is a, c, g, or t
  misc_feature (256)..(256): n is a, c, g, or t
  misc_feature (264)..(266): n is a, c, g, or t
  misc_feature (270)..(270): n is a, c, g, or t
  misc_feature (273)..(273): n is a, c, g, or t
  misc_feature (275)..(278): n is a, c, g, or t
  misc_feature (281)..(281): n is a, c, g, or t
  misc_feature (283)..(283): n is a, c, g, or t
  misc_feature (285)..(285): n is a, c, g, or t
  misc_feature (293)..(293): n is a, c, g, or t
  misc_feature (296)..(297): n is a, c, g, or t
  misc_feature (303)..(303): n is a, c, g, or t
  misc_feature (308)..(310): n is a, c, g, or t
  misc_feature (324)..(325): n is a, c, g, or t
  misc_feature (329)..(329): n is a, c, g, or t
  misc_feature (340)..(341): n is a, c, g, or t
  misc_feature (343)..(343): n is a, c, g, or t
  misc_feature (359)..(359): n is a, c, g, or t
  misc_feature (361)..(361): n is a, c, g, or t
  misc_feature (365)..(366): n is a, c, g, or t
  misc_feature (370)..(370): n is a, c, g, or t
  misc_feature (391)..(391): n is a, c, g, or t
  misc_feature (397)..(397): n is a, c, g, or t
  misc_feature (448)..(448): n is a, c, g, or t
  misc_feature (451)..(451): n is a, c, g, or t
  misc_feature (493)..(493): n is a, c, g, or t
  misc_feature (495)..(495): n is a, c, g, or t
  misc_feature (502)..(502): n is a, c, g, or t
  misc_feature (521)..(521): n is a, c, g, or t
  misc_feature (524)..(524): n is a, c, g, or t
  misc_feature (553)..(553): n is a, c, g, or t
  misc_feature (556)..(556): n is a, c, g, or t
  misc_feature (575)..(575): n is a, c, g, or t
  misc_feature (582)..(582): n is a, c, g, or t
  misc_feature (601)..(601): n is a, c, g, or t
atgattttttatcgtattctacatgccaactgctttacatttcccagccgcaagatatacncttcttnccccctgtccngccctgtctgtctgcntccccttcccccccgtcccattngccctcnggtcccatttctacaattggtcttccagccnncattttnnctcatgtncngtantnttncggttnntcgagcnnnnnnnncccnancccccnggcattatanctctttaattnntgacttgggttatcncncctgaatnnnagangangnnnnagntntnatgtggtntgnntgatgntttgnnnaggtgagagagggnntgcntgttgtgtggnntntgtaagaagtcgcccntncgtnntgcntgcggcggaattactaaacgnttctgngtcgacgctgaccatttgcttcaatttcttccttgggtcgcccgaaaaagntantttcgctttcttgggcttggatcgttcatagctataggtcancntcttttnctctctgttattctacctnatngactctggggctcttttagcttttttccnacntcctttttgcgctgtggcntttgctntgtgttgccattctccttntttcctttctggtctcctgtatatattattttcccgtatcc

SEQ ID NO: 610239 - DNA, 928 bp, Homo sapiens
  misc_feature (5)..(5): n is a, c, g, or t
  misc_feature (72)..(72): n is a, c, g, or t
  misc_feature (77)..(77): n is a, c, g, or t
  misc_feature (81)..(81): n is a, c, g, or t
  misc_feature (87)..(87): n is a, c, g, or t
  misc_feature (107)..(107): n is a, c, g, or t
  misc_feature (147)..(147): n is a, c, g, or t
  misc_feature (158)..(158): n is a, c, g, or t
  misc_feature (191)..(191): n is a, c, g, or t
  misc_feature (198)..(198): n is a, c, g, or t
  misc_feature (221)..(221): n is a, c, g, or t
  misc_feature (238)..(238): n is a, c, g, or t
  misc_feature (247)..(247): n is a, c, g, or t
  misc_feature (255)..(255): n is a, c, g, or t
  misc_feature (257)..(257): n is a, c, g, or t
  misc_feature (379)..(379): n is a, c, g, or t
  misc_feature (381)..(381): n is a, c, g, or t
  misc_feature (430)..(430): n is a, c, g, or t
  misc_feature (501)..(501): n is a, c, g, or t
  misc_feature (627)..(627): n is a, c, g, or t
  misc_feature (649)..(649): n is a, c, g, or t
  misc_feature (719)..(719): n is a, c, g, or t
  misc_feature (750)..(750): n is a, c, g, or t
  misc_feature (779)..(779): n is a, c, g, or t
  misc_feature (784)..(784): n is a, c, g, or t
  misc_feature (796)..(796): n is a, c, g, or t
  misc_feature (799)..(799): n is a, c, g, or t
  misc_feature (804)..(805): n is a, c, g, or t
  misc_feature (811)..(811): n is a, c, g, or t
  misc_feature (838)..(838): n is a, c, g, or t
  misc_feature (844)..(844): n is a, c, g, or t
tggtntcccgctactgcccacgttctgcaaatcctgccatgcagcttgaccgcttcatccagtgtgcacccngctgnaggngctaanagaggccttccgggagaagnaaacagctgtacaaggcaacatccggttcagcttcggagnattcgtcaccntaacagcttctcggatgctttgacccacccttntgtgganagtggagtgccccagggaccttncctggcttcttagagtnagagaagtntgtgcacntntcttcttttcctgtccctctagaagaacattctcccttgcttgatgggaaactgttccaaaagagggtgaaaagtcctgcataatagccaccaaatagtgaggaccggggctgaggccaaananaaaggggcctgatggaggagaggatagaagttaaatgtcctaatggccntgagcagttaagtggaacagcctggcaccaggagcaggtccttgtaatggagttagtgtccaatcagctgngctccaccctgatgccagtggtgagtgttcatcggcctgttaccgttagtacctgtgttccctcaccaggccatcctgtcaaacgagcccattttctccaaagtggaatctggccaagcataaganagatctgtctatgggaccagtngcttggaatctgcaacacccataaaaccttgtgtgttaacttctagctgcctggggctggcccagatcanacaaatctgctccctgggcatctttggccangcttctgccctctgcagctgggacccctnacttncctgccatgctntgntcggnntcagtntccaggaaacagtggtcacctctcccngccaanactttttttaatttgcattttttttcatttggggccaaaagtccagtgaaattgtaaaaatcaataaaaggatgaaactttgga

SEQ ID NO: 610240 - DNA, 205 bp, Homo sapiens
gaatagtagggcatctgatttggaaagtcctaaaagaagagaaagtgcaagtataatttcaatgcactcatccacagggcagcatcagggtcaagttcagtcaggcaaaagcatcagcaggtccccaaatctctgccccaggcaaaacaagcgcaaagggccaagcaaatcactgctgcaaaactatcttgcaaacaccagtgca

SEQ ID NO: 610241 - DNA, 892 bp, Homo sapiens
caggaatggaagacgggtcagatgatatggatacctcagtagaagatatggtggtcgttcatgtgatcactcgctttgtgagaaccctgttattaattatggaacatggtgtaaaacctcacagtaaacatcttacagagtattttgccgttcctttacgaagtttgcaagaaatgggtgaagaagagagccaattttgctttcattgcaatgctatatctacaatggtacatgtttacatgggaacaaaaggacctgaagaatcctcaagttgaagtgtcatcagaggaagaaggggacagaagaagaggacggaagaagatatcctctctctggcagaagaaaaactacaggccagctgcccttgaaaacgatgatagctttagttgctcttatgggttgaacagtctcgactcagacaaggcatttgacattatcacagactgacatggcagcattaacaggaggaacaggtagtcacattctctaatattagacaattttgatcatcacaacaaatccctcacggttctctccagtgacacaacttttgctgtttgacaggcatttcccttcttgttcgaacatattcgtgatggcatcaatataagacaaacttggtacatctgatctacagcctgtgtcgatacaataatcgacttgccgaaccatatcgtatctatgcttgccacgtcattagcaaacgttgacctccttgacggccaggccaaattcatatatcttccacagctcggtgggactactgcctactgcgaggatacgcctaggtgctaaccctcccaggcaatctacctccccatctgcaattttaactacgcatgcaagaagggcactatcggacacgtcgctcagcactcaacacacacatagc

SEQ ID NO: 610242 - DNA, 269 bp, Homo sapiens
attcgcggccgcgtcgacaataaaaatcccacccttaggcttgagttctcctgtgctcaagcaattttcttgccttggcttcctgaatagctgggactataggcatgcaccaccacgcctggctagtttttgtatttttagtagagacggggtctcgctattttgcacaggctgaactctaagtcctggcctcaagtgatctttctgtttcaggccccaaggtgttgggattatggtcatgaactgatgcacccaggcctttatacttc

SEQ ID NO: 610243 - DNA, 533 bp, Homo sapiens
gttccgttgcatcacaaatctgtgttacaatatggcttctcaatgaccagacatatactctgaaaagtgacaaggatgtactaagaattatcctcattcatagagtatctgaaaaatccttatcaagtacgatattaactttacctttataacatccttgtgtgcaaatgagagaaaaatcaaggcatacgaagatgcattgtgttctacatgattaaagtaccatccgttagtctccgttaaaagattttcatccatatattcaaaaaccttttaggttcacctgtccagtctaagacagagtgtagacattttggagtatctgaactaagcatcgtcctgacttggacaaacaatagaaactccaatgagaagtccttgtgggcctcccagtcatgcctttccgtagataggtgaacttcatctatgtagtgtcatcacgcctgcaatgtctaaatttgcccacataggatgagttacgaattcttgcaggattgctgcagctatacatgctcctgcggatctgaagagtg

SEQ ID NO: 610244 - DNA, 658 bp, Homo sapiens
tactaaacaggtaaattatgggaatcactgaaatatttggtagatactggtgtacacagtgtgtctttctttgtgtcctttggattacatgatttgggatttttaaaattattagcacacaactattttcagccctttaataatggagcatcaaaaacatcacgcttgtaaccccaagcaaattatagaagacgtgtatttaactagtgatatccattttcccagacatggtgattacaataatgcaaacgacgtcatacaatatgccatttacaatacaggacgcgacggcaacggcaacaattgcccatagaatgtcccaaactatatgtcccaaccagatttggcttccccatcaatcactaccgtgtaccttcccctagaactacttctggggcacttcgcagaagggatcttaacaacctacttcggccctggtattaacataacttcaatttgggcccagaaaaagtgtgtgtcacccattattttccaggaaagttcctggccttctttgaatggcaataaagacttctttcacaaatggcctttgggtcgctaactttccaaaaacgcgcaaaaatttgcacccaaattattcccaagacattgaacgccttatcagttcacacaaaattactggtaagttcacgagact

SEQ ID NO: 610245 - DNA, 325 bp, Homo sapiens
caaatatagaaaatcattttacataagaattttaagtatttgcaataaatatatgtatttagattgtatgtattcctatattcttatttgtcattttattattaagtaaatgatcattaaaagtgtaattaataaccttggagttttttgttgaatcttgaggtttaacatacttctgagagtggcgtgggtaagtgtcttcagttactgccttttattcctatgggatggttccctcatattttatggaagagagtataatgagtaacttggtgataaatcatggttgtgtatttcttttgtaattaatgtaaaactgattaaa

SEQ ID NO: 610246 - DNA, 431 bp, Homo sapiens
tgtacggttgaacgtatgctagaacctcctggcagcggagtgtcatctgcaccaggtgacacagcgctcgcaccaaacctcctccggactgattcacaggccaggaaagaattaaagatgaggctcaccaggcgccgcagacacaggtcgagaatcagtttccagacgaaccagaatgtgctccagtgggacatattttccaaaacttagcagccctcacagctttgatcttcaacagcatgtccacaaaagctaccctcactttctccgaatggtcgtggagacggtatctgagagctggcaggagctgctctaacaatgggtgggctcagttggtggtccaaaatcattggcagaccacttaacgacagaacaacgaccatcagctgagctcgtgtcaaatgccagtacggaaggtggagtaaagtccg

SEQ ID NO: 610247 - DNA, 124 bp, Homo sapiens
gcaccgcttactacagtagtacagaaaaagggcccctctgagtgaggctgcagcctgcctggacaaagcagtggaatatgggcttatccaacccaaccaagatggagagtgagggggttgtccc

SEQ ID NO: 610248 - DNA, 193 bp, Homo sapiens
  misc_feature (127)..(127): n is a, c, g, or t
tcaccatgttggccaggctggtctcaaactcctgacctcaagtgatatgcctgccttgacctcccaaagtgctggggttacaggcatgatgagccaccgcacctggcctgacctgcaacttttatgntctctggtaaaacatgagaaatacttgtaaaaattatgggagtcaaagtaaataatttatttttta

SEQ ID NO: 610249 - DNA, 419 bp, Homo sapiens
  misc_feature (22)..(22): n is a, c, g, or t
  misc_feature (69)..(69): n is a, c, g, or t
  misc_feature (155)..(155): n is a, c, g, or t
  misc_feature (243)..(243): n is a, c, g, or t
  misc_feature (285)..(285): n is a, c, g, or t
cacccttcctggcaaatccatngaatccgaggatggtcttccggagcttgccacactggtaaatccctngatccacattctcttaggctccaagggcatgtgaagaagtgaatatctggcctttgtggcttttgcacttggaactgttaaggtangaatatatatgaccttactaaaatgttaaaaatcgaaatacatcctgggcccaagggttttcagtaaggatctataacgctatataangaactcccctaaagtcagtaagacagacaacccaaatgaaanacaggtaaaatatacaagcatattacaataaatctaatatgttcattaatgtataaaaatgtgttctaccacattgcttatcagaaatataaattaaaaccataaggagataccaataaatacacataagattt

SEQ ID NO: 610250 - DNA, 669 bp, Homo sapiens
agcgggctgtccctgcccgagacaatggccggcgaggctggtacgcggtgctcccatcttctctctcatgaatctcgtgaagccccgctgtgccgcgtaggtgggggccggcaatatcacaattaccatctggcggggacaactgagaaggcaactgaccaggatatcaaggataactggggcgacagtgatgatgtgaaaagaaagaaagagaagtaaaactagaagtaaaggtttcagaaaagatagatcgataaataatcgatcgatagatagataatagatagatgataggcaggtagataaatagataatattatatacatgtatatgtatatgactcgagaaagccaaagagaaattacagcaactggaaaaaaaaaacctttaatttaaaaagatgttagggagaacttaaggtgttaacaccaaagaacaattagcaaattcgaccgggactaaacctaaagaaatttccaggaagagtcagacttcaaaccagccaaaaagacgttggcggtacatacagttaatggagccaaggctctgaacccactttgggacgagatggcttccgtggatttggaaacagttactaaaaacattaacaattacccatttttgaacaagtcactgtattatgcaaagttggggggtatccttaagatg

SEQ ID NO: 610251 - DNA, 807 bp, Homo sapiens
gaaagtgaggtcaggcggctctaacggatgcaagactcaccttatcccagtggattgtgcagaatacactgttctggtcggttgtcattctagttctccagtggggttcttactggattatccaggtagctgagaatctggatgaagcgtgcactctagggcagagcagctatgatcctgattctcagtgcctgcggtcgaaacgaatcgtgttccaggaatttaccaccgattactccggctccatacaggaatgaatcggaatctggttccctgcgacggagaatttcgaaggacatgaacattgatcaacagactgtcatgcaaggagaaggatcggcataggtcaccagtgagaggctgacgggtctggtaaggcaggcttgggctgacgaagtcgacgagcaccgtagaaaacgagaggtgacttcagtataggccacatgaggagatgagcatactaagagatacgttcagttagcatattggccacgtatgatgaccatcttgagccgcatcataaaattgggataggctctatgagacacgagaacccgaagacggcctcggagatggggtgctcgaagaccttgggaacggtttagccgtagcaggaaggtataaggcgatgattcgacggacagtgcggaaatgaagcaagagaattccatcatgaactcccggtctcgaacgaggaactgaaggctgactgagagtgttcgtatgcttgagagagctggagcttctggtgccctctatccaccgattcctaaaatatccaaggagactggtagcttgggcagttgg

SEQ ID NO: 610252 - DNA, 164 bp, Homo sapiens
ggtcgttctagaggatcccagcactgtgagactacttgtcagcatcgctggacatgaatagccaggctgacatcaagcaaccatgaactcagctattatgaacatcacatataccagggcagccgcacggcatcgatggtggcgcttactcctgtgaccacccg

SEQ ID NO: 610253 - DNA, 428 bp, Homo sapiens
tcatcatgcggcattgcatgtctagtatatttttaattatatctactgcatatgtatatgttactatcagactggtctacataattactagacgattatcctatcagacttacagtaaattttgtcaattatagacataaaggaggcagaaggaaatagagctattcaaatgcaaattttttatatacttattgaaattaattttattttaatctgaacaagattgtcacaaattacacacaactgaaaaaagttgtgaactggcatgtctgcaagatagctgtctagactttgtcctggttttcatcttccccagcaaaaagggaccaatatattgaattaactactttttttttcactatgcatgaatgcggaagtacactggagagcaccatgtaaattgctaaatccttgtggaacacagaaac

SEQ ID NO: 610254 - DNA, 268 bp, Homo sapiens
gaaaaaaaaaaaaaagaaaaaaaagaggggggccgggggtttcccgaaagggatttcggttttatcccccgggcccccctcctgcttaagattcaactgggggcaaacccgggatgctctctaacgtaatcaagggaagggtccgtaaaaccaagtgatttttcctctataacttccaccccatttgttttggcccccaccctgttacccctatggcccccttttttaaaggctttgaaaaaccaaaaaaattttttttggtttttta

SEQ ID NO: 610255 - DNA, 241 bp, Homo sapiens
tggtgtgaagtgttgaatgagtggagaagagtgcagtgtgcaatgaggagagcagtgttgggcagtgtggtcggggtttgatcctgaatgcagaggcgacatggaagggctttgtgcagtggtgctgctgtgctactgattcacacatatagaaatgaccattcttggagtgcagccatggagtgctggtcacgttgaatgagtgaggcagatgtccttgtgaccagtgatgtttgttgac

SEQ ID NO: 610256 - DNA, 218 bp, Homo sapiens
ggggttttaaaaaaaaaaaggttcccttgggtgtgttttagggaaggtaaagaaaaatctgctctttctttgaaaactgtttttgcccccggcagggccttgggaaggcccaaacctttaccgtagggcttttgttcccttaaaagttttgtttcctgaaaataaaaagggtttgttgggttttttattgttttttgtgtttatataaataaacctgg

SEQ ID NO: 610257 - DNA, 166 bp, Homo sapiens
  misc_feature (146)..(146): n is a, c, g, or t
agaggatccgtgagtggcatgtgaggtggcattcacgcaggttagaatggttatactaggaagtcacaaacagcagatgcgtggagaggatgtggagaaatgggaatgctcttacactgttggtgggagtgtggattggcttcacnccattgtgcgaggacagctg

SEQ ID NO: 610258 - DNA, 157 bp, Homo sapiens
cgttgacaccatgatcgtggacaagaccggcacgctgacggagggcaaactgacgttcgagcgagccatcgccgtcccaggacggtctgacgacgaaatcctccttctggcggccagcctggaccaaggcagtgagcatccgctggcccatgccgtc

SEQ ID NO: 610259 - DNA, 172 bp, Homo sapiens
cgacagaagggggcatgaggtggtgcttctggggtgttctgtttcttgatctggttgccggttacctgggtgctttccgtttgtgaacattcttggagctgtacacttttgatctgggcacttttctgtgtgtatgttatacttcaataaaaagttgggctttgtgactagc

SEQ ID NO: 610260 - DNA, 302 bp, Homo sapiens
  misc_feature (7)..(8): n is a, c, g, or t
  misc_feature (35)..(35): n is a, c, g, or t
  misc_feature (67)..(67): n is a, c, g, or t
  misc_feature (89)..(89): n is a, c, g, or t
  misc_feature (204)..(204): n is a, c, g, or t
  misc_feature (222)..(222): n is a, c, g, or t
  misc_feature (281)..(281): n is a, c, g, or t
  misc_feature (284)..(284): n is a, c, g, or t
gcccggnncacctctgacatctcattccgggtatncccgaggtcgtccccatgcttcccagcctggncctggagggtctcaaacttggnctggtaccaggcttcagcttcagcccggctgcatttggccatctcctcatactgcgccttgacctcagcgatgatgccgtccaggtccagggagcgacttttgtacatggacagnaccacagatgtgttgganatctgggactgcagctctgtcaactccgtctcattgagggtcctgaggaagttgatctnatnattcaggggattcaactt

SEQ ID NO: 610261 - DNA, 117 bp, Homo sapiens
gaaaagagactgttcaaaccactgaggatcagattttgaagagagatatgccaccagcatttattaaacttttactagaggaaatcctaaagaatgtacttcaaacaagtccgctga

SEQ ID NO: 610262 - DNA, 364 bp, Homo sapiens
  misc_feature (280)..(280): n is a, c, g, or t
tcagtcgctctggggacgctgatgccacaaaggaaataaccaaaacaagataactctattgggcggcgggaacagaaaggaacatgtagcaatcactcctcttcatccatgcaaggaagcgaggcgatgccttgaaaaggacggccttctttgctgcaaatagccagaagtgaactgagcaaaggaagcacgggacgcacaggaagaaaagtgctccaagggacggacaggacggtgccggggttaggaaagcgcaacactgttcagacacagtctccgntatatgaatggcaagcccagttaaaaatatctaaaagggcttttttaggtttttaaggatatttttaaggttagttttattaaa

SEQ ID NO: 610263 - DNA, 738 bp, Homo sapiens
ctcaaatcagtatgaaggccacccattcagggcatatttggaatctgaagttgccatatcagaggaattggtgtcagcaacatatagctacattctgctcttggtcatgtgagacgacgcacaataaaggaattgaggcgtctcttcttagttgatgaatttacttgattccctgaagtttgcagtgttgactgtgggtatttacttacgttggtgccttgttcaatggtttgacactactgattttagctctgatctcactcttcagtattcctgttatatatgaacggcatcaggcgcagatagatcattatctaggacttgcaaacaagagcgttaaggatgccatggccaaaatccaagcaaaaatccctggattgaagcgcaaagcagaatgaaaaggccccaaacagtagacattcatctttaaaggggacactcccttggttacggggtgggcgggtcaggggtgagccctgggtggccgtgcagtttcagttatttttagcagtgcactgttgtgaggaaaaattacctgtcttgacttcctgtgtttatcatcttaagtattgtaagctgctgtgtatggatctcattgtagtcatacttgttttccccagatgagggcacttggtgaataaaggatgctggggaaaactgtgtgttatattctgttggcaggtagtccggtgttttggaaagtgccagcagggaaacttggggggcaggaaaaaactt

SEQ ID NO: 610264 - DNA, 176 bp, Homo sapiens
ttttttttttttccccccccccccgtttggggcgggggcctttccccccccggggggggaaaaagccttttttgggcccccttaaaaaaacccctttttcaaggggggggggggttttttccccggccccctttttccggggggggggggcccctaaaagttttttttccccctga

SEQ ID NO: 610265 - DNA, 129 bp, Homo sapiens
ccacgaggacccggtaacttcaagctcctaagccactgcctgcgtggagaccctggccgcccacgctccccgccgagttcaccgggtgcgttgcacgccgtccctggacaagttcctggcttctgtggc

SEQ ID NO: 610266 - DNA, 336 bp, Homo sapiens
cctagggagtcaggctggtcaccgagtgtcacacaggtagggggcgatcatctggacagagcttgtgggcccagttgtctagtgatatcttgtctgtcacattccccttcctgggtctctggcatgtgtctggcccagatgaagaaattctggtctagagacgcagagcagattatgtagcttagtcctcggaagttggcgagcccaggtctgtctggcttacaaggtcctccctgcgtcgtcctgcgacgtatctttagctgcatgttaaccatgctttgggtgcctccattatcctcatgtctttagggaattccctgtccggttgagcggaga

SEQ ID NO: 610267 - DNA, 151 bp, Homo sapiens
  misc_feature (81)..(81): n is a, c, g, or t
  misc_feature (133)..(133): n is a, c, g, or t
gatgcagatatttgcacaatggttcggcaaaagcagaacaaatatccgatactatttttaactcaacggaaaatctgaganttatcctagaacttccaatgggaccttcaagaattctccgggacaaaccccnccatttggcaatggaagg

SEQ ID NO: 610268 - DNA, 1491 bp, Homo sapiens
  misc_feature (405)..(405): n is a, c, g, or t
  misc_feature (410)..(410): n is a, c, g, or t
  misc_feature (531)..(531): n is a, c, g, or t
  misc_feature (538)..(538): n is a, c, g, or t
  misc_feature (550)..(550): n is a, c, g, or t
  misc_feature (580)..(580): n is a, c, g, or t
  misc_feature (610)..(610): n is a, c, g, or t
  misc_feature (1491)..(1491): n is a, c, g, or t
ccggccggtcgcccatagccagtgcctccgtcacctcttcatcgcaccctcggactgtccgcaaggtgccccgtgcggcggatcctaggcgtccgcagcagtacagccggcgctcgccgccgacgtctccgttagatcgccgacctatgacgaccgagatgcgaccttcgcataggtgcgccaggaacttaccgaccagaggacttcgataagagtccggtacattcaatgctggcacgcatcaatacccttggcatgccttcttatcggcgcttccatagcggatctataacgcttgttcacaaatgctcgtgttacgttagcatttctgcaactcgactgaagtagcattcgctaggaccatatgtagaagatgatagcattatgcctcgatagagtagcttnttgcnttgcgagcgcaaaatcgtgcattgtacggatgatgcgcgaacaaattgcttagaggaatacatgattcgaaagcttggcaagaaaccctagagcagtacgtgtggtgcactgataatcttntaccatntctagggaaatntagtggaaagcaaaacaccaaaggactttntagagatgacataggagcaggagacagcgngagtaggagagtgctcaccatgggcagctgatggagattagacatttctgtggacacaatccaaatggtgcagactctgagatcggacctacacttgggttatacctgtgtcaacataagacaactgggggttccacaacattgtactggaaacaccaaatgggtaatccaccacgaataatgtgggatcggttggaattgttcccattttgagacgggaacgtaccggattttacccgtaggcgactatacggcaggccgagagggggttcgccaatacaaggcgcccgattcccaattcacggcgacacttcgcggggcggtttgaaccgccaacgcgtttgtagcaccaacaaccttttgtcccagccaaaaggacatcgccgggatggcagcccactggcaaaagtcgtgggcgccttagcagggcgggaggacagctcaatcttgccttcttaggaaggaaagccttacacaaccccctttgggaggtaagacaccacgtgttggcattccgctttggacaaccggccttaacgggccctgtccgggggacccttaaactatacccgcgccaaatatcgccccagctggtggtggggtgaacatcacatccacggggggagacgacaccaaaagagggcatagcgggccatagggcagtggaatagggggaggaaatcgcccgagaaaacacggaggtaatcggcacaggaaaaggtctgggagccaccgagggaaacaactttcgcaccatgttaccagtcttctacttagcgaggcgcgtcgagaggccaccgaatcccctcttagagacgctacacacacagaactgtcggcgggcccccagccagagcagagaccaaaacacagtgcagacn

SEQ ID NO: 610269 - DNA, 969 bp, Homo sapiens
cttctgccacacctcgtctctcagttctctcgcacatttccatagagaccgtgttggtttgttgttcacccgggcccccgcgtcttccatcacctgtccccccatttataggcattaaaatccactgtctgccagtcgctcccttccctcccacctgttattgaggtacattgtgagtgtaagaagaattgtaaacacagagaagagacatctgttactgagacctaacgtgtgggtgctagtgcacaaggcagagaaagagaacaacctcgtagacatctgtattcctgatgtgtggtgtatgggagctatagcctgtggcggttggagggctctgtgaggcgacagcggagaaccaagcatcttcgggagcagcagtgtgtgccctcggctgccggtccctagctgccgaagacttgcatacgcgccgatgctcgcatcgtggaggcgcccagtcgcgaggttcgcgtggggacctggaggcgcggagttggccagtccagtagcctggttttctccggcatgcatttaccagggcccaaaggggtggcgtatcttactcgcttccatagtttatgcctatggtgacagtcgacctgacaaagggggacgcgttgtatttttgctccctgaagtatgggggtgatagtctttggcttaaatacgtctttcaacgtatgcaccacaatatccttacgatgcgtataaattacctgtgcaggccttgcccagtactattaaaacacaagacggaaaacacgcaacaaggaaagatccacactgaacagaagggaaatagctcggggggcagcgaccttccctttcaaagatgcctggcacgctggcgggccccaattacattccgttcactccaaccacagatctgggcaggttcttggcttcaaccaaggttgggcaagtataacgtccccacgtgccccccaatcatctcgcctggtgaccccggga

SEQ ID NO: 610270 - DNA, 195 bp, Homo sapiens
  misc_feature (151)..(151): n is a, c, g, or t
  misc_feature (173)..(173): n is a, c, g, or t
cggagtgatggcttgatcccggctcactgcatcctctcgcctcccaggttcaagcgattctcgtacctcagcctcccgagtagctgggactacaggcatgtgccagcatgcctggctaattttgtatttctagtagagatggggtttcacncgtgttgccaagcgctgatccncaaaactccgcgacctcaggta

SEQ ID NO: 610271 - DNA, 867 bp, Homo sapiens
cacacgggcccctgagggtaccaggagctggaggccccctctgaagataattcttggaagaactgccccagcagggacctcagtgcatggcccagccagtgctgcccactgacagcgccagccgaggtgagagtggccgtgggtccccgcatcagtgtgacttgtgtccccagcccctgccacaattggtgggacatgcttggccgggcggcacggcacgtggggttcggtggctttagttttgggccgggtcctagggggggggagctcgtgttgcatgtgtatgcgtctgctgctttgttgaacaccgcgccgtgcttggctggaccgttcttcgcgagcggcctgctgctaagcaaacagcacatatctatcacaagaacagaaagagacagcgatgggaacgacgaggcaagacgaccacgagggaccgagagtagtacagggcaggcggacatctgggcccagacaatcgagaaacaccctgatgtgaaacacggaccttcaatacaaacaacactggtacccgggagtacccagttggattcggacttcaactgaacagggggaccaattcgcaagagacgaaccttcattagtaggtaccggaattgtggtgtccaccccctggctccctaatgcagcaagcctgggaaccccatggtcgcattccttgaaccaggcgtacattaccatgtactgggagacagacactggcctagggacatgggaggtgtgcttggaaacccggcggagaaatgagaagtgacagtatgtcctgccaggtaaacaactgtgtctaacgacccgtgccatgatgggggcatggttgtccatggggtccgaccaactggtaggctgcacacg

SEQ ID NO: 610272 - DNA, 349 bp, Homo sapiens
  misc_feature (140)..(141): n is a, c, g, or t
tttaagataccaattttgataaatttcccacaatggggtctggggaagtaagttataaaataagccatatgatccagcaattctactcctgggtattttcccaggagaaataaaaatgtaagtttacaccaaaaacttcnnaccacttgttaaagcagcattatctgtaatagcaaaaaatggaaacaacccccaaatatccaacaactgactaatgaataaataaaatgtggtttatccatacaatggaatgttattcagcaataaacaggaatgaagtactgatatatgccataacacggatgaaacttgcaaacattgtgctaaataaaagaagtcagtcacaaaa

SEQ ID NO: 610273 - DNA, 159 bp, Homo sapiens
  misc_feature (18)..(18): n is a, c, g, or t
gacacctacgacgatcgngctacagcgctcggcgcggcagagggtcccgcggcagtcaggtggccatggttcccgtaggcagaaggagttgcccacagagcccccttacacagcatacgtaggaaatctcctttgattacggttcagggcgacacggat

SEQ ID NO: 610274 - DNA, 160 bp, Homo sapiens
tgataagtgaggaccagggcgggctgggagatggcagctctagatggggctgtgtgatttggagcaagttccttccttctcagtgccttagtttcgtcatatacatggcaatacgctggcacagcacaatccgaaggttccctccagcatacaaattctc

SEQ ID NO: 610275 - DNA, 233 bp, Homo sapiens
  misc_feature (79)..(79): n is a, c, g, or t
  misc_feature (209)..(209): n is a, c, g, or t
tccttagtcaccgcgtcacaaaccgcactatattggtgcgatagctgcacccttctcaattgcccagcccattttggtncgaaacttcccgttgaggctggcagaacgccacagtttcgcgcctgaaacccttatttcagggcattagcgcttcttttcggagccctggtttggtttttgcattttccttgtatcagcgtgtgcctcangcccgcgccacgcgattaaactat

SEQ ID NO: 610276 - DNA, 185 bp, Homo sapiens
cccccccccgggggggggggggggggggggaatttttttggccccccccccccggggggggggggtttcccccccttttttttttggggcccccccggggggggggtttttttttttttttaaccccccccccccattttccttttgggggggggtttttgggaaaccccccttttttttgggga

SEQ ID NO: 610277 - DNA, 113 bp, Homo sapiens
tgagctgcctacctttagttgtagcaggaatcttcttactcatccgttccaccccctaacagaaaatagcccactaatccaaactctaacactatgcttaagctggatcagct

SEQ ID NO: 610278 - DNA, 410 bp, Homo sapiens
aggaagaagaggtagggttggtaggagaaacgcgatcaaggttgtaataatgtgatggatgaatacaggttagcaagaacagcagaggtcgtgctgtgatctgagtgctaaatggcctggacagaaggacataaggaatctctccccatttctccagtcgtcggaaataattgcttaagtcaggtaaaactgtaaagtcgaatgttccatttgcgggccatttggacccgttatctagttggtactgtggacagactgaattgaataaatagacaaggcgcttagggcgtgatatcttgcctgaggcctgaggtttgcaggtttttatgaggtagcctatcgggctgtcctttggaaaggaagactgagaatttcccataagagggtaggctcaggagaacagggaaaag

SEQ ID NO: 610279 - DNA, 551 bp, Homo sapiens
  misc_feature (138)..(138): n is a, c, g, or t
  misc_feature (143)..(144): n is a, c, g, or t
  misc_feature (148)..(148): n is a, c, g, or t
  misc_feature (155)..(155): n is a, c, g, or t
  misc_feature (161)..(161): n is a, c, g, or t
  misc_feature (163)..(164): n is a, c, g, or t
  misc_feature (173)..(173): n is a, c, g, or t
  misc_feature (176)..(176): n is a, c, g, or t
  misc_feature (180)..(180): n is a, c, g, or t
  misc_feature (188)..(188): n is a, c, g, or t
  misc_feature (198)..(198): n is a, c, g, or t
  misc_feature (200)..(202): n is a, c, g, or t
  misc_feature (206)..(206): n is a, c, g, or t
  misc_feature (209)..(209): n is a, c, g, or t
  misc_feature (212)..(214): n is a, c, g, or t
  misc_feature (219)..(219): n is a, c, g, or t
  misc_feature (221)..(221): n is a, c, g, or t
  misc_feature (240)..(240): n is a, c, g, or t
  misc_feature (244)..(244): n is a, c, g, or t
  misc_feature (249)..(249): n is a, c, g, or t
  misc_feature (415)..(415): n is a, c, g, or t
gaaaattagcaattaatcaagggatggaggtcgatttagtaacagggttagccatagaagaagcttgttatgctcagaccattccaacaaaagacagacttgaaggtcttcttgcttttaaagagaaaaggccccctngctannaagnagaatanaagggncnnaaattcttnagntgcnatgtaatnaatgtattcncnnnagtntcnttnnnatccncnatatgcctcagcacatggnaccntatgnccaatagtaacagcagtatagttcatcgggtgtaataagcatctgtaatggacccatccgtgtacttcattcaaatgtgttaatgtcatattcattcagatttatacagctagtagtgtatagtcagaaacagaatccaagtcagatatacatttttaaatatttnctgcatatgaggctttctgttaattttttaatgtgaataatttatatattgcacattctagggaataatattgattgtatgtctactgtgctgcattaagaaaataaaatttctatataccaaaaatgtgaagtta

SEQ ID NO: 610280 - DNA, 319 bp, Homo sapiens
  misc_feature (138)..(138): n is a, c, g, or t
  misc_feature (143)..(144): n is a, c, g, or t
  misc_feature (148)..(148): n is a, c, g, or t
  misc_feature (155)..(155): n is a, c, g, or t
  misc_feature (161)..(161): n is a, c, g, or t
  misc_feature (163)..(164): n is a, c, g, or t
  misc_feature (173)..(173): n is a, c, g, or t
  misc_feature (176)..(176): n is a, c, g, or t
  misc_feature (180)..(180): n is a, c, g, or t
  misc_feature (188)..(188): n is a, c, g, or t
  misc_feature (198)..(198): n is a, c, g, or t
  misc_feature (200)..(202): n is a, c, g, or t
  misc_feature (206)..(206): n is a, c, g, or t
  misc_feature (209)..(209): n is a, c, g, or t
  misc_feature (212)..(214): n is a, c, g, or t
  misc_feature (219)..(219): n is a, c, g, or t
  misc_feature (221)..(221): n is a, c, g, or t
  misc_feature (240)..(240): n is a, c, g, or t
  misc_feature (244)..(244): n is a, c, g, or t
  misc_feature (249)..(249): n is a, c, g, or t
gaaaattagcaattaatcaagggatggaggtcgatttagtaacagggttagccatagaagaagcttgttatgctcagaccattccaacaaaagacagacttgaaggtcttcttgcttttaaagagaaaaggccccctngctannaagnagaatanaagggncnnaaattcttnagntgcnatgtaatnaatgtattcncnnnagtntcnttnnnatccncnatatgcctcagcacatggnaccntatgnccaagtggagggcggtttttcatacggggtattggctcttgggatgggcccccccgttattcattcaaag

SEQ ID NO: 610281 - DNA, 391 bp, Homo sapiens
  misc_feature (375)..(375): n is a, c, g, or t
tataaatctaatcgttctctgcaaaatacctagaaaagtgatgctgaggtaggatcagcagataatgggccatctttttttaaagaatgttgtattcagttaataaattaattgtaattctacacatatataatgagttcagaatttttaaaaattcgggggaaaggccatttatttagcaggtttttagagctaatagttacctccagtctgagctgtccttaactatatcccggtcttgtaatacacactatttcatcgctctgtagtgagaggagagaggcacacactctcttgctagttcatctgcagcacataattattatgtctgatgttgactcattgcagtttaaacatttctcctcgtttgcaccntcagcagaaaatggaa

SEQ ID NO: 610282 - DNA, 342 bp, Homo sapiens
tgatcattccaaacgggcacgcactgacgcaactctgacagccaatacaacgggcagaattggtctgcaccacctgctcgcccatcgtcagcgcccccacggggcaagcgccaacacaaggggcgttttcacactgatggcacatcaccggcgcactgatgctgtccagtcgctgtaccttcagccggggtaaaaagacatcggcattcaactcctgttctgaagggtgagcgaccacacaggctactttcacaagtacgggcagccaatacagtcagccggattaacgataattaacggtttcatcacgatgccttcgtatcaaacagagtttaacatatc

SEQ ID NO: 610283 - DNA, 86 bp, Homo sapiens
tccttaataaaaaaaaataatttattggtcaaccaaagggtgatttatacaacaggaaaacagatgtaaatgaaaacgggagtaga

SEQ ID NO: 610284 - DNA, 110 bp, Homo sapiens
tacgtatgggtgtgagccaagtacagccactcttcaccgggctccctgctctgggccctgcaccagagctgccaccctcttcccagccctagccctcttccccagcccag

SEQ ID NO: 610285 - DNA, 912 bp, Homo sapiens
ggaaggggacgccgggaacaggaatttcttcacatggctcctggagaagtgatcatcacagttcgcctcatccgttcctttgaacatcgcaatttcaaacctgtagtgtatcacggagggactctggacaagactgtacagggaatttatcgtattctaaagcaagatatccctttaggaccaaacctgccacgcaccattcagaacattataaatatgatgcactacagattattcatcaggcacataattcacagacacgatgcagctttgtgtggagtagcaagatgacgaaagactccggctgaaagcaagacagcactctgaaagggcagctggagtcgccagggaacctgagactgtgccttccttctgtgaggcacgcattataaagacctaacaaaagctaattgcccatttacatccctgttgaaaaacggtctcgagggcttccttttggcatacctgtataacgcttctttatcccaactgggaattttcgactggacacccaacttcttagaaaattaaatcccaggctatactctttgagctaaaattctggttatgacttctcctcagggtcttacctgtctctcttactttcctaggtgtgtacactgagtattactgagacaacccttgtgccttctcaggcactacctgttctacaactaagcacgagacacacaaacaaacatttggggggctcgcgaccggaaagtataaaatgttgggggccgccccaagttaggaatttgcacacggcaaggacaccggacgaaacgtgggtccacaaacaacggggcgggcttaacacaggtctggtcacggctcacggcggctcaccccgccgcaaaaggcagcacaagcagcagggcgacgcagacacgcgcggacagcagctccaac

SEQ ID NO: 610286 - DNA, 833 bp, Homo sapiens
agactggataagtcgtacaggtacttcaataacatcaacaggcttgcgaaggagttccccttggctcaccgtcagttagaggacgataaagtcactgtgtggtgttccaacgattacttggctttgtctaagaaccctcaagtcttggacgctatgcgcaagaccatcgacaagtacggtgctggtgcaggtggtaccagaaacattgccggccacaacattccaaccatgagactggaggctgagctagcggccttgcacaagaaggaaggtgctctagtgttctcctcttgttatgttgccaacgatgccgtcatctctctattgggtcaaaaggtgaaggacttggtgatcttctccgatgaactaaaccacgcctccatgatcgttggtattaagcacgccaacagacctaagcacatcttcagacacaacgacttggctcagctggaggagatgctacagatgtatccaaagtctactccaaagttgatcgctttcgagtctgtctactctatggctggttctgttgcagacatcaacaagatatgtgacttagctgagaaatacggtgcgctaactttcctagatgaagtgcatgccgtcggtctatacggtccacatggtgccggtgtcgctgagcattgcgacttcgaagccaccgtgttgcaggtatcgccaatccaccacaaggtgaccacggtagactcagaaccagtcatggacccgtgttgatatgattacggtacttggggtaagtccttcggtactgtaggtggtaacgtcgctgtttcgaacaactactcgactgggttagaatcttacgccccaag

SEQ ID NO: 610287 - DNA, 964 bp, Homo sapiens
gcaaccatagatcagttatcttatgacaacattaggcatcaggctctcttggaataagatcaaagtgtctcttatcacttgtgattcctactttggttattgtaagccgatctacactttcagtggccgacagaaaacgagggacaatagctgtgcatcacaaggcctaggaggctgtggtccccactggggctgaagagaagcccagtctgcccgacgcggtagccaggggtggcagctgtgggacagccggggagcgaggacagcggtctgtccttcacaggttttactacttgtgtttctcgctggagaaggacaagtgattgcgcatagcgtttctcttacccgagtatgaatgattatagatttcgtgaggcatgttcttgataaacaaaaggctatggttaagtactcggagaggcagggagctaggccacaagcacgggcatcacatgtggtgccgaattcctcgaaagcgtctgggatcaggtattgccagaaggggggctgttggtcctccattcctcgtatgtgccacgaggtagaggaatctcgtcctgcgggggggccgcaggccatctgtattgttatgcaggacatgtatttctcaatatggccctgtaaaagctgtgcccaaggaaagaagcagtctgcctgaaaagagcccggggctggctcaaggacatcgggcccagcgtcccctccgggaggccagctgaggaacaggccaggcgaacggaaggaaggaaagaagggtataaagaacaggagacgcatggcgatcacagctattaaaacggacaaggcaccaaagtcggaggggcaaacctccaaagaccggagaggacgtggagaagaaacacttggacaaaacgctacagacaccgggcgaccggcaaaaggccaagaaaacaaacggagaacacgagaaaccctgaagaaacacataggaaatcaaacacat

SEQ ID NO: 610288 - DNA, 116 bp, Homo sapiens
tcaaatagtcttcaatataagttacaacttgattagagttgatagacattgtatctatttaaagacaaaaaacttcttttatgtacaatatcttgtctagagtctagcaaatatag

SEQ ID NO: 610289 - DNA, 1352 bp, Homo sapiens
  misc_feature (253)..(253): n is a, c, g, or t
ggacagttgagcggggttgcggagctccttgggctgcgagctccgggagtcttccgaggttcggtgcgcgtctgggtggcgagcggcgtgcagtgttctcggtcagggatgcggagcagttatgctcgcagcgcaggccagggaagatcgcaggagcgatggcagcgtagacacgaagtatctggttccgcggatcctgtaaggctggctgcagggcgcgacggaccttgcgggcctggacagcgcctccgancgtcccatgcagacgtgcatctatccgatcagtcaatctcaggccagcgaatgtacaagctcggaaggcatggagaagacagtgcgtaggacctatggtgcaaggcacagaccatctggcctgggccttgcaatgccccaggaagcaagctccgaggtggctgtgtgcggcccgcccatgcctgccggagatgattgtcaccgcacgtgctggcaccagccatacatggctgggccctcgggggacgctagcatcgtcgaggaaatcgagctcgggcaggcggtagtcgctggtggggaactcccggtttctactatgggcccaggggttggaccaagaaaaacgaaggaagcgtgcagtaggccgtgggggccaaggggcgtaggctatcggacgcggcgtgggaggaagcacgcgacaggctcctgaagtgggaccccaagcccctctagaagcgagacatccttgctcctcgatcagtgtgtgccaagggatcaggtgcggtccgtgcagcccccggggggcagtcgctaccagggggaggactcatgggggacatgccctggggacaggagaagcgggagtatgctcgcacgtgagcctaggggctacgcacagtccttccatgcgaggggctcccaagaactccaggtgggcttcattcgtccaaaggccaagggcccgggcaccggggcgcaccgcaaccgaaggttgggcccgggggcgggaagccacacgaagatccggttgcagccggggtggctgctcccacaggggggccacacgcgggttcgcaggaacggaccgctggggggtggaaactggaaggagccgaaataataaaggcgaatgagggggcgttggctggttggacacaagagggcctccgagggggccggggacccctgggggcatcacatgacagggcagcagcagagagtggcacgcatcagtgggggatcacgccggcacactcagcgaggggacgctgggcgccccgcaacaggtataaagggcggaaggaatagaacacatgtaaaagacagaggccgagggggcgagccacaaaagacgggcgaggggagagagcagagcgctg

SEQ ID NO: 610290 - DNA, 167 bp, Homo sapiens
gcagcttcctttactgacgacaaccaatcagcattcatcctcctggggtggcttgagccccacaagtgaggtagattcccaacattacttaccaccaacaacacagcagcacgtatctatcgcaggcgagaataccctttcatcatcaacatctctggtcacctcac

SEQ ID NO: 610291 - DNA, 308 bp, Homo sapiens
ggtttttttaccccccgggtggggcggtttttggggccgggttcccccacctttttttttttgggccccctggtggggcagggatttccgggcctcccccgggggggggccccttttatttttttgggcctcccgattggttccctttggttgcccccctttcgggttttgggtgggggtttttgggctgggggggggggcccccattttgggggcccgttttccccctttttttttttggcccctttacccgggccggtctttttttttttgttttttttaccccccgggtgttcccttttttttta

SEQ ID NO: 610292 - DNA, 258 bp, Homo sapiens
catatgctctggatacagctgtcatcattaaatattcaaataattgaatagactaattagacctttctcatcctttccctttgtcttctctaccttctctctcaggttatctttccccatccctgttcctcccaccgtctatatctgtatctaccacatgcttctctgtctcgtttctgactccttttatcattatctcctgttgaaagtggtgaacaagagtaagaattcgcccttaagtattgcttggtgtggggc

SEQ ID NO: 610293 - DNA, 207 bp, Homo sapiens
gcaaagaggttggagatcaaggggctccaggacatattttggagaagactgtggtaagtgtaaaggatgacttctaattcttagcgtcacagtgggacgggaaaaactgcccaaccttaacttggagacacgggactgtagaatgtgaagagggaagtgaagacgatgaatccctccgagaaatggtggagctggctgcacagagac

SEQ ID NO: 610294 - DNA, 125 bp, Homo sapiens
ggaggagcaggagcctccgcgcaagcagatactgacggaggagaacatggccacccacagcccacaacacagcctgcacaaagaccacccccacagcagcccccccaagacctcaccccactccg

SEQ ID NO: 610295 - DNA, 253 bp, Homo sapiens
tttggttgtaggaaaacttgaaaattccaaaatccttattttcctatttgagaggctggttcagcagggtgtgtgtgtgtgtgtgtgtgtgtgtgtatgaatggtatatgtattccattatcttcgaagagaatgagtgagtttcgtggataattttttatacagtctacgtggatctttctcattggccatgtaggtaagattcttgaaactcaggtctttatcaaattattttaaattcatcaccatttaa

SEQ ID NO: 610296 - DNA, 273 bp, Homo sapiens
caagatccgagagctcgacgaaaggcttgtatggtatgatggttatatgaatgtgtataatgtgcctagaaagagcctgtagtgaggagagagtagctacgagtcaggtgagtagtcctgcaggaggaatgtcactgtctgtcggctcatatagcaatggacagatagagaaggagtagatcaagctattgttatgcggaagcaatcgggccgatatagggactatcagtgcaagctcgatatatggatacatgagagatatacaatgatgtc

SEQ ID NO: 610297 - DNA, 421 bp, Homo sapiens
agggtaagagggcaagctagcgcgtcccacaatgatttcctttatttctcgccatccgaatatatccttcttcaccaaagttgtggccccagctgttaatcacaagccagtattcttatcccattaagatcaccatagccagacgtcatcattcacagttggagcagggagaggcagctgtggctaacgggaggtgacatttccatgtcaacatagtccaggtaaagttagtagagtatcaaatgttaaaaaatgctcatcccagacctttgggcgtgactaaagagttgtttcatatgtcttcggtaccctcagtaacacctcccaacccccaaatatcactttccttcctgcacacatacattaactcttttgtttcttacatatttcatttacataggtagggattattacattctac

SEQ ID NO: 610298 - DNA, 158 bp, Homo sapiens
cccaacgctgcacgcggttcaaatgcagcgattcctgaggacgcatcctgaggagagtggcgatgaggacgaagcacgacctagggggggcgcatctcgatctgctctctgacaaacgaattgctgtgaggaagagttctccgattctgaaaaggagg

SEQ ID NO: 610299 - DNA, 278 bp, Homo sapiens
acaggccagcccagctgcacaaggactgaacaaggagctgtctcattgtctccatgccggaaatcgagagaaacctcaacatcactggctaccaccaactcttgctgaaaagcctgaagctggccaaggccaatcgaatgctgggagcatgagcactaggagcgcgaggctgagaatggtgcgctacctgtctgagagcatccccacgctgcacacccttggcctgtccctgagtgccctgcaggacctgtgccaggagctgcacgccaaggcggtgg

SEQ ID NO: 610300 - DNA, 198 bp, Homo sapiens
ttttacttcctcccaaataaaacctaacttttttaactaactatttaagacttggaatagtccgcttgattaaaaaaaggggaaaaatgtttgtaaattcccctctaatgggactttgattttactataattcagcagaaaattcaaagcgctgtgatttttagatggccctcccataaaacagtcccggcattggca

SEQ ID NO: 610301 - DNA, 320 bp, Homo sapiens
tgttgtttgtcctaagtggtgttcttgcttgcgcgttgggacatcactttttggctattccccgacttgaagccaggtgtattgaaatctgtcactcaccggttgggcgcatcggcccatgctgtactccttgctgtgtgggaggccgaggcgggccgattattgaggttaggagttcgataccagcctggtcaagtatgatgaaacaccgtctctactaggtcctaccaaaattatgctgggcgtggtgacacactatttgtagtcccagctactctgggatgcttgaggccaggagactcgcttaaacccaggaggcg

SEQ ID NO: 610302 - DNA, 377 bp, Homo sapiens
  misc_feature (12)..(12): n is a, c, g, or t
  misc_feature (292)..(292): n is a, c, g, or t
  misc_feature (352)..(352): n is a, c, g, or t
ctgggaggcganggtgggaagatcgtttgagcgcaggagttggagaccagcctgggaaacacagtgagacctcgttccaaaaaatttttttttaaaaaaattagccgaccgtggtgaagcgcgtctgtaatcccagctactcgggaggcttaggtgggaggatcacttgatcctggggagtttgagactgcagtgagccgtgatctccgccactgcactccagggttcggcgacacagcaagaccctggatcccctattcccgttttccccgcaaaaaaaaccaccaaggtnggagttaaggggaagttaagttttgagggattcaaaggccacccgtttcccattgctttnaggaaggcatttttatttcttgcga

SEQ ID NO: 610303 - DNA, 165 bp, Homo sapiens
  misc_feature (102)..(102): n is a, c, g, or t
ttttgactccagcatctgtctcactgctgcctgcatatctgtaagacatgttattatcgctgttgacatcatttacagtttttcctggtgatactggtgggntgggtggatgttcatgtctttgtcttaagatcttctctggctgcttcaaagcgttgggttaac

SEQ ID NO: 610304 - DNA, 452 bp, Homo sapiens
tgtcagctgcctacagtttaatatgcagcgttcacaaaacagctgccagtgctacaattaatgaagcaaaacttaatatgtaatcacaatctaaattagcatcaatactttgacattcattacattggtttgggggaagaaaagtagttctggtatgtttcattgatccccagataccttccaatctggacatgatggggctgattccagatggttcttctcacacttcattcaggtaggtcagggtccctcgtgtatggccaggtaacatatattcaccgtgcccagcagcagaggcatcggttggttcatgtatgcccatgttccgagtgggtggcaatacctcaagcaggtaaagccatgtcagtttttcctaggcagtttggcatttcaaacttcagacagcccagtaatgtaatgatgtttccactgtttgagtttaagatcgtgtt

SEQ ID NO: 610305 - DNA, 439 bp, Homo sapiens
tttttttaaacttgggttccttccccttttcagcccccttgggttcggggggggccccctcctgtgcccttgtttggaaccccttggttttcggtttttggaaattggtttttggaacccttttccttgtttccgggggttgggggttttattttggattttcctttttcccgcccccccccattttttttttagggtttggcccgggggggttttttgaaaaccccgtttttttggacattgggggtcaaacccttttgtttaaattttccctttcccagggccccccgggggttttcgggcctttttttcccttgaattgaaaagggtccgggggcaagttgctttgggttaaccccccccaggttccaaatttcccttttccaaagaaatccttattccttttttttggggaattaacaaattaaaccccccttta

SEQ ID NO: 610306 - DNA, 1605 bp, Homo sapiens
tctctggtgatctagggatcctagtacaccgtcacatcatagtctattatgtccatataagcgtgcatgtgggcactgtacataggtccatgtacatggggaacgaactgtgtggccatcggctgacagatcaggctgcattgcgggatccattgcccagtatggtgatccacctgagcttcgcagaacgatcttttcccagtgggtagaccggtctgataacatcgagtactagatcgcgggtcttcgtccagctttgactgttccatgatcaagttagctcgcgagcgcctacatcgtttccgtgctgatatccttgtattgaggttagaagcgcaacagtgtcaggcgtagatccacaccgctttaatcacgcgcttctagtggagcaattcgcgccggccggaacccgtcgtctggtagtgatgaatactcgggtttggagtccttttgacgttacgatcctgaagcactaatgtacattttagccccgtggtttttgtgacccactggatagtgacctcgatctctacatcgccccttatcatttttgtgcgtcctctctatgagcgcatccatatcgagttcgatagctcgctctattcgcgtatcgatcagttgcagctcgagacgatattactcgatagcgagtcgatcgggagaagtcctatcaccttggacaggccaccaggaagaagccacagactttgcgtttagctggtggaaccaattaggttggatttggaacggtttcacccccattagctttgccggcgagcagggacaccgcgaaaagccaatttggtggtaatttcgccggcgcacattcaaggcgccgttggagtaattttcgcgacacatctccaatttgcttttccccacaaaagtgcccctatttgggcatgtgggagaactcgatcttcgcgttggcgacaaccccccgtgggtgaccttggcgcaatggtaggatacagagccggcgcccatattgcgggggaaagggcttccaactgtgtgggtatcactaaacacaatttcgacacgttcgtcacggcaacacacgggagaagcaagtgaagagagttccacccccacatcgtccaccgggggagagcaaaccattggcagaaagtaggggccccacgataaacattttgtgaaccattaaagccccccttgggttttcccgctcggaatgaaaagtccccccacccagttaaaaatacaggtatgaccattgtaatgtactatcctatcgaaccaaccattacatcaccaagtaaggagcccatggggtacctttgtgcccaacaaaaataggatcagacacttcacaaataccccatctatcacaccatcttcatttgcattgcgcaccactcaagggtgccgagaaggaacgctcattatgcaatgcaggtggatacactgacacagataaccagggaacgaggaggaactctcacacagcaagaaactcaccatagctgagaaagacgatgtgaatacgaacaactacgtatggtatcagacaccacgattagatagtgtgccgaaaaacgcaccaaccaactatgatatggcactagagacgcgcgatcacca

SEQ ID NO: 610307 - DNA, 217 bp, Homo sapiens
tagtttacatttaacttagtatatagaaacaactgttccttttttgcactcgtagtcattagacatgaataatgtttaagatatgtaagaactataacaagtaaactggcataaacaggtttgggaacaaccaactgacttgttaagcatgtaacccaactagtgagaacagaagtacctgataatacaaaaaatagcatactggttaagaatggtc

SEQ ID NO: 610308 - DNA, 484 bp, Homo sapiens
gaattccgttcctctccagcaccatccagtgaaactgatgaggccccattgatttttactgccagaggagaaactgaggagagagccagaggagcacccaagcaggcttggaacagttcatttttggaacaactggttaaaaagcctaactgggcacactcagtaaatcctgttcacctggaggctcagggcatacacatcagtagacacacaagacctaagggccagcccttgagcagtcccaagaaaaattctggttctgccgccagaccttccactgccatcggctctgcaggaggagccagacgcccggcgctctgcagacaccggcccgagtaacacagagctcgagccggagagaggatggcagtcccagcaggcgctcaggcacaccccgacgacatccaaagcagactcctgggcgcgtccggaaatcccgtcggaaaaggcgcggttgccatggcgccggagatgctccccaagc

SEQ ID NO: 610309 - DNA, 165 bp, Homo sapiens
ctgtaaaatggagctactaatagtccccttctcttagggttcccttaaggagtaaaggagattatgcatgtcagacacagtgtgagtttagaacatagtgttcaatgactgttagctgtgattgattgttactatgtagagtaagtcattcttaaacttttactg

SEQ ID NO: 610310 - DNA, 553 bp, Homo sapiens
  misc_feature (193)..(193): n is a, c, g, or t
  misc_feature (228)..(228): n is a, c, g, or t
gaggtttctgggtgccagtgttttccaatctccccgggccctggggtggcgcacccccttattttgttttgtggcacttcttttcctcctgggtgaacatcacccgggtgaagcaaaggggcctcagtccccaaaggggttttttggacccgcttcctttcccaagggggtcttccttttttaaggaagggtnccccccctcctcccttttggtgtaagattttttantcaagggggggccctgggggctgggttagcctttttttaaaccctgggggccttggatttccgccccttttttcagggtccccaaaaatttgggttttgccccgggggtttttttgggccccctgggccatttggggggggcccttttttttctcccagggccggggtcagttgggggtttcccacccccaggggcccttttgattccccccttaaaaaaaaggggtttcccttttaaaaatggctgggggtagcccccccccccccttttttccccgggaccccggttttaaatttccctgggggccattaatttcccttttga

SEQ ID NO: 610311 - DNA, 103 bp, Homo sapiens
actctgctgtgtcgattccaagccagaaacggcccgcgagagagcatcatgatcatgacctgtcctatcactctcgatagtctgcccgttggggtatttctta

SEQ ID NO: 610312 - DNA, 190 bp, Homo sapiens
  misc_feature (8)..(8): n is a, c, g, or t
  misc_feature (69)..(69): n is a, c, g, or t
tgctgctncaatgttgcacttcgattcatcgcgcgcacgccgctcttcagaaagagatcggtgccttcncgacgagcgagtttgcattttggaccaatgtaacgagccattctttacaatctcctggattacacgcggcgcttcttcggcggacggcacccgttgtgcgggattggctggtggaagggag

SEQ ID NO: 610313 - DNA, 146 bp, Homo sapiens
ggccttcccctcccccctttccttttgggggttttccttttccttcccctttttttccccttggggggtgggtccctttgggccctttccctccctttattttggggggccttttttttccggggaaacccaacccaggggtttta

SEQ ID NO: 610314 - DNA, 224 bp, Homo sapiens
ataaagccaacattggataacatagcactgaaaaaatgaggaaattattaggtaaccaatattattttaacaagcccatcaatttactttctggctggtagcagaagttagacagcgtaaagcttgagaagatgaagggtgtctacgtaggaccacgaaccaatttacgaagaatacttgacagctagaaggggaagttggttcaaaatcacatcaaaaagcta

SEQ ID NO: 610315 - DNA, 98 bp, Homo sapiens
gagattcaaagcttctatacgatagtaccgggacatgagtttaaatcgacgtgttctttaaaatgacacttataaatcctaataaactgttaaactca

SEQ ID NO: 610316 - DNA, 787 bp, Homo sapiens
tcgcctttgccgatccgccgccgtccacacccgccgtcagctcaccatggatgatgatatcgccgcgctcgtcgtcgacaagcgggtccggcatgtgcgggccggcttcgcgggcgatgatgccccccggggcgtcttcccctccatcgtggaggctgccccaaggcgaccaggcggtgatggtgggcatgggtcagaaggattccgtatgtgtggccgacgaggcccagagccaagagaggcatcctcaccctgaagtaccccatcgagcacggcatcgtcaccaactgtgacgacatggagaaaatctggcaccaaaccttctacaattgagctgcgtgtggctcccgaggcagcaaccccgtgctgctgaccgaggcccccctgaaccccaaggcaaccgcgagatgatgaccccagatcagtgttgagaccttcaacaccccgagccatgtacgttgctatccaggctgtgctatccctgtacgcctctggcggacactggcatcgtgatggactccggttgaccggggcacccacacttgtgccactctaccgagggggtattgcccctcccccgagtgcaatccgtgcgttctggaccctcggttggggccgggaacctggaccttgactaccttcattgaaggattcctcaagcgagccgcggctaacagctttgagcaaccacgggccgacgcgggaacatcgtgcgtgccattagggggaccttgtgctaagttgccccggacttcgagccagagatgccacggtggtacagccctcc

SEQ ID NO: 610317 - DNA, 106 bp, Homo sapiens
cagaaccagcacatgttatacaggcttgggtcaatgtggcgggtcagaccgccagtcaccatcgctcactgtccacagcaaaccccccacagtgagtcatctgcca

SEQ ID NO: 610318 - DNA, 158 bp, Homo sapiens
tggtataattatgtatggtcgacgtgtgtcttgtaggatgtccggtccgtgatgtatagagcttgccatgatagggtagtcctttgataaggaggggtggggggcagggagttgaagaaattcccttgcgagtgctgggggatctgtaaacatttcgt

SEQ ID NO: 610319 - DNA, 141 bp, Homo sapiens
gaggtgataagtgcagctctcagatgcgtggagactcagtgtgtggactcggctgcttgagtggcgctgtggcgatggagattacctccaccttaattaatgcgagtaaaatgggtataaaattatatccatacttaacca

SEQ ID NO: 610320 - DNA, 216 bp, Homo sapiens
ggcggagacagatgagcaataactatgaatcgactcttagttacaaattgtgactgtcgcgatggagaagtactatcatatctatgaaagagtgctatagtgtagcatttaacggtcatgagaacgtctccggcattacacgtggtgacttctaaatagctaagtcccatcaggtcgtgagaacgctatctcgcaagtgaggaaggcctgtgctag

SEQ ID NO: 610321 - DNA, 487 bp, Homo sapiens
  misc_feature (325)..(325): n is a, c, g, or t
  misc_feature (338)..(338): n is a, c, g, or t
  misc_feature (354)..(354): n is a, c, g, or t
  misc_feature (360)..(360): n is a, c, g, or t
  misc_feature (372)..(372): n is a, c, g, or t
tggtagtaggaggtatctgcggccaggggcgaggcgtccaggcccgttttgttcgtgaccgggcccatggccaagctgccaggcatgggggaaccgtagccggggtagtgcatcacctgttcgtaggccttgaggtccattttgtggggctggtggtggtggtggctgtggtggtgctgctgctccgaggacatgaggttgttgatggagaacgggtggttgaaggcgtagtggtgttccggcttcaggtgggcctcaggcggcaggcccgggtggtggggcgggcccagcaggtgggccgcggcctgctgttgctgcccggganagggcgccggctntggggggctcagcgcngcagcnggcgtccccttnagctctcctaggaagaaaaataaagcgaaattggtaatgggacgcgctcgagtgaggcgactcggtgcccgccggagtctcggaggccggcccggcggcctccccgagttgagcc

SEQ ID NO: 610322 - DNA, 271 bp, Homo sapiens
  misc_feature (257)..(257): n is a, c, g, or t
cgcatgcacgctgaatgcctgctagctcgactcttagaggttatcccccgccgaaaccagattcactggtgccacctctacagccagtaacagatataggaacatgttaaggaagtcagcacttacattatgaacaattggctacaacccctacacagtatcatttgtgccaatttctggttgcaatggtgatcacatgctgtagccaagtgctaacatgcctcggttcacgggatggacagtcacccgtaccgatngcaatggggtatct

SEQ ID NO: 610323 - DNA, 1110 bp, Homo sapiens
  misc_feature (1110)..(1110): n is a, c, g, or t
cggtaaatgaagtggcgagaaggacgtaaacgtcgggacaagttaagtgggaatatagcatctatttcttgatcagcacgcattgccggttcacatgtgacggatagttgcgtctcaggatatcaattaccgaccacatcggcgtagaacgttagcccgccccggacacaggcagtgcaatacgtagcatcatttcgaaatgcatctcacatgactccgctttgtggcgcagcgagccgtgcatctcgaggacaggcatactttgtatccaaactatacgtatctcgcaataatatgatctaaggatcaagtaagaatctaaactccaggtcatattctgatcccctcataagatcctaccatcatagattcaggtatgcccgttgtatcgctaagacccggactgcccggtgcaaggccgctggacccatgcatctgtgtaattttccaaacagttagtgagcgtttgcctatgaggagtgctcggcggacactcggatcctaccgtaccactccatttacctaacgctctagggtgcagacgctagagcaagcataagtcatggtggatgtatgatatagccactagataacgtgcctagtagcaatcggctcatagcagtgatgattcaacgatcacgtggcaaacttaagggctcaattcatgaatataataacacgataagatgtgtcgacacggtgtgcagcacagagcacgtgcctgtggatctatcggtcgagtctgtctcacccagttttagtgtttctgccccacactgccccacccccattgttccgccgaccatgtacactttaatgtcgtcccgatttacgctaccctaggaggcctggacgcttcccggacggatgacgacgccgggcaaggtcagaggtggataacggtagtattgttctatacttccgggtgtgtcctggcgagttccgtgcggtgtattgcagtaccatatcaccattacgtaggcgcggcgtagtgcctccacgtgcaatttttagcccgcttttcactcctccgttccacgcaccccttatcatctccagctctatacccctacccccctggttcttctgctcatcgtggcatggcaggtn

SEQ ID NO: 610324 - DNA, 883 bp, Homo sapiens
ttttgcccgccggtcgtcagagcgtcctcgttttcgcaggggtctgccggggggctgaatcgctttcttgggggaatccccgtggtgttttcatgccgttgataggtcccgcgccgtgttgcgaagtgtccccccgttgggtggagagtattgtcccccgttcccggatggttgctcacagaagggcctgtttcctctttctgcgtgggaggcctcgggcgctccctaccgcgcggttttgtctagaggaggcttctgggccacaccccggggggaccggttgtccagcaatgcggcgcgcttgtgtaggcgtgtcgcgaggagggcccccgctggtttgttgaccagggggggtttgcggtacgccgtggggggtggagcacccgcctgcctggggtcacctgggcccctgatcgcgtcctgccatgggctgctgagtaagtggtcccagattccccgccccgaagctgtgccgctctgggaccccccgactggcgtactttcgtcaaggagaatgtgtttctgcggacagcccccttggttgtcacccggttgtaggcacagtgtcgccccgcgggcaagaattttcagacgcacccagtgggaccaaagtcagatggtgtgtagatacacacgcagctgtggagagggcggggcgtttcgtaggtcgatagtcacgctggtgtgcgcgagatcagaagaattggctgtagctgtgagccccggcgcgcccctgttgcccccccagttactgggtgttgtaatacaacgagtccacataaatttttcttcgcgaagagaaataattcgccgcccacgtttgttgttgtgaaccaaagtggaccgttggagaaaaaaccctactttttttaaacaaaaacga

SEQ ID NO: 610325 - DNA, 148 bp, Homo sapiens
ctgatgacacccgatatctccggcgcgagcgtgttcgaggcggccgctacggatgtcgcatcgacacccgtgatcgtgatcgacgggttgttccaaatccgactgaggatcgtgcccgtaccgaccggctgcacccccgccgggagac

SEQ ID NO: 610326 - DNA, 214 bp, Homo sapiens
  misc_feature (1)..(1): n is a, c, g, or t
nagtggtgcagaactagctgtatagccagacgtatttgaggtagcagggaacagagtatgggttaaaatttatttcataccaccattaaagaatccaccaagaagtttcctccactgcagcatgtacacttggtccggtgtagaactagtcattcattatccaggggtggtataaaagtggctgtcatcatctaacagcttatcaggggaccgg

SEQ ID NO: 610327 - DNA, 121 bp, Homo sapiens
caacgcatgtgccgctcccgcaaaaatgggtaacagtcgtgccaccaagaaaatgcccgcttttaccatggttgctgagtgcaaataagcagacacgggggtcggagcggcacatccgttg

SEQ ID NO: 610328 - DNA, 889 bp, Homo sapiens
tttttggggcgcccacccatgttgactacaaacccacgaggtgggggccccccgcccgtgatttccaacacacgagacccttttttcttgcgggggtgtgtatccacacatgattttttctcctctgccctcctgaggtgtgttaactctcttgggggaatatttctctctccgcgtggggcgctatcggacatgtttttgttaatccctctttaaccacacacagatatctctctctcaactttttttgttgacgcacacaagcgatctcttttgtttacccaacgctcgtgtgtgtgtgtgcaccacacacagcccccctcgtgtgaagaaaaaattatgctctctccgttgttctctctcttcagcacgccgcccccctcgctccgccccgctctgtgtggcggagagtttcccctctattgtgtcctccgccccctgcgggcgccccacacaaagaggagcgccccacccttcgctctctctctgtgggagaagaaaagagagtgttgtgttcgccccacaaacactctgttttataaaaatatattctatagagagagaataatatatatttaaaagagagagaaaaagaaatctcccacgacattccccccgtctctctctctctcgagagagagacccctcttcctccccgcggcgcacaattcttttgtgtgcgggggcctcctccgctctctcacagaggccgcgggcccctgtgggccggcgacccgagagggttatatggtggagaggggccacaaagattgtggtgttttttttttggggaaatcacagagagcccccccacggcgcccataaaatacccctctttttttttctcccccccgcggaaaaaaagggttttttttttttttcccccaca

SEQ ID NO: 610329 - DNA, 456 bp, Homo sapiens
ccagcttatggcgggggatactaagtgatacaggaaaccaagtagtgctgagcttgaagagatgcctacattaatgtgcaattgtaccgtgatatcctctagcggcaaccatgtagggcagtaagcatgagccaagctcggcgtcctcagttgataaagttggagcttgactggtgtacattcgtaaaacttggctggcacgtgtctgggtttcatgcatgattctacagccggtatatgtgcacgggggagtggggctatgctgagtttcggcatttgacggtaagccctgggaggcaaggcatgtgtttattcttggctcctttatacacatgccatagtgtgcaaagtgatactcctcctcaagaggcggtttaaccacatgttgggagtttcggagactttcgggaggagggtcagacctctttggctttgctccccagggcataagggggg

SEQ ID NO: 610330 - DNA, 174 bp, Homo sapiens
tcacctgcgcccaggctttacctctcgctcccactctccctctcctcccatctcctcggtctcctcccacctcagtcctctcctcccaccttttcctctcctcccacctcttcctctcctcccacctcttcctctcctcccacctcttcctctcctcccacctcttcctctcct

SEQ ID NO: 610331 - DNA, 391 bp, Homo sapiens
gcgcatagcagtcagaagccaagacatgttacagcttatctggctgaaatcgggtagtggacttaaatgggagctaaggattaaaaagaagagttaattacaagtacttggccaacttatggcatagacgacaagacgccaggcttaccaacaggcgctatagctggactcctattatagaatgtacttaggtacatacttcgtcgaattgtctcagaattcacagcatcaattcttgcttcaagctcagggatgggaatccttctattatagcataacatttgcctaccaatatcttcacaaattggagttgaaccatcaagctgcaacaacatgatatgttttcagaagatttctggctcgtgcaacctcactttctgtgacacttgta

SEQ ID NO: 610332 - DNA, 875 bp, Homo sapiens
  misc_feature (21)..(21): n is a, c, g, or t
  misc_feature (300)..(300): n is a, c, g, or t
  misc_feature (304)..(304): n is a, c, g, or t
  misc_feature (307)..(307): n is a, c, g, or t
  misc_feature (313)..(313): n is a, c, g, or t
  misc_feature (318)..(318): n is a, c, g, or t
  misc_feature (339)..(339): n is a, c, g, or t
  misc_feature (360)..(360): n is a, c, g, or t
  misc_feature (388)..(388): n is a, c, g, or t
  misc_feature (394)..(394): n is a, c, g, or t
  misc_feature (590)..(590): n is a, c, g, or t
  misc_feature (614)..(614): n is a, c, g, or t
  misc_feature (660)..(660): n is a, c, g, or t
  misc_feature (665)..(665): n is a, c, g, or t
  misc_feature (667)..(667): n is a, c, g, or t
  misc_feature (670)..(670): n is a, c, g, or t
  misc_feature (674)..(684): n is a, c, g, or t
  misc_feature (691)..(691): n is a, c, g, or t
  misc_feature (699)..(699): n is a, c, g, or t
  misc_feature (707)..(707): n is a, c, g, or t
  misc_feature (718)..(718): n is a, c, g, or t
  misc_feature (737)..(738): n is a, c, g, or t
  misc_feature (741)..(741): n is a, c, g, or t
  misc_feature (745)..(745): n is a, c, g, or t
  misc_feature (747)..(747): n is a, c, g, or t
  misc_feature (749)..(749): n is a, c, g, or t
  misc_feature (772)..(772): n is a, c, g, or t
  misc_feature (785)..(785): n is a, c, g, or t
  misc_feature (808)..(808): n is a, c, g, or t
  misc_feature (865)..(865): n is a, c, g, or t
ggggagccaatcccccaaacncactaggagggctcccacccctgccctcccaccccatttcagggccccagggcttagggtggaggaaggggaggtaaccacccatccagggactgaccctggagactgtccctgccctgcctcaccctccccaggagatagggggcaacacctgggcacaacccctcacacccccctcccccaaccctgcttgtgcacatatgcacattatggctcctcgctgagctggtcagttcctggcagggcccctacccaacagcaccgagtgggatgggagcnaggngtnttgggnggggngagcctgagaaggaaggaggncccagctacgggactgcaggngagaaagagtggggccccccaccttgtncatttnccagagtctctggtagtccccagatccccctgcaactggggatggcgggcgggggtaggaaggcgagtggctgtggcatgctttcccatagccaatcccagggtctggtgatgatcagggttccaaataggggctgtgtccctgtctctgaaaggctgggagcagggctttattgcacaaaatactgtgggagggncacacgcagggggtggggcccagncagtctgtatacagagatattgcatttaaaaaaaacaaaaatctcntttanantanttannnnnnnnnnncactgantgaaacanacaaaaanaggcccacacnatatgaggcaggtggggcnngcngganancnggcagaggatgcctcagactcanggcattgtcaccntcttgtttgagtcgagatcccancctgggctagctctggaccccggctgggcgtggggtagtggtctgggggctggtatnatggggggta

SEQ ID NO: 610333 - DNA, 1088 bp, Homo sapiens
  misc_feature (830)..(830): n is a, c, g, or t
cgacgccggacgccccgttgacggcaacgcggtctccgctttggggtccgggccggctcgtggcgcgcgcaccctctgcagcgacaagagctccgaaacccagagctgcgcaccgccgcgacctctggctccaaccattgcgggtaaacccgcgacagaccccacaaaccaaaagtgcccgccgagcgcgccacgcacattgcgtcccctatcgctacccgcccccttttcctttaccggctttgccaattaccccttttggcccgcgcgtgcccaactgcacgccccatcatccatcgcacactgcaccacactcactccccgcggggacgcctccgttctccccccgtttcccaaacacgtcctctcccccgctctgggcgaatactttgtccctctcacccccaaaggtcgaaaccagcggtctatcgtctaaccccgggtgcgatcctcacctgcacctttggcgccgaccactatgaaacccccccaacgttgcgcgcgatccgatggtggcgcccacccgcactaccggtcgccgccctcctcccaacagcccgccctctccccggacaaaaccagcgcgtctctttcatgctgcgcgcacatcaccgccggaagcctccttcacactcttgtgcgcgcgccctccacagcagtcgccacccacccccgacccgctgcttggtgcccacacgcggataatcgatccaatcggacctcgacccattcactccccgtcccctcattcatacaccgctgtgctccaccacaccccacgaacagtcggatgctcgctcccaacacctcgcccgccgcaatccccttgngtgcgacaccacagctcaccatgcgcacgccaactcggtcatccatcaaccggcatgcggctgctatgatcctcccgcccctgtttatatccactcctgcactcggtaatcgatactcacacagcgcgccgccttcttgttgcgcgccacctcatttctcccagacctgccgtgccaccacacaggcgcgcgtgcgcccggccttcatacactcccacgtccggtaaatccagacgcacgtatcagctagaccgcggg

SEQ ID NO: 610334 - DNA, 658 bp, Homo sapiens
agcgccgcctgcctgggccggacccggtcaggttctcaagctgtcgtccctatggggctgtgtgttccttgtcccgggatgtcctgcgcctcccatgcgggacgctggaagagaaaagagcaaagtttgcagagtgttgcatgagagaaagacaaaaagaggttgcatctcggggaatttagatgtcaatctgtgcaagaaaaagagaaacgacacatggaaaaattagaaaaaacaaattgtgctacatctgggcccccaccagagggtggacttaggtggacagtttcataaaggcataacatgagtagaaagactctacgtggcaataagtgtttattatctgcaatcaaggtgggcttcatcaatttaatttctttctcttgtgagtaactgaagattcagacttgtgtaatatttattgggcccttaagtgcaatgttaaaaaaactgtgtgatttcaagcttagagaagtggctagacttttcacttaaaatactgattttcctacattttgctcttcgtgcagtaggtggagtgatttgcttatttctaagtagttaacaaactggaactaattagtgaatttcattacattggttgtaacattctggatatacctttaagattaaaatccgcaggtgtcttttaatccta

SEQ ID NO: 610335 - DNA, 1182 bp, Homo sapiens
  misc_feature (1)..(1): n is a, c, g, or t
nctagaatccacgaggataaaagactttgatgccaactctaaaataaaggacttccctgaaaaagctaaggatttctttattgaagctacacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccaggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttat

SEQ ID NO: 610336 - DNA, 1224 bp, Homo sapiens
  misc_feature (1)..(1): n is a, c, g, or t
  misc_feature (1188)..(1188): n is a, c, g, or t
  misc_feature (1190)..(1191): n is a, c, g, or t
nctagaatccacgaggataaaagactttgatgccaactctaaaataaaggacttccctgaaaaagctaaggatttctttattgaagctacacctttgtctaaataactcagaccatgaccgacttcataccttggtaactgaacactgttttccagacatgacttgggacatcaaatataagaccgtccgctggagctttgtggaatctttagagccctctcatgttgttcaagttcgctgttcaagtatgatgaaccaggcaacgtgtacggccagatcaccgtacgcatgcacacccggcagactctggccatctatgaccggtttggccggttgatgtatggacaggaagatgtacccaaggatgtcctggagtatgttgtattcgaaaagcagttgacaaacccctatggaagctggagaatgcataccaagatcgttcccccatgggcaccccctaagcagcccatccttaagacggtgatgatccctggccctcagctgaaaccagaagaagaatatgaagaggcacaaggagaggcccagaagcctcagctagcctgatgacaaaaatgacttctagggtgaagcctgggtgatgaggctgctggaagctttgaagtctcccattcccctcatgctataaaaagaactacctttgttctctcccatcctgctcaggtcttttcagcagtctcatcatcagcaaccatgactgatgactgggccctagcaggtggcaggtataacatggccatggacactcttcttttttaaattttatgtctagcttctgagtctagatgaaagacagtatgtttcagagaacattggatatcagtttttcccacagcagggactgtgagagacaaccagcagcatcctctttgtaatcacagggcagggatcagagtttgaaatgaaatgttgtcagggtgttggaaaaattttggtgagttctgcacatttcccctggttcaggctgggcatggaccagccttcagatggcagaagtggaagatgagcctacttgtgagcgatgtgactttaaggaaatgaagactggggaagaataattagtgtttataagacatttaagaggccctttttcatatactgactcactgatgaatcagcatttgcattttatggaaaaatataaatccaaagaaataatttataaaaanannaatcctgccgcgttttaccacgttgtgttggcc

SEQ ID NO: 610337 - DNA, 222 bp, Homo sapiens
acacatatttctgaaaatatctgatccacaccaaaagacacagaatatacattaaaaccttaagtatgtttctcacagcagtttctgggttaaggtgacagatttcatttggttccctcctgaaaccttcttaaaagcatgctaaagaaatattgttagccgggcacgggggctcacgcctgtaatcccagcactttggaaggctgaggtgggcgcatcaga

SEQ ID NO: 610338 - DNA, 177 bp, Homo sapiens
aggctccagctaaacgatatttggaggtcagcacggtgctcacgtgtcgacggaactatgtacagtggaggcatgcacctgcattgttgaatacacgttgaccaggctccatctaaacgatatttggaggtcagcatggtgctcacggtatcgacggaaccttgtactagggaggta

SEQ ID NO: 610339 - DNA, 130 bp, Homo sapiens
acataagcatataataaccccaggattggatccactttcagtgccagccaccgaggatcacacagattcacccaagtcaatagaagccggcgtaaagggtgtttcagatcacacccctccccaatgagag

SEQ ID NO: 610340 - DNA, 118 bp, Homo sapiens
gaccgaggaagtactcgggtctttgcactccaactcggcgcgccccgagcccgaggggccccagccaacccgacgcccgtgtgttgtgtgtgcctaacacccggtacgtgtccggcca

SEQ ID NO: 610341 - DNA, 340 bp, Homo sapiens
agaggcaggcttcgctgtcagtacgttctttgatttgtaaaggggcagcacagtcttttccttcatccaacctctttgcatcttacaacgtcttgcctctaaaagaccctagcgtaagaaggcaatgcttgtggaatgtacagtgcatattggcggcgcacgcctcattacgattcgcctgcttgcttctcctgttcaatcgtttctttggaaggcagtggatttttctcttgcgtctctgtcttcttcagtttcgacttatcgaatttctcgatctcagccatatcgggtttgtcagacatggttgcggaggaaaagcgaagcgaggcgcacgagtacg

SEQ ID NO: 610342 - DNA, 486 bp, Homo sapiens
  misc_feature (93)..(93): n is a, c, g, or t
  misc_feature (105)..(105): n is a, c, g, or t
  misc_feature (110)..(110): n is a, c, g, or t
  misc_feature (115)..(115): n is a, c, g, or t
  misc_feature (137)..(137): n is a, c, g, or t
  misc_feature (139)..(139): n is a, c, g, or t
  misc_feature (144)..(145): n is a, c, g, or t
  misc_feature (185)..(185): n is a, c, g, or t
  misc_feature (191)..(191): n is a, c, g, or t
  misc_feature (375)..(375): n is a, c, g, or t
  misc_feature (443)..(443): n is a, c, g, or t
  misc_feature (451)..(451): n is a, c, g, or t
tcagctgctgtggtggctccagcgcgcctggttctcagtggccacacgcacaggcctgcgaggtgcaccacgggggccgagtcccgagctcangtcccatctttnaattngaagnaccagaaacaaccccagttttnancatgnnaacgtgaaagtttatttttgtctgaaagctttcataagtntttaantcaacacagtaatcaactattttaattgctgcaatcgggtcaaaattttacaaaagccacacacaaatttctctccttctacacgtagctccatacactgccccttgccaaacaccctttccggggaaccaatcagcatgacattcctgggcagttaaatgtgagaagcgaagggcagggcacngtccaggtggactttatccttcaaggaggggccgtatcctctctcttacactctggtgtgtggttaantttctaanggaaacaaccatttaattccattaggctatactca

SEQ ID NO: 610343 - DNA, 122 bp, Homo sapiens
tagaggagccgatggatgttctccaccaccacgatggcatcatccaccacgaagcccaccgagatgacgatggccaccagggtgaggttgttcaggctgaaacccagtacgtacatcagcgc

SEQ ID NO: 610344 - DNA, 215 bp, Homo sapiens
gactacaggatcctcattgtgatccacgtgccattgctgatccagtatgcattgtgatccacgtgccattgtgatccacgtgccattgtgatccacgtgccattgtgatccacgtgccattgtgatccacgtgccattgtgatccacgtgccattgtgatccacgtgccattgtgatccacgtgccattgtgatccacgtgcgcattgtgatcca

SEQ ID NO: 610345 - DNA, 327 bp, Homo sapiens
aagatgaggtctcacgctgttgccctagctagagtgcagtggtgcgatgtcgactcactgaaacctccgtcctctgcccccgggttcaagtgattctcctgcctcagcctccctagtagctgggattacaggtgtgcaacacattacccggctaatttttgtatttttagtggagacggggttttgccatgttggccaggctggtctggaactcctgacctcaagtgatccgcccactttggcttcccaaagtactggggattacaggtgtggagccactgtgcccagcctgggtccctttcttccttccttccttccttttctttt

SEQ ID NO: 610346 - DNA, 1124 bp, Homo sapiens
gggggggaggactggtggcccgcgaggctcggtcgcagacaatgcggccggcgatgtccgcgatgcctaggcgagtgccgcggtgtgacgcggggggccttgtgcgcgtgagggctggcctgggcttcggcctccctccggttccctggaagcgggccctggtaccatgcgcgtggatgcagcagcagaggcggaggctccagcgcgtctctctcctcccgcctcagccttgagcccgggggaagccaggcggaccgggtgtctggagggggggggtccggtgcccgagaactgggaatttctcttcacgtagacatattggaccacgtgtgcagttccccaggaggcacaaagttataccattggtgggcgcttggaatacttgcccgggaaacacttacccattctttaccaaatttgtctatgacaattgaagtgtgtaccatttgcatttcgtccttaccaaactagggcaagttacagtgtcagacaagcagcataggtgacttacagtacattacaccgtttgtccataaatgggtgggcaatattgtggtggcccacgcaaattcgtcctcacggatctttccgtgggacacaccgtttacccgaagttattaaacccaccaggcagttttctgggacactccggatgtggatagttgcagcccacgtgttatacatgcaacaggatggagcacgggatttctcgtggatcacatttacataagacacgacaacttcgtattaaagaacggtttacagccgcattttgaggggcccctttatgaacacaccgcttgggcagttggcatccgaaatacttgggggccacacattataccccctccgaagtgtgttcaacacagcaacgggtactttggacttgggtatgcgcgagaacagagttgtgcccccaggatattttagaaaaagcagtaaggcttacgaatatttacaagcgaacatccaccccaggtgtgcgcattttcttccaagagggaaatggctaggttgcctccaaaaccgtgtgcacgcacaggacatttggggtgaccacaaggaagcctggtgaactgtgggacaatcacacgagtacacgacacctatacgagcattcaaga

SEQ ID NO: 610347 - DNA, 487 bp, Homo sapiens
ggtactctagaggatctgaacgggaatcggtgcggagtggggaatattccttgtctaaatgcagagcagctgagagaagttagcggggctcttcctctgttctctcccaccatccaatgtggacgtggactcagtttccctctgttctctcccaccatccagtgtggacgtgggctcagtttccctctgttctctcccaccatccaatgtggacgtggattcagtttccctctgttctctcccaccatccaatgtcgacgtggactcagtttccctctgttctctcccagcgtcaaatgtggacgtggactcagtttccctctgttctctcccaccatccaatgtggacgtggactcagttaccctgttctcgcccaccgtccaatgtggacgtggactcagtttccttctgttctcgcccaccatccaatgtggatgtggactcaatttcgctctgctctctcccaccacacaatggcacgtggat

SEQ ID NO: 610348 - DNA, 496 bp, Homo sapiens
  misc_feature (23)..(23): n is a, c, g, or t
  misc_feature (53)..(53): n is a, c, g, or t
  misc_feature (427)..(427): n is a, c, g, or t
  misc_feature (496)..(496): n is a, c, g, or t
gaagtgccgccgagacgcccgcngcgggcccgacgagcgggactcgccctgcnccgacttcgacgcaggggccgcagggcgggcccgcgcagtcggagtagcgacaggggcctggggggcagcccggagggcagcccggacggcctggctttcggcgcgggcgcggggggggacagcggcacggaggaggagggggcagaggcggaggaggccagcggggaggcagacggggacacggaggccgaggccgggggccgggcggacgggcgcgagcggcacccggggcgcggggcgcaccgcgcaggcgggcccgcgaccgtccggcgcgggcggcggcgcgggcccacggggccgagggcaacggggcggacgcggaggaggagggcaagacgccgcgggggcaggccgggcaagggggcaccgtgancggcggggaggaccggcggcaaaacggagcggacgcgaaccaaagagacagccggggccgggcgccccn

SEQ ID NO: 610349 - DNA, 176 bp, Homo sapiens
gtgctgattctttaactgtggataacttcctgtaatggttgctgtccatactgactccagccagaactgttcatccttaaaccacttgtgtgggcatgagcacccgcggcccctgttgaaccgctcagactgtgagcatgagcccccgtgttattcgtcgatttggtgccgtaatc

SEQ ID NO: 610350 - DNA, 345 bp, Homo sapiens
gtatacagtgtggttaaagaagctggcacctttcgcctctctcttgctcccctctccccatgtgatctctgcacacacaagctccccttcaccttccgacttgagtgggagcagcctgaggctttcaccagatgcagatcgcggcaccatgcttcttgcacaactgctgaatcatgcaccaaataaacctctttcctttataaattacctagtcttgggtatttcttaatagcagtgtgcaaacggactaatacaccccatacgtttgatatgagcttaatatccagaatatattaggaactcaaaactattaaagagcaggaaaataccaggttaaaaaacagg

SEQ ID NO: 610351 - DNA, 235 bp, Homo sapiens
catacctggaccttctcccaggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacaggcacgtgccaccatgtccggttatttttgtattttttgtagaaggtccaggtatg

SEQ ID NO: 610352 - DNA, 408 bp, Homo sapiens
cgtctcttgactgtacaaaccctgggtgttcacggcacagagctcccagagagaggcgcatgtcacaccctttgctgtttgtgtgagtagcctgtctctggtttgcgagtgctttggccagcccactgtgacaaggtggtggctgaggaacctcagcgcgaattacggccactactaccaagaaacgtggccagactcttgtataagtcagtccccgaccacatttctaatcagcaagtgaaggctatcaaccagggtctccgagctgacctcctcccacgtatgatagttcttcttgtcctcacctcaggccgcaatagcaccgccttcttgtgcttcttcacctcctctggcgtagaggacttacgcaccttcatgtcgtcgaaccccttgattaccccatcacag

SEQ ID NO: 610353 - DNA, 172 bp, Homo sapiens
  misc_feature (95)..(95): n is a, c, g, or t
  misc_feature (146)..(146): n is a, c, g, or t
  misc_feature (154)..(154): n is a, c, g, or t
agcatcaaggctccgggcaaatccagtcattcccctgtttcagccatatcagtcaggggttgtccgttgcagcaatggtgcaaaatgtcaggcancagttcattgcatggaggtcagcaggcgtcagttgttcagcaggggtcacngcagctcngcaattctgtcaatccat

SEQ ID NO: 610354 - DNA, 446 bp, Homo sapiens
  misc_feature (6)..(6): n is a, c, g, or t
  misc_feature (438)..(438): n is a, c, g, or t
ttggtnagactgactcagctgctgttcaactcccccctggctgaactgcttttgctaatactgttaagctgtggcccaggagacaaaacgtcctgaggtactagatatatctgacgcatgcaaaaggcaaaacctccctatttctcatatttagaagatactggtatatagtcttcccaaatcaaaaaatagaaggcaaaatggagataagaaaaaccgtgccaaacctcagctatacatagagtgctttggaaattgttagtagactgaaataatttctatctagctaaagtagataggcgtaatctaatcaaaagagtttaattcagatcagttgagagtatctgactttagatctgctgctgttcggaaattgctgaagtctaaacaaattaaccccactctgaaccaacatacatcttcttgattgattcaggnccacagag

SEQ ID NO: 610355 - DNA, 830 bp, Homo sapiens
tgagcgaggctgtgtcgcgtggccagcgtcggcgtgacggttggacgcgggcgcggacactgcgggtcccgactgctgcagccgcttgtcagtgtgatgaagatcggcatgccagacaccattcgcttttcgacccaagatgatttgatgtcttataaaactctgatgaaccatgatggctacgacagacattatgtatagacagcgtatcaagatgggcaacgagatgcaaagtagtaacgagagtcaaaggagagaacaagatccaaactgctcatgaacctcgatgcacgaaggagtgagcccgtccgccgctgtggagtctcgagagcccgaatggatgtggacaagcaggccattcataggcaatccactatttccatgtattagcgttcgtagtattgaagaaatggtgaacaagtctagcacaggtgctctgaacggcacagactgtctgccaggtgtagactgtaggacagtcgagacaatttcggtcaagaaaaggcagagagaacggaagggcaaacccttatcgtttatggtgaatgatccgagagaaccggatcaagtttcaatggtagaacagcagatcccagagttttggccgctattcgatcgttccttggagcctggtgacagaaggtttaacggaacgtcctgcaaacgattatctagcacgtcggactacattagcgtctgtctggacacaacaacacaatggaagcacgtgacaacttcctgtccgacgtgcgacgagccctgtgaaggccgcagtacgtcaaccgagtggcaagtccccaagcacgatatccaaaagtggccgaatcacc

SEQ ID NO: 610356 - DNA, 1024 bp, Homo sapiens
gatgaggactccacagtattcgacatcgaaatacaggtaaagagcctgtttcccagaccatggtggcgatcctgtggagaagttggtcagcatgcaagcctggggatgtgaacggagctggagcatggaaggcccgtcttgacgtcgagaggatgcttgaacaccaaaacgaacgtgatgtatacaaaaccccatgctccactcgatgcgtgtcaggcatctgctcagactgtcactggcaagctcgtttccacgtcaccacaatggagttgcttctgccaacctttgggcatccctttaaagtgccccctacttctactccccatgtaagaggcttggtgccttgctaaggagcaaagggtagaaacagtgttgacttttaaagaagttccgtgtaagacaattgttgacaatagtaaaagagatcaggaggatcaagcaatcgtaaaacaagcctgaaggatgtccaactgtgtctttagaatttccgagattcttctctagctggcatctacacatgggaccccatctgatcctttgctgctttacaggcttggtcaggtcctggcctcattatggccgttacctgtgtcagagttcaaggtggatgtgctacagagctggaacagcccttacagaagctgcacacgtctgtggctaccttatctgactaccgtaaccacagagcaacaaacgcaagaaagggcacacagagacacaagccgggcgaagacacaaagaccaaaccgaggacacgggcacaaccgcgactaaggaaagacggaagagcgcaaccaggacaagtacaacacagtgcacacataataacagatccaacccgggaaaggaaaagcaaagcgcaagacacccaggcggcagcacacaccgcgcccaaaagaggcccaccgacacgaccaacaacacccgtgccaacccagggtggacaccccacaaccaaccgctcgcacgacaccaccaagcacatacaacaacaaggcgctcacacgcacccccaaccccccga

SEQ ID NO: 610357 - DNA, 268 bp, Homo sapiens
tctagaggctcccggtaaaatcacgacatcctggctaacatggtgaaaccccatctctactaaaaataccaaaatcagctgggcgtggtggcggatgcctgtagtcccagctactcgggaggctgaggcaggagaatcgcttaaatccgggaggcagaggttgggcaacagagtgagactctgtctaaaaaaaaaaagaaatgaaacatgtaagaggctccagaagaagggctaaatgggcagatgggagttctgatacgggtttgga

SEQ ID NO: 610358 - DNA, 974 bp, Homo sapiens
  misc_feature (354)..(354): n is a, c, g, or t
  misc_feature (356)..(356): n is a, c, g, or t
ggacggcgccgagttggtgcactctggccacatgcctgccccgctggctttgccctcaagatggacacgggccgagggtctccggacaccggctggtgcgaggctggcggcgtgtcgaggctggggcagggcggccgagtgtgctcacgttcgagctggtctttgggggcgaagggtcagggggcgaagctaccggccactaactgtaaggcggacgctggctctcttcgaccaccaggggcatcgtgcggacgtagatgctatccagtcgtgcagacatatcccatgcgcctaactggcagcatggatcttcgccttcctcgtggtaccatccaactggggctagccatcgcntntcggctccgcctagagcaccacagctgccgcgtcacatacgcccaacatcgtattggcacctagcgcttgtaggcctgctgtcagtacactggttaaacgtgggatacggatgcgcgactatggggagtcggaggctgcaaacgaagcgcctaccgtggcacatagtgagagcgccgaggtgaggtaaagcagtggctttacgatacagaacttagaacatgatgtgaactgagcatggtttcccatgaaccaataggaccgtactaatgcgcttgtagactgactttgagcgggcgtacgtgcaaccacacggagttgagtcgtaatttctgaagtcctcttccttgattcattctgggagaaacgtaggtatgcaggagcacgaatttcaaggagcgcagccgaggtggccgagagccaccggccaggaagcggctttgattcagattaggtcgcgggtcccggggggggaacggcgtgatgggttcggatctgcgtccggacgtacgctttcgggattcgcctggaactcggtccgggaggcggctctgctggcagggtcgtacctgggacggttagggttccgcgtagacgacggtgctcttggtggaacgggg

SEQ ID NO: 610359 - DNA, 447 bp, Homo sapiens
acactcattcgcaacgtgaagccagaagatatcaagagggttgcttccaagatgctccgtggcaagcctgctgtggctgccctgggtgatttgactgacctacccacctatgagcacatccaggcagcgctgtccagcagaaatggacacctgcccagatcataccggctgttccggtagagtcccttagagctggctgtagagtgcttgtgtgcatgttactgttggtgtagacactgcataaggctagctagctgtgtgaacagtgccaacagtgaaactctggaaacttgaatgaaagttactgttgccactgcacttttgtgtctttcaaaacacaagtggcttatttttcatctaacaagtattttttctgagtatctgccaaagcaggtgctgtcttggccactagatgtttctggagcaaggaaaggcttggaaagattt

SEQ ID NO: 610360 - DNA, 915 bp, Homo sapiens
gatcgctccagtgagcacgttgtgacagatgctgcgggctttcctgcctggcatgcggctctgccggacatcgggaataacatttacatcgattccgtgcaggtggtcactaagagaattcgggcacacaatgggctcatgactgcaccgcggactcgctgtctcctgtccctatcggaggccttccggttcgtggacgcccttcacccggtagattaatgttgctgcgctggtagacaagaggttgtctcaagaggaaaagccacgggagtacgttaccccgagacctcatcttgcctactggacatagtccaatgtgcttgcgatcacgatatccacgtttggcatacgtcgggagattctgtaggggtgtctcactctataaaagaaagagacccacaaaatgtctagggtgagcatcactcgatctatcagccaccccagaagatagcctcttggcagcagtctcgtgggttcccgatctgcgcctacaaggacctatatacccgcaacaatgaagacagagatacagacttggagctacctcgagtcgttggtgatgccgtgagaagccatgggacatttgatgttccatttcattgtttcgtaggaagaaagcgacttttggtccgcaaatgattcgtagtcattgaacatcttgcacgggaagctggtcgttgagttggagccaggagggttgacgggaccgtttcccaagaggtagaagcggacgggatggcagtggacgcgaaaagacacacacggcagggtttggcaacagcacattgaaacaatagaattgaccagggccgttgcgaccggaccttgcaaggttgagcttgggatcacaccgcctaaaagaaaacagtccgaaggcacgattacgagaacgggaggcgggaacacaaatgggac

SEQ ID NO: 610361 - DNA, 129 bp, Homo sapiens
taccttaatggctgttttacaaaaatgtagaagtgtattttttgtatcattaaaaaataactcaatggatgatgaaaacacattcacacaaaaacatatatacgaacattcatagcagcattattcata

SEQ ID NO: 610362 - DNA, 716 bp, Homo sapiens
ccggtgcgccgcagactagggcgcctcgggccagtgagcgcggaggagccatggcaccggtaacggggccgtggaaaacgggcagccggacaggaagccgccggccctgccgcgccccatccgcaacctggaggtcaagttcaccaaggtgaggcgggctgcccctcccaccctgacggcctggtggcccctgcgctggtgcatgccatgactctggtggctgtgcgtggggctgagggatgcatgctgtgtgcctgtgggtgtcctgcctggtgctgcctgcctgatgaccctgatgccttccctgccctgggctgcggctctccatgaaaccgcacctttcgctgggacgtctctgggcggggatcgctagtgctgtgctggggcttctgtgctgcttgtgatgcctctgaaggcgcgggaaacctgaggcctgtccaggctgccctgctgcgggggccggtggcctgcccggcattccctagctgagggcccctgacggtgtccccttgcgcttgcccgcttttgatcggcgagtggaggtgcgcgccgccgtttgactcggagcgcgctggttttggggagctccctccccagaaaacccctgcgatgatttccagggttggacgagtctggctttgagagggtcggagggtccgaggagcgccaagagagagtccgggaggcaggatggcggagctgcagttggaagactg

SEQ ID NO: 610363 - DNA, 657 bp, Homo sapiens
  misc_feature (128)..(128): n is a, c, g, or t
ggtctcgtttgcacgctacgctacgttcattgctccgtcctcgcgccccttttcctacactttcctcttctccccgacctggcatggagcctgctctttccgcgcggtgcattctggggcccgaggtncgagccccgccgcgtgccgccgtcgcctgatgggaagcgagaacgaggccgtgaccggagagacaaatagcggagtcgccaccggagagaagtcgactccctagcagcagccgtcgccagagaggccctgccaccagttcgcccgtccccctgccccgttcacaatgcagcctgcttctgcaaagtgggtacgatcgaagggactatgtcttcattgacattcagtgttgaagacagtaacggctgtcaactgttacaactctcgacaaaatccaaacttacatttcagttgtctcggacgcgaacgtgataactctcacagcattctacacatgacattgatcttctttcactgtattcgatcccacactgattccaagcccataaagaaccggacagcatcaacttttatcgtccgtctaccgacaacggacgaaatctggagccagtccatgggccaaaggttaaacaaaaacgaaaggcgccaaagcttaaatttggcgcttagtgtcgacttccaataaattgg

SEQ ID NO: 610364 - DNA, 304 bp, Homo sapiens
cccgactagcccgacgtccccgactagcccgacaggttgggtggaaaggcgaatgggtggacgtctagttggatggaaggatagttggtgaggatcttatggataggcggatagttgggtggactggcgattgggtggcagtatagttggatggaaggacagttggttaggattgttgggtaggagtacttgttgggtggaatggagacttgggtggacgtctacactggatgggcggactggttggttacggatctttgggtacggagtactgtcgggctacgtcgggggggtaccgagctcg

SEQ ID NO: 610365 - DNA, 141 bp, Homo sapiens
gcttaaccaacatgaagcactatggttggctcagtcaggtcagctgagaagtaggagctgttatccatcactggtggggaggctgcagagaagccttgttttcgggtggttgatgggacactattcatgatagagaaattg

SEQ ID NO: 610366 - DNA, 215 bp, Homo sapiens
caggggtattaacttacccagaagtctgcagctcggttagatggctgatatttcaatcttttggattctattggatggcaaggtccaacatcgtgagttggttatggttctccaggccctcgatgacctcgatgccatggtggctaaggtacagctcccgcaggttcaccaggttcggcagaccctcgatctgggtcagccggtgggcttcaggt

SEQ ID NO: 610367 - DNA, 962 bp, Homo sapiens
  misc_feature (29)..(29): n is a, c, g, or t
  misc_feature (66)..(66): n is a, c, g, or t
  misc_feature (327)..(327): n is a, c, g, or t
  misc_feature (393)..(393): n is a, c, g, or t
  misc_feature (395)..(395): n is a, c, g, or t
  misc_feature (400)..(401): n is a, c, g, or t
  misc_feature (404)..(404): n is a, c, g, or t
  misc_feature (408)..(408): n is a, c, g, or t
  misc_feature (410)..(414): n is a, c, g, or t
  misc_feature (416)..(416): n is a, c, g, or t
  misc_feature (418)..(418): n is a, c, g, or t
  misc_feature (420)..(421): n is a, c, g, or t
  misc_feature (426)..(426): n is a, c, g, or t
  misc_feature (428)..(428): n is a, c, g, or t
  misc_feature (432)..(432): n is a, c, g, or t
  misc_feature (434)..(434): n is a, c, g, or t
  misc_feature (437)..(437): n is a, c, g, or t
  misc_feature (442)..(442): n is a, c, g, or t
  misc_feature (446)..(446): n is a, c, g, or t
  misc_feature (448)..(449): n is a, c, g, or t
  misc_feature (452)..(454): n is a, c, g, or t
  misc_feature (456)..(456): n is a, c, g, or t
  misc_feature (459)..(459): n is a, c, g, or t
  misc_feature (466)..(466): n is a, c, g, or t
  misc_feature (470)..(470): n is a, c, g, or t
  misc_feature (472)..(472): n is a, c, g, or t
  misc_feature (476)..(476): n is a, c, g, or t
  misc_feature (478)..(478): n is a, c, g, or t
  misc_feature (481)..(481): n is a, c, g, or t
  misc_feature (483)..(483): n is a, c, g, or t
  misc_feature (485)..(486): n is a, c, g, or t
  misc_feature (488)..(488): n is a, c, g, or t
  misc_feature (492)..(492): n is a, c, g, or t
  misc_feature (494)..(494): n is a, c, g, or t
  misc_feature (497)..(497): n is a, c, g, or t
  misc_feature (499)..(502): n is a, c, g, or t
  misc_feature (508)..(508): n is a, c, g, or t
  misc_feature (510)..(511): n is a, c, g, or t
  misc_feature (513)..(515): n is a, c, g, or t
  misc_feature (548)..(548): n is a, c, g, or t
  misc_feature (554)..(554): n is a, c, g, or t
  misc_feature (556)..(556): n is a, c, g, or t
  misc_feature (558)..(558): n is a, c, g, or t
  misc_feature (561)..(562): n is a, c, g, or t
  misc_feature (564)..(566): n is a, c, g, or t
  misc_feature (568)..(569): n is a, c, g, or t
  misc_feature (571)..(573): n is a, c, g, or t
  misc_feature (577)..(578): n is a, c, g, or t
  misc_feature (582)..(582): n is a, c, g, or t
  misc_feature (584)..(584): n is a, c, g, or t
  misc_feature (586)..(586): n is a, c, g, or t
  misc_feature (588)..(588): n is a, c, g, or t
  misc_feature (592)..(593): n is a, c, g, or t
  misc_feature (596)..(596): n is a, c, g, or t
  misc_feature (599)..(599): n is a, c, g, or t
  misc_feature (602)..(602): n is a, c, g, or t
  misc_feature (610)..(611): n is a, c, g, or t
  misc_feature (615)..(615): n is a, c, g, or t
  misc_feature (618)..(618): n is a, c, g, or t
  misc_feature (631)..(631): n is a, c, g, or t
  misc_feature (637)..(637): n is a, c, g, or t
  misc_feature (646)..(646): n is a, c, g, or t
  misc_feature (683)..(683): n is a, c, g, or t
  misc_feature (703)..(703): n is a, c, g, or t
  misc_feature (705)..(705): n is a, c, g, or t
  misc_feature (711)..(711): n is a, c, g, or t
  misc_feature (713)..(714): n is a, c, g, or t
  misc_feature (722)..(722): n is a, c, g, or t
  misc_feature (726)..(727): n is a, c, g, or t
  misc_feature (739)..(739): n is a, c, g, or t
  misc_feature (825)..(826): n is a, c, g, or t
  misc_feature (831)..(831): n is a, c, g, or t
  misc_feature (836)..(836): n is a, c, g, or t
  misc_feature (899)..(899): n is a, c, g, or t
  misc_feature (941)..(941): n is a, c, g, or t
tattcagggacttggatttggtggcaggngatcaacataaaccaagacaaggaagaagtcaaaganatgaatcaagtagattctctgggatataagaggcagccgaagagttcacaagtgtgaagcctggaagccggcgcggtgccgctgtgtaggaaagaagctaaagcacttccagagcctgtccggagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcnacttctccgaacctcagcccgactggtccgaagccttcccgtgtgtgtctgccgtagaggtggggntncatgnnggnggtntnnnnntngngnngtttntnccgngngtngctgnggcngnngcnnngnggncgtctgntgcncnggtncnggntntnngngtgngnggntnnnngtgggngnngnnnaggttaatgataagataatggtaggagaaatgngtgtgntngngtnntnnngnntnnngggnntggngntngngggnnttncgntcnccggcccnntgcntcngctgcctctgggngccccngggcttgcnctttcccgcttgcgcctccgccccgtgtcgtgggcgnccgggcgttcttggctcgcngngctgcngnngtggctcncgcnnggcctcccggtnctgcgccttgcccccgccccctcgcctgccttttcctgcgcgccggttcgcgccttcccggccctttcccgcctcgccctgtctgnntctcntgggntgggcgggcgcggggctggtggcggctctctgtccccccccgttcccggccctcccgcctctngcgctgcgcccccccggggtgggggcgccccccgggtgtgcncgccctgggcggggcgggtgt

SEQ ID NO: 610368 - DNA, 120 bp, Homo sapiens
gcatttttggctcatctccagttgcctctcttcttaactatcagcacagcttgctcatctatcacctagcttgctggcctcttttgcttgcctccgcctgctttttgacggcattgcctt

SEQ ID NO: 610369 - DNA, 275 bp, Homo sapiens
actacaagtgctcaagaaggacaagaaactatgaactactgcaggctctctccatcttattgagtcacctgatgcatctgacctttgtatgttactaacaattctccgtctacagctggatgggataattcaggctagactgcttacaaacactaacggttaaaccgtcaggctggcgttgaaattgccaccttggctggcttagaatctgtctatagtcataccagtactgttgacggaggccattggcctattctacaggacagctttctcgt

SEQ ID NO: 610370 - DNA, 680 bp, Homo sapiens
  misc_feature (546)..(546): n is a, c, g, or t
  misc_feature (621)..(621): n is a, c, g, or t
gcagttatgaattaataatataggaagcacagttggattccactagcaaaatctataactctcatggttttggaagtcatcttcatgggtgattttcctttgttttttaaagaaaatatttcaaacaaggaattcataggatactgaaatttgatatcatccagaaaaacagatcccattacattgtaattgttgttactaggcatatttattaagtagagaaatagagggtaaaaagttagtgaactgtcttgtttgcgtgaaccagtatttgtggatatgtctagaactgtaaaatcttgcttaactagaaccttagtctgcaccctccttttaggagaatgaggtaaaaggaagacaataagcttatgatatcagggattcatgtaaaacaggaaatagtagttggctccagtcttctcctctaacaaaagtatgcatattctgagagataccccaaggcatcacaagatcctgaatcatcaaaacaccattgaattgtgttgggcattttgtagccaggaaagtgaagtggttcaatttagnaaagggtttcaggccagggcacggtgacttcaggcctgtaatcccagcactttggggaggccgaggacaggcagnttcactttgaggaccagttagttttgaggattcagcctgggcccaacgtgggtggaaac

SEQ ID NO: 610371 - DNA, 541 bp, Homo sapiens
ggggtcccccccggggggggcccctttaaaaaaaatgggtccccccgggggccggaatttgggcccaaaaaatcccgggattttttttttttaaacaaatagggggttttccctcttcccccaaaccccacaaaaattaaaccctaaggggggtttttttgtttgcctttaagttaaaacaaaaggtttttgggccaaaaaattcaaagggcccaaaaaccaaaaggcccttttttttttttttaaaaaacaatttttgttttaggggaaggaagtgggcccctttttttttccccagggaaaggcttaaaaaataaaaaaaatttttttggccccaaaaggggtttgttttccttttggccaaaaaatttcccgggggaaaattcaaaacccagactgggggattttggaaaaaaatttttttttttttttaaagttaaataaaaaaaaggtttttaattttaaaattgggggggcaggggtttttttaaccccttaaaggggttccccttttttgggggtaaaaaaaattaagccccga

SEQ ID NO: 610372 - DNA, 177 bp, Homo sapiens
tccaggatccccgctatgacgtgtggaagcctactacacactggtctaatgcgagcactttcaaaggtctaatcatgagagtgatgaacctcacctattctcagcaatgaatatggccagcacggccaccaccaccgctcatggaaataagagaagacacaaacaattagaaaaaca

SEQ ID NO: 610373 - DNA, 998 bp, Homo sapiens
gagcgggctgcccggatgcgctgatgccgcgggagcggagccggggttagctggcgctgctggaagatggcgagcggccgggacgagcggccgccttgtgctggctagggctggctcctgttgctcatgtgcctgctgctgctggggagctcggccgggctggctcacatcaagaaggcggaggcgactaccataaactacgagcgccggagcgccgaggcggccgagggccagattcgaccgctacgtaccacgaacaggagtgggagtcggcgctgagggaggcggcggccggggcctccccggccttggaccggcctcttaagcatcggcgctcggtggacggccggccgctgtgggtgcttcgcctcaaccgcctggcctggggctcgctaatccctgaggtcgacccggggcctgaccgctgccgggcccgacgcttcgggccccgctgcatgcccgggcccggcccccagacgatcaacacctgctgacgccaccactgccatggcgaccgaagaccccgccgtacgcaggccagcgctgcacaacctaccttgcgcccgagaacctgagacggccggacctagccgcaccagggaaccccagccccctgggaccgcgggcctggtcacaacaacacaccggacaggtggatacccttgactaggccacaggcgatccaaagcccgcggaagtggctctcaaacaacggtggccacgcgaaggagacgaccctgcgggaaaacccgaccagccacggacaggcccgaccccagacggccacggacggagacagcacaggaacaaaacagagacagggagggacgcgcgcacactgcccagcggcaaactgcgtcacacgagcaccgattcacacacacgaagccggaaaacccccccgagccacgacaccacagcgttagaccgcgaagcgacgccccgcggcacaccaccaacaacgagaggaacacgccaaaagcaaacacgctaaacaa

SEQ ID NO: 610374 - DNA, 506 bp, Homo sapiens
  misc_feature (347)..(347): n is a, c, g, or t
tcctgtctcccagatcctgagaccctggctgagaacttggcccagcctgctgcttaaaggcaccatggggacctgggttgccctgagacccaagccattgttagcagctagccagccacaccaaccacgccagggggaggaaagggaaggactgggagagacacaaagaccagagccagcctcagggacaagagattccagttttaggcctttctccttctaagtgccccccacccccatagcctgcatgtccactcccagacgatggccaagagcagaaaccccccaaaaaaaaaccccccccccccaaaaaaaaaaaaaggggccccttttggtgggggaaggcncccccccaaaagggtgtcctggtttgacagcatgttcaatgaggaaccccaagacggacccacacaggtccacccacgctgggggctgtaatcacggagggaagtggctgcccccttaacacacctttaataaacagtctacagacccaaaaaaaaaaa

SEQ ID NO: 610375 - DNA, 372 bp, Homo sapiens
gggggtacaaaaaaaaaaaaaaaaaaaaaaaaaaaaaaaaaaaaaaaaaaaaaaaaaaaaaaacaaaaaaaaaaaaaaaaaaaaaaaaaaaaaagcggccgttcaaatgcctataacataaactacatatgatataaatgatgccccttaaagctgggcaaaatttgaaaaactaaatggggaaaccttaaaaaggaaccgagctaaacagacaaaggactggtcaaaaaggcaaagtccttggcataaaaggtcgaataatgcattcaaattcaaaaaatttctttaaaaaatggttatcaaaaagaaatactaaagacaggtaaaataaactaggttaaaagaaagacaaataaaaactttgtaaaatcc

SEQ ID NO: 610376 - DNA, 1014 bp, Homo sapiens
aggaattttttcctgccttcctttttaaagccagggtgatgaatgtgcacccattgtactgggaataatgaaagaggtgatgagcttgtactagatccttcagacacatctatgagaagatttgttcatttaagaagtctgcccactgagcgtatagggaaaggattgaaaggattttaccagctcctcttagtaactccgtgcaattgaccacacgatcagactctctgttctctccgttgcctgaaggaactttgggggaatcatcttcatccgtagttacgctttcctgtaaccttctcagtgtgtttaacatgcctctgaaactatgtgcaatatttttggttgacacttgtatccatccttaaagagattagtgcagattgcagatgttctgtcttccatcccaaacaagcgtgccatgaggtaggatcctagcgggtttggctgtgcttactccactgctcagaaagcttccattctgctgtcctcagtcctcgattcctcttctgtgctggacttccaggccacccacccttttcacagtttagatagtgttgtcagctgctgtccctaggtagcaacacacaatacctactgtgaagtaggacgtcaatctgtgtgcgggttcgtcggttatgtggaaatcacaatctccatgaggagcaaaggggttttgcagtgtctttttgctttcagaaccagagaatctatattctcactaagctgattgtatttggttgctcataaaataggttgatagctaatttgacaagaatgcgttactggttgttcgggtaaagtactagaagtttgggaagacactatttggtgtgggctttatgtgtttaacattagactgttgggccagataaatttgggtattttgaggagttgagaagtagggtggaggagattggagatatgtgaaattaaaaaagggggtataacgggagaagcacttagagcatagtataaaagggagaaatgatagtggaaacaatttgttattga

SEQ ID NO: 610377 - DNA, 514 bp, Homo sapiens
gtgtctagaggatctactcctacccacgcaacaaaatcaacaccaccacccttctcgaggaggaagccgagacctgccaggtggtaagggacaaacccagcagagaactccatccttcccttaactccacagggaatcccaagaaagggaatctcaagtccttctgggtaggtgagttaggagctttccatcaacagggagcagtggttaaggacacgtggagaatcccagctccttggacagggtgttccccctcgacattcttgtctgtaacatggggtgatggccaggcgcggtggctcacgcctgtaatcccagcacttggggaggctgaggtgggaggactgcttaagctcaggagtttgagaccagcctgggcaacatagcaagacccccaccatctctgaaaaaaaaaaattagccaggcatggtggtgtgcacctgagaatcccagctactcagaaggttgagacaaaggggatcgctcgagccgtggggtaggaggtgggtaccg

SEQ ID NO: 610378 - DNA, 324 bp, Homo sapiens
  misc_feature (219)..(219): n is a, c, g, or t
gggcttcctaagatagactttatggttaatgggatttattttagctggttaagtccaggacccctaccaggaagaactgaggtccatatttgaggttggtctcacccttttgcatgtggtcctactaataataattttgctgtaaagaagcctcaataaggagatggactgtgtgaaaagagatgagaaagcaggcctgtttgcaaggctggcccttgntgggcatctgaaagcttggatttcaggagggttctcattactccctaaatgataagagtggctcactgtgccctaaactgttccgtacaaacaatgtggggttaa

SEQ ID NO: 610379 - DNA, 449 bp, Homo sapiens
attcgcggccgcgtcgacgaccagcctggccagcatggtgaaaccccttctctactaaaaatacaaaaattagtcaggcatggtgtcacttgggaggctgagagaggagaatctcttgaacccaggaggcggaggttgcagtgagccaagatcgtgccggtgtactccagcctggacgacaagagtgaagacttcgtctcaaaaaaggaaaaagaaaaaaataaatctttaaaaataactagttgctgggtgtggtggctcacgcctataatcccagcactttgggagtccaaggtggaaagatttcttgagctcaggaatttgagaccagcctgggcaacaaagcaagacctcatctctgctaagaataagagaaaattagctaggcatggtggcagatgcctgtagtcccagttagtcaggaggcagaagtgggaggattgatgagc

SEQ ID NO: 610380 - DNA, 459 bp, Homo sapiens
attatagtgaggagtttgtgtgtttccaggaatgtatccatgtcctctagattttctagatttgtgtgcttagaggtgttcataataacttcggaggatcttatgtacttccgtgggatcagttatcatccttgtcatttctgattgtgcttatttggatcttctctttttccccctttggtagtgtagctagtgctgtcaatcttgtctattcttttgacaaactatctctttatttcattgatcatttgtatcgattcattgtgtctcaattttgttcaattcttctctgattatatttatttatttccttttgctagctttgggattagtttgtcctctttatttttctattctatgcaagatattagattgttaatttaagatctttctgacttcttgataaaggcctttagtgctacaaactttcctcttaacattgctttaactgcatcccaa

SEQ ID NO: 610381 - DNA, 662 bp, Homo sapiens
cgcggtggctcaggcctgtaatcctacgttttgggaggctgaggtgggtggatgacctgaggtcaggagtttgagaccagcctggccaagataaacacaaacacaaaattagccaggcgtgatggtgcatgcctgtaatcccagctactcaggaggctgaggcaggagaatcacttgaaccagggaggcgatgatgctggagagctgagatcgtaccattgcgctctagacgctgcaacacgagcgaagctctgacccaaacaacagcggagaagcagggcgtcactttcatccaggccatagtgcagaggtgcaatttcaggtaactacaaccttagtcagctggctcaagcaatactgccaccttaggctcacaaatagctgctctgatactacactgagtggatgtcacagagcctacagagcctacaggcctttagttactatgtagagtatttactatgtgaccctataataatgaatgcattgattatttagaactgggggtagcccgtgacacagcttaggcttgtgtctaccctatggagctgagctgcaagatgagctgaggcagtagttagaactagatgccccttattacgccgctacacagtagaacggcttgaacccgcaggctgagatcccattactaggctgctgct

SEQ ID NO: 610382 - DNA, 405 bp, Homo sapiens
ctagagtatacaaggctgattagagatcctcaatgtatgccataaagcagttcttaaacaacacatttgaacaattcttgaggattagaggggtgaggggtgttaaccagttcagaattttaagaaaacaaaccggttgtacttagagaacttgaataatgagagaagactcttagtttaaaaactgatctttgacatgatgtaggaaggttctttgattaagaagttaaatgaccctgtttgaagggaaaaagaaaggtagtagtcgtatttagtcgtatttagtcctctgagatgtttcgagattgcaggatttctgtctttcctcttttggaaacatcctgggaggtgagattaacatgatgaactcacagcctgtccgcctcttatgcatcctgctgccca

SEQ ID NO: 610383 - DNA, 189 bp, Homo sapiens
gaacaatccaagctaaatggcccactaacaatacttaataagaaacagaaataaccgttacatgctacaaatatttcattcatagatatcacatataactttgacaactatacaactaaactgctctgtggaattgaacatggcatcatttttataattatgttatctcacctatactgtccaaatgtg

SEQ ID NO: 610384 - DNA, 277 bp, Homo sapiens
ttgggagggacacagatggagcaggtcacacgcgagcagtggtgaggtctgctctttcaaagccttggattctctggtgaaaaccgaagtaaagactgtacactaagccgggcacagtggctcatgttcttgtaatcccagcgctttgggaagctgaggcagagggatcacctgaggtcaggagttcaagaacagcctgggctacatagcaaaagcccgtatctactaaaaatacaaaaattagccaggcatgatggcgcatgcctgtagctcccgc

SEQ ID NO: 610385 - DNA, 285 bp, Homo sapiens
ggtcgacgagaggcggactcagggtggtaatatgagtgatggggagtggctcacattaccacccttcacagggccttctctcgtcagatgagcaggagcaatagagtttcacaagagcatgaaccctattatgaactgtgcatgcgagggatctaggctgtgtgctccttatgagaatctaatgcctgatgatctgtcactgtctcctatcacccccagatgggaccatctagttgcaggaaaataagttcagggttcccactgattctacatcatgggtcgacg

SEQ ID NO: 610386 - DNA, 966 bp, Homo sapiens
gacataatgatgagcaatatagagtgcgtactctgccaacaaatgagatactaactggttgtgtgcacttggaatcatacattgtaacgatggggatatgctcattccgggaaatgatcttactcctgacttaactgtgatcgcatcagtacatcacggactcatgatggcgagaactgggatgtcctctaatgtgcagcgagagtattatcagtctcctattaagtgtgtaagaaggatgttggctcgacaccccacccatggagtccctctggcagaccatcgtttgcgtagtacaagtgcatgcggtgtgcaggcatgtacgtctccatgatgtgtgtgttgaacgcatctaagttatgtgctcttcgtgaagaggttttaggctggtgagacttggggtcccttctgtcctgtcagaatctagagagttcccgccttacctggggtacactacgtgttcacagagtgggtactaccatcttaattgagatcgtagcgtatcctcaagaatcaaacatagtctggtagcataactcaccttgaactgagtgaccctgaactcgcactctggatcaacgtcgaaagatttgagtcacgtcatgaccactagttgtgacattgactgtcagggtactgactgtgatactgttggtgctgtacagtatgccagccgtcaggatgatgtacggttgacctgatgcccatcagctcacgtgtgtaacaacgaacagtgtcctaaatggtgccaaccaacgaattggatcactgtcctctgatgtgcctaggggtcgtgcccttattttggacttgttcattcaccagttgagaatcacacgcgtgttgcaccccagattggaatggcctcatgcggcttctgcaatttcagcctcagatcagaaggaacacaagaggaggcgatgggagtcgaccaacacggtggtaggacaaatacaacactctcgc

SEQ ID NO: 610387 - DNA, 287 bp, Homo sapiens
acaggacttcgacggacggcagtcatgggaaaagacttcttctgctttatctaaatttgactacttctggacaagaaaatttacgtttggttaataccaagctgaacatcatataaagaaaaaaaagaacagcccttaaaggttaaggggtacgggactgtaaccagggtgaagggcagccggaacaaagttaaaagggaattgatctccaccaaagaagtcgggggcatgacagctttctctacttgctcccggactgggcctataccaaagtaaagtgttggtag

SEQ ID NO: 610388 - DNA, 1265 bp, Homo sapiens
gccctggctcgcagcggggtgcccctggaccctgcctcgctgcgggcatcgctgcggctgagcatgagccctcctgtgcctggatgtgcctggtgtgtcctgtggccctgatgccctctgctggctctgcagtgcccctgctgcctggtgctgctcgtgggtgtggttgccttgaacatctgtgcttcctctggtgtggaatgtgatgtgccctgcccttcctgccgcctgctgctaccttgcccgtggtgccacacatgctgcctgacccactccctgtgccccacagtgcattagatggacgcttgtgccatgaatgctgggacgtgatgcttggtgcctggcatgatccatggacggacggacggaccgagacagccagctggcctgcacgacatgacggtcgatgcgcagcatgaccagcagacagcctggccccgctgtcaaacgaagaaaccctggacactgccaaggatgtgccctcttcggcaactgaggttccgacccgtgaccgatcggcgtgagcacgtgagtgcacgacttaccctcgaatgataccgtgcgagcagcatccacagcactattgcttcaggcgtatctacacagagcggacagcctggcgaactctagaccgaagggactagcagcccgcaagacccagcaaaacgtcagctggctgtgcagggaccagcttgaccaagggaccaccgggcaagtggcctggccttccgtgttgcccactcaagctcaagaccccaggcaacgtgtgttgctcaagacgcatccttttgtgctttcaacggcagtcagcttacctctcccatcacttgttctcagggttgccgagagggggcaagtgtgcacaggccttccaactggcgcatccaagtgacaaggcccaggacacaggccaaccggaggggtcctcgcttccatggtcaaagcggggtactggcgcatgtggtgcaccaagggtcaagtcttgaacgggcatggcatacatggagggcacacccaagacacacagcacacatgccaagacgaacgcatctgggatagcgtagaagaccattggggcgacccccaacttgcgcaccacacaagacgagagcggccccagccaacagaacagaaagaccaggagatcccataaaagagaacacaacacgccagataccccacgagcgcagcgcagcaagcacacaacccgccacacgacacaacaaaaaaaccgcgacaaccgccgcgaaacaccgcaacaccgg

SEQ ID NO: 610389 - DNA, 537 bp, Homo sapiens
  misc_feature (351)..(351): n is a, c, g, or t
  misc_feature (360)..(360): n is a, c, g, or t
  misc_feature (395)..(395): n is a, c, g, or t
  misc_feature (422)..(422): n is a, c, g, or t
  misc_feature (439)..(439): n is a, c, g, or t
  misc_feature (478)..(478): n is a, c, g, or t
  misc_feature (505)..(505): n is a, c, g, or t
aatttttggaacaaattttaaatataggcattactagaggaaaattatctatggactgtcctattaatgaagaatgtctgtcttacctccgtttgttttgggaggaggagaaaatatagaagaatctaataaggaacaagtgattttacttttttagctcccagctactgttgtgctcgttttaattgctgttttgaagatctgctgcttaattatccccatcccttagccggagatgtgggagtgtttccctttcagttttttgggtgatgttgaaattccttttgtaattcccctcccgggggcccaggggtcaagaatttcccaagccattgaacccaccagccttcntttttaaancattaaaggcttccccagtggggaagggaaaactnccagcttcgaacaggttaaagggggantggggtgggggtttgcntgccctgcaatttgctctaaaaaaccgctttagtggccnttcgttacatacaacccaggacatccngtaggcaaggggggacgcacatgtgtgtgtgt

SEQ ID NO: 610390 - DNA, 449 bp, Homo sapiens
aaccagctacatcccagatatcttatattcagttgcactttgaattagtttttaagggctgtttcatttaggtcactcttactaaaattctaggttataccaattacattcctaatcagatttatatttcttagattaatattaaagtttattatccttgaggtggttgtgtagtgcagtagataagtaactgcttgggacacttgcatactatattggagtgcctggttggaatctccactgtgcttcagatctagcttcctaatttgaaccccaggacgcatcaggtaatggcccaagtatttgggtccctgctacccacatgggagacttggatggagttcttggacgctggcttcagtctggcccagccttggctgttgttgacatctggggagtgaaccagtgggtggaagatctctgtctgccttccaaaatacaacaaattt

SEQ ID NO: 610391 - DNA, 529 bp, Homo sapiens
ccccggcctcttggttgctgccgtgtgctgtgtgctgcacatagccattgtgcatggctggtctggtctctgtccgatcagcttggtgagccagtggtgatggggtcagggtgatgacagctgttcctggtgccaatgtgtgtagttcatgccccacgggccttgccagcagctctggccagatggaggctgctaaggtgcccctaggctgtccctcaagttcgaggtctggtgtcgacacgctggtgtcacgcccggagctctgaagacgcctgagggccgcctgcacgccctgagtgaaactcgtctgtgcttcatctccagggcgtctctggccgagcctctttttgtggaaaacgacagcagcagcagtggcctggaagacgccaccgctaacgtgagtcccatggcctgcagccccaggaagcaggcagctgggccaggcagggactttgcacatgcagggactgaggggagctggggatgggcaagtggtgactgctgctagctgccaggctgggcctccaaa

SEQ ID NO: 610392 - DNA, 148 bp, Homo sapiens
agagtcaaaaaaaaaaaacgctttggtccacatactaaccacacacactggctccatatttgtatagaaatatctccggaaagggccggggttagggggggggccctcttaggttttttttaaaatttttcaacccataccaatggtt

SEQ ID NO: 610393 - DNA, 262 bp, Homo sapiens
acctatttcgccgggagaggactgtaactactatttaggtggcacagattgaaatttagtggttccatgggctgactgaggaggggtggacttttatatatagatctacataaaacctgctacatgacaaaacccacacctaaggaaatttaaagaatttgccccagttactcactttgagtaacctgaaatctagctgttgaatacgctgaagtaaatccttgttcactgaagtctttcaattgagctgaatgaatacatt

SEQ ID NO: 610394 - DNA, 807 bp, Homo sapiens
agcgggtgcatcctgggcttggcgtacccatggcgtctcgtgtcctttcagcctatgtcacgcgcctgcccgcggactttgctgccgctgccccgggctccggatgcctggccgtggcccggcctctcagcaccgctactctgctccgtcggggagcccagaccgaggctcgggactattgcagccggccttagtgctcgcgcatcgttcctggtacagttacacagctcgtgccgtcagtatacgtgacagtgctcgtccgttggacgtctatgcacgggcatccaaggacccgtgtgcatcttagcggtattcgaaacgtcgtatcgacgaagagaatttgagcgccatgaagaagtgcgtcttgcatgtagaagtactcagttattgaatggaacagacctggagcttagacagctttggaccaaggtaggagagttagtcatggccatggacagacgacatctaagggtttgaaattccatgagtatagcatgctgaaaagtgaattgtgtccatcgaagaaatcgtagatcacattgctagataagcaacggcatgtattatcgaataagacgtatcagacccttaggctttgctgagcagaggactcgagagtgatcagtgacggaatgtctggcgagtgcaggacaccatcttcggccattcgtgactgaactctgactaagagtgactctctgactggacattgtaattttaacactcggtagtggtgttgaaaactctgatggaagactacaattctagtacaaaaccaaaaacaatagacaagcaaagccttttcag

SEQ ID NO: 610395 - DNA, 119 bp, Homo sapiens
ggggaggaccgagacaaacgcacaacaaaagaacagaaaaaacccacacaaaagaaaagccaccaacaacacaaacacaaacaaccaaacaaaaaacacaaaaaagaaaacacaaaatc

SEQ ID NO: 610396 - DNA, 729 bp, Homo sapiens
  misc_feature (512)..(512): n is a, c, g, or t
ttcagtttaaagtatttccatcacttttcctccataatccaaatatttaaaaatgcaaagaaaattaacttccaatgatatgtccagggactggcactaaaaaaaattttcagactgcaaatgagtaatccaaatgaaaatatcaaagggagacccagttatcaaaatgaaagccactcaactatattaaaagtccacaagttattctgttattcgagcactattcacaacagagtccagcttgctaacctggtggtagatttgaagagacacttattcgccagagagctctgaaggaaaactagatttatctagttcaacttcataaagagagattcaacacgaggcgtgacaacagagttattaaaaagaaaattgggtgccttttatctagcaagtgttaggccttaaaattatgccaagtttggatacaactttatggtgggttgctttagggtcttatctatcaaaaaagtgcacgactagcagaacgtgcacatacgtggtccaancactctggtctcttcacctctgcttctaaagccaagaaaccagatatgcgcagtaactcagaaagcatctagccaggcatcagttaatccaagatactagctcttagttccaaaagcccttgcaagagaaaccctttgggggggaaggggtgccacgggatggaagccctccataataactggaatccatgagtgtgtatgccaagtctcatcgagg

SEQ ID NO: 610397 - DNA, 479 bp, Homo sapiens
cgcttactacattgttattaagccaaaagtgatacaaaacattcagagaaaaagcactgtacctgtcttacctaaagacctggatgagttaagaagcagacccaggacttaaagacagtatctttgtgaattcatgagctctttctccagagaaaacgagaacgctacaacgtatattattaagaaacactctttgagaaataatagctctttgagaaataataaaaaaggggagggaggcaagtatacttgagtcagtttgtgtactaatgttcaaaaagataaactggcatgtgatgaaattaagcgactgaaactgggaacgttgatgtcgaatccttctaaaattcaaaaagcacgggtaaatacttgctcggagggcattagaaaagaacattgcaagcgtaattacctaatgctggtgtaacataagtatcctatcacttataataacaacataaatgggctcgttggcctca

SEQ ID NO: 610398 - DNA, 372 bp, Homo sapiens
ttcacacccttcaagcaggcggtgaaggagacctgtgcttggttcactgacaactacgagcaggcccggaagtgaagctgaaagacaggatcagttgcctgcggaccattcggctgcaagagcccagcggccaccacccgtcaaaccttgcaaggagctgagggacccaccagcaaactggggcctgcattccattcgctctgcaccccaaagcttttttccatggggccccccattcacgttggtcttcagggaaaccagggtttccgcaggcccggcgttttgctccccacaccagccccctgcgcgtgtccactctgatcctgcatcccactccctgggagccaataaagtgcattttcacaggcaaaa

SEQ ID NO: 610399 - DNA, 471 bp, Homo sapiens
agactcctgccacatggaccaggatgaagagggatcaaagagataattagccaaaaacccagtagcctagaagatacaaaactccactggcctctaaaattatattagccaagagtggtttcatttgagtgccttcgtgtgtatgtccatcaaactggaaccaaactgttttgtaagtaaacaggcagcctaagcccaaccctaccttcttaattcgggttattctctttttcatctggggatttacctgttcatttaatctgcctgttttgatctgttttgaaaaagataaagagcctcaaatcagaccagcactgattaattaaccctgctcctaccaatcttttttaaagcagttgaagcagaatgtataggtgtcagagaagaaacctagtcagccagacgtgctctgtattcagcaatagtttgtgaatgaataaattactaatcctccttgtcgcttgaaaaaaa

SEQ ID NO: 610400 - DNA, 415 bp, Homo sapiens
cccacaaggtccagttctacacagctcctctccaactcaatatagattcctcacagtctctctgtgaggaaggtaaatgtcactgctccccgttggtggggaaaacaaaggccagagtggttaaagtttttgcctgaggttaaaccaaaaattaaaatgtcccttggcccacaggaaagaatccttccaatccaagcgcatttaaaaaaaaaaaaagaaaaaagttgagccaccctgtcactcttctctcagatgccatgaaagacttcctcccacacgagtccccacactcttgccacttgacagcacaggctcacatcacagagtatttctctctctgtgaaaatatagagcctctctcttttcacatggacagagagatatataaagtcacatgagctcgtgccgtactcct

SEQ ID NO: 610401 - DNA, 104 bp, Homo sapiens
tcaaaaagctccagcccagaaagcacctgctccaaaggcctccaccccagcccccacccccaccctctccttgagtttctgtgaattaaaatatttgcaaatct

SEQ ID NO: 610402 - DNA, 141 bp, Homo sapiens
ggcgtcgtaattgcgtcctcccccgcagagctttggcgtctacaccgggtgtgtgtaaatctggtgtcatcgcttgtgtcttgctgggctgcgctggttgctgtccccctcctccgtctgggaccgaggagctgcctgttg

SEQ ID NO: 610403 - DNA, 396 bp, Homo sapiens
ccccagcaaggtgggcggaattgtcgggaatgaagacaccgtgagcaggctagaggtctttgcaagggaaggaaatgtgcccaacatcatcattgcgggccctccaggaaccggtaagaccacaagcattctgtgcttggcccggcccctgctgggcccagcactcaaagatgcccatgttggaactcaatgcttcatatgacagggggcattgacgttgtgaaggaataaaaataaaactgtctgcttaacaaaaagtcactctttccaaacgccgaccttagatcatcattctggatgaagcaaaccacatgaccgacggagctcaacaagccttggggagaaccatggaaaactactttaaaccactcgcttcggccttgcttggaatggctc

SEQ ID NO: 610404 - DNA, 138 bp, Homo sapiens
ctgtagaaggctcagcaagcattagccccttatccaaaatacttcctcacctgaaagatcatcattaattacttggggccaatactctaattttcaagctgggcttcagggactcttggcgtgacctgatagtggcag

SEQ ID NO: 610405 - DNA, 774 bp, Homo sapiens
gaatgagattctggaggcaagtaaaagataggacatgtctgagagcttggagaaaatcaagattcagttagacaaaggaaataacgaattggtgaccaagctgaagcagcacaggatgccaccttgactacaactactttccaaaatgaagatgaaagggaataaagaagtatatatgactccactcaggggtgtaaaagcaaaccaagcatcaaagtctactcagctaaagacataaacagaggacagagaaaagtgacagaaacagctaggacgaacaggagggtcagactgctgaagccgaactcttagaaagtgatcatgaagtccagaaacagaatcagaaaatgaagataggagactaccaagacgagccaaaaccgcagcacctagacaaaaacgtacaacttaacctatgcacaatattctcactgaagatctaagtttaggaaagacgatggaggtggaatcctttaagattatgtaccagttatatgctttcaataaagaagaagttacccttgtcacaaacaaacagacaacacacggggccggaaccgcccaaagaggaactcccctcgtagggggcccccaaggcatacacgcagtaccccagagcaaatcaggaacccacacgtgggcgccacataatgacgagatcgtgataaagaaagacaagccacaaggaacgcacgtcataaaaaaggacgaagcacgggcaacacaagcggcaagcgtgggaccaccaggtggaagacggacaccctagaatgc

SEQ ID NO: 610406 - DNA, 264 bp, Homo sapiens
ttacagtcttaggaacattggaagaatctccagctgggagtgttcttatgcttccgacaacaatgggtcgctattggttcatacttcgcgtatcttatgtttggcctatcttgatctttggtgccacttaccttctagattttcccaccagttgggtcattgcttttggaaattggggcctgcagatcgtggatatatgatcattattggttgcctggaatggattcaggccgagctgtagtctgaggctccgtgtgagaaagc

SEQ ID NO: 610407 - DNA, 1610 bp, Homo sapiens
ggacgcgtgggataactaccactgacatgactttccaaaaaacacataattatgaatcaagcacaaccacccacagcctaattattagcatcagtcccgtctacgtattgttttgtaaccaaactcaacaagcaagcctatttagactgttccccgaaccgttttccgtccgagcccgcgtaacagacccgccgtcgctagatactagacataccatggacataccgtagcgcgaccgtcaagcagagtccagtggacgaagtcacaagcgccccagtttgatccgcgagagaaaccgcagaatatacgacgcagaagaagcacctccgtagcccatcgtgactactcactaaggagttcctgccgcatacacacaagtcgagcccctgtaccatcgacgtccaaacaataccgaaccaagaagagagacagacaaagcgtaaggatacaagaacacacaaccactaactaccctagcgataacggcaacacagcagaaaagcagagagtaccacgcaagcaatagagaacccaacccaaaccagcaccgacaagcacgcgacaaaacgcaggcaccagaagcacgacccgagacaagcggccaagagaccaacgaagatacagaatacccataaccaacgcaccaaagcccacaacaaagcgggacacccacgagaagccacacacgacacagcaaggagcgaagaagataaagagacaaaaccaagacagcacaacgcacaaccagcccaccagaaggcacacaaacacaaaacgacaaaatcccaacaaaaaacaaaccagaactacacacaaacacaaggcagcacaaaaaaagacaccagtagcaccacgacagcaaccctagggaagacacacaaccacacagcaacacacaaacccagacacgaaggacacgaggcacacacacacagaagtacaaagaaaaatggacaaaagggaaggacccccacactagacacaagaagaaccagcacaagcacaacagagagcacaacaccccaaacaaagaaccacacaaagaacgaaaaagacaccggcagaggacatggaggaaccaagaacaaaacaagagcacggacgaacaacgatcaaacaagacgacgacgaacgagaaaggtgaaaaaagcaacgacaacaagcacgcagaccaccaccgacccccagcaacacacaaaacgaggaagacaacgaccaagaaggtgaacaaaagcaccaaagagagcacaagaccagcgcaacgccacgccgcccggcctaagcagtagaacgacgacaaaaagagaaacataagcagcagacaagagaaagcaaacgacaaacgcgcaggagaagaacaaggcgagaagaagcaacgagacacggaacgagatgaacgggcgggtaagagaagaagatggacgaaggagagaatgcctaagcaagtaggagcgacacacagagagacgcagcgacagacaagaactagaagaccagaaacgcagaggaaggagaacaaacaggagaagcagacacaagaggagagagcaaggagacgacaacagtcaggcccacgaaccacaacacgcagccacgagcgcaagcacgag

SEQ ID NO: 610408 - DNA, 175 bp, Homo sapiens
  misc_feature (74)..(74): n is a, c, g, or t
  misc_feature (76)..(76): n is a, c, g, or t
ctcagaaacctacaggcaactggctttctttaattttctcaggtcctcatccctgtttacctcttctgtctctntntgcctcaagcccagaaacaacccttctccttttccctttctcccaatgctgcctcttccctctccccgctcctcttcaataaaaccctcactaaactcc

SEQ ID NO: 610409 - DNA, 106 bp, Homo sapiens
tttatgccatttaaaaattattttaataggatttttgtaaagagtgaggtggcggtggtttatatctacctctggatttaagcaaataaaagggagagaaaaaatt

SEQ ID NO: 610410 - DNA, 518 bp, Homo sapiens
gagatagagtctcgctctgcactccagcgtgggtgacagagcaagactcaatctcaaaaagacaaaataaaacaaaacaaaaacagagtctatgctcttaatcactccactatattgtggctattattattattgctatcattattagaatatgtaaatactttattatccctatgaatatcattggcaaaatacattcaaatatgtaaagctttgcaaaagtttcagtaatttttatctttattttaaaactatatcagaaaatgttttatagatatgaaaacagggcagagagtcttggaacttattcaagtttctttatatggtagaagacaggattataagataaaggaaatatgcatggctaatttaataaaaatatatttggcataatatttcttgtgtcaggaagatgacagcctggtctggagttagaaaatatgcaaacacagagattctaattccatttctgccattaccttatttgttaatcacagtaggtcatttaatctcttaaa

SEQ ID NO: 610411 - DNA, 777 bp, Homo sapiens
  misc_feature (87)..(87): n is a, c, g, or t
  misc_feature (112)..(112): n is a, c, g, or t
  misc_feature (137)..(137): n is a, c, g, or t
  misc_feature (172)..(172): n is a, c, g, or t
  misc_feature (186)..(186): n is a, c, g, or t
  misc_feature (196)..(196): n is a, c, g, or t
  misc_feature (199)..(199): n is a, c, g, or t
  misc_feature (208)..(208): n is a, c, g, or t
  misc_feature (222)..(222): n is a, c, g, or t
  misc_feature (256)..(256): n is a, c, g, or t
  misc_feature (260)..(261): n is a, c, g, or t
  misc_feature (263)..(264): n is a, c, g, or t
  misc_feature (266)..(266): n is a, c, g, or t
  misc_feature (281)..(282): n is a, c, g, or t
  misc_feature (289)..(289): n is a, c, g, or t
  misc_feature (292)..(292): n is a, c, g, or t
  misc_feature (321)..(321): n is a, c, g, or t
  misc_feature (331)..(332): n is a, c, g, or t
  misc_feature (334)..(334): n is a, c, g, or t
  misc_feature (352)..(352): n is a, c, g, or t
  misc_feature (357)..(357): n is a, c, g, or t
  misc_feature (360)..(360): n is a, c, g, or t
  misc_feature (366)..(367): n is a, c, g, or t
  misc_feature (369)..(370): n is a, c, g, or t
  misc_feature (400)..(400): n is a, c, g, or t
  misc_feature (496)..(496): n is a, c, g, or t
  misc_feature (526)..(526): n is a, c, g, or t
  misc_feature (538)..(538): n is a, c, g, or t
  misc_feature (551)..(552): n is a, c, g, or t
  misc_feature (555)..(555): n is a, c, g, or t
  misc_feature (767)..(767): n is a, c, g, or t
gggtcctgcgcgctccggactgaggtggcgtccctgggccggacggcggtgttccggcgtggcgggaagccggcactggagcgggancgcactgggcgcgggaccgggaggngcagggaccggacggctcccgagtngcccacctgacggtaccgagagggcggcgcccctncgagcagagccgtnccggccactnccntgggatctnacttggctcttgtngttgcgggcaccgtgaagccctggggtgtgcgtngttnntnntngtaggcgcccttttnnggcgttnggnttggggtggtggtggcgttgatttcagcnccgctttttnntngagaggagggctccactngttcnttnggcttnntnncctggggctgcagcgaattgggctggcttnttgtttttttgcttgctggcggttttgttggttagaagaagtttttatttttcaggagagccaaagagtgtttggccctaggtgggaaaagaactngttgttatctttgctctgatctggaagggnccagctttgggntgaatggtagaanncangcccgcccgtccggtgctgacccacctgctggtggctctcttcggcatgggctcctgggctgcggtcaatgggatctgggtggagctacctgtggtggtcaaagagcttccagagggttggagcctcccctcttacgtctctgtgcttgtggctctggggaactgggtctgctggtggtgacctctggaggagctggcccaggaaggacganaggtcccatc

SEQ ID NO: 610412 - DNA, 228 bp, Homo sapiens
  misc_feature (13)..(13): n is a, c, g, or t
  misc_feature (87)..(87): n is a, c, g, or t
tccacccaggtcncgagccctcacaccctggacgggaagggacagctgcattccagagcaggaggcagggctctggggccagaatgntggtccttgtcgtagagccctccacattttctttttcttttttgagacagggtcttgctctgtcacccagactggagtgcagtggtgtgatcatagctcactgcacccctcaacctccttgggttcaagcaatcctccttg

SEQ ID NO: 610413 - DNA, 132 bp, Homo sapiens
cccagaaggtgccttcaggacaacaactgggactacaccaggatctggccagggcttcactcatctcaagggcacgggcgggatccagaggtggcattcatgagggatcgtaggtcatgcctcagaggcagt

SEQ ID NO: 610414 - DNA, 301 bp, Homo sapiens
  misc_feature (283)..(283): n is a, c, g, or t
ttccctaactacaccaaaaaacagacgaaaattcaaatgctcctcggtctcactcaaaagctattcatttttcctagctatttacaaaaacacaaattttcaacctcaacaaaggaaatgaggttttaaatttttctatttaaaaaaataatccttttcctttactaaaacattatttacttaactatttttcattcaatactactactcctatcaccatttataattctaaattttaaacttcaaaacttctaactatcaaacctcttagtaggtgatactnctccaatctattcctaat

SEQ ID NO: 610415 - DNA, 228 bp, Homo sapiens
caccactcctatagatcagtctcctccaacttcaatgctgtactcctctccctggctgtcaacagtgctgcctgttttgttctcagatccaaagtttcctacaattttcttataacttaaagcaaaatcaacactttctctgtttcagagtaccaaatgtctcagtcatcactgtttcctactcatgttttgatttctctcccaccatctcactgatctataggagtg

SEQ ID NO: 610416 - DNA, 133 bp, Homo sapiens
tgacctgggtgcatgcatgtggagcgaaacacgtggcttggactcaggcctgaggtacctggcctcattaccttactcacgtgttgcacaactgaccatgtcacggaggtttctcagcacttccatctccccc

SEQ ID NO: 610417 - DNA, 165 bp, Homo sapiens
ggctgtttcatttttatttattttattttcatttttgagacggagtttcactcttgttgcccaggctggagtgcagtggcgcaatctcggctcattgcaaccttcgcctcccaggttcaagcgattttcctgtcgaaacgcaaccctcccttctgtcgtcttctc

SEQ ID NO: 610418 - DNA, 354 bp, Homo sapiens
agtgtggatatccaggaaaacatagttcagcattttgataggcatcttcacgttgcataacctccaccgcgtttgccttgtaggcaacatgcatttaacacttggccgggcatcaaatataaagatgttgtgagactgggcattggaatccatgatagcttgaaggtatttttcatcttcttagcttcgctttccactcactccaaccatgggcgggctacaccgagtgatagtggcttgactttcgacgatgaatccatgataaaactgggatacggcctcttgatctgaaggatgccacgtctctttaaattcttcatcaggaatattggctggcacaaccaagagtgtcgg

SEQ ID NO: 610419 - DNA, 162 bp, Homo sapiens
atgtttgtagctacaccacaattcagatatagaacattttgtcatccaaatattatgcagagaggccaggtgcagtggatcatgcctataatcccagtgctttgggattctggggatagaaggatcactggaagccaggagtctgagaccagcctgggcaat

SEQ ID NO: 610420 - DNA, 427 bp, Homo sapiens
aaaagtcttgatcattttatttgagctttctgagggagtaataggcacttggggaatgtagtctcatttggctttcaaagaagctttgacaaggttctacggaaagaggaatacacatggagaaaaagaaaggaagatgatggccgggcacggtggctcatgcctgtaatcccagcacttcgggaggccaaggtggaaggatcacctgaagtcaggagttcgagaccagcctgaccaacatggcaaaaccccatctctactaaaaatacaaaaaattagccaggcagggaggtgcgctcctataatcccagctactcgggaggctgaagcatgagaatctcttgaactcaggaggcggaggttgcagtgagtcgagatcacgccattgcactccagcgtgggtgacagagcaagactccgtctccaa

SEQ ID NO: 610421 - DNA, 604 bp, Homo sapiens
  misc_feature (206)..(206): n is a, c, g, or t
acggaagaggtggtgtctccctgggagtggtgagctgcagaaataaactgctcctttccttaaaacaatcagccggtgactcagcctgtaatcccagcactttgagaggctgaggcaggaggattgcttgagcccaggagtctgagactagcctgggcaacacagggacaccacatctctataaaacattaaaaaattagcttggnctggtggcataagcctgtgttcccaactacttgggaggctgaggtgggagggtcatctgagctggggagatcaagtctgtagtgaaccatgatcatgccactgcactccagcctgggtgacagagtgagaccctgtctttaaaaaaaaaaagctaatagtgaaaaatataatacttgcctgcacagtttctgtagatcagaagtttggtgaagcttagctggtggaggatgggcaaggatctgggggtttaacctctctgtatacagactttcaattactagatctgtgttaagctccacattatacccctagcttactgcaataacttgagtctccaagacgtgagacttactgctaatccagttcaatgcttatcagatcctacagaatctttctg

SEQ ID NO: 610422 - DNA, 139 bp, Homo sapiens
ctgactcggtaccctcttactggggcttcttgcagtggtttgcaatgtcccagagaggctgactgctgatcaaggctgcaggagcagccttgccattgtgcttgggcgttgcctgcatactcatactccattgtgctga

SEQ ID NO: 610423 - DNA, 492 bp, Homo sapiens
ggaacagcggcctggtgcgctcgcttagcgggcgacggaatctgacggacgtggacgcccccggagtggaagccgaaacatgagttgtgtagctgaggggctgtcgtatccgcgtgagcctccggacagacgccagagcgaggagggtgctactgcgacttggcaagatgacctcaattcctgcgcagccatagcttctggtccttcttttgccctcctcgtggacgcatattccgattaccgtgtctcacgcccgtggaggaaacttgcccatcagtgaaacaactagccaacaactctagaccgttaagttgtggctattgctgcctgctacagttctgagtaggttctgaaggagccgtcgcatggatgctcccgtccgtccgaactctggtgactgcaacatcccgatgaggtaggcgcgatggcagatggatagagaagaccgtggaaataagattctgaatggcggacagccatgcacgtggaaga

SEQ ID NO: 610424 - DNA, 693 bp, Homo sapiens
agctttttgtccttccaggtttgtgccaacaataccgacaggattattggtgctctgaagtcagaggaggacgctgggaatatcgccacctacattgtggcgtttaccctagatgaccgaattctgctacatgaaactaagatcgaggatgtgaagtatgagggacttgagttcatttagtgtctggatgtattttcatgccaagaattggtaaatgccttcttctaggtgatgtacatctagatttgggcattgtaaggttaagaataatgccaagtgtctgatggcagccaaaatgtggttgtaaatatcgactcttaaaattaaagttgactctttaattattttaaatcacctgtcggagccttcatcagaagtttttattattgttttcttctctctgtcttttccgaggtttagcgtttttaagcccagcactgtacttacagtgtaatgaatgtaacagaatggatgaagtaacagactcgaatagtttaccctacaaacatcactgcagttgccatgtggttttgacgaatgtctttttttttaaattgtgcatttttttttgttttttactttattgacgagtgtcttaaacagatcagttactttaaaaaaatctttaaatctgaactgtcacaaaatgaacatcatgtttcatcgattcaccagagctatttatttgttgta

SEQ ID NO: 610425 - DNA, 571 bp, Homo sapiens
gacccccgcctaagtttcacacgccagtcctttgtggaccgctccctcctcactctgctggggcacctgaagcctggatgctttgagagaattcttcagcacaattgtggtggatgccattgatgtgttgaagtccaggtttacaaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctgatcgacctgaagcgccgctataattttcctgtagaagtgaggttcctatgg

SEQ ID NO: 610426 - DNA, 101 bp, Homo sapiens
atatctacgatgaagctaataactcttttagcgcaagcaaatagcagctggtgtgctcaaagataaagaaatgaaaatatgaatgacaatcaacatatact

SEQ ID NO: 610427 - DNA, 551 bp, Homo sapiens
  misc_feature (109)..(109): n is a, c, g, or t
  misc_feature (522)..(522): n is a, c, g, or t
catttttgactgttaaaattctgtctgtctaaaggatattaagtattaaatttgatatattctataagatatatttcatgtttaataagaccaaagataattatttttnacctttttgaagctaaatgaatctacctttgatactcaaatcaccaagaagatgggctactataagattctagacgtgatgtattctcgccttcccaaagatgatgttcatgctaaggaatcaaaaattaatcaagttttccatggctcgtgtattacagaaggaaatgaacttacaaagacattgattaaattgtgctacgatgcatttacagagaacatggcaggagagaatcagctgctggagaggagaagactttaccattgtgcagcatacaactgcgccatatctgtcatctgctgtgtcttcaatgagttaaaattttaccaaggttttctgtttagtgaaaaaccagaaaagaacttgcttatttttgaaaatctatccaaccccgatgcggcaggttggtgatnaatcgcgctacatttgtggaaggtaataa

SEQ ID NO: 610428 - DNA, 135 bp, Homo sapiens
ccggtggacctggcagcggctgcagccgacttggaatgacctgggggacaggttcgacagcgtgggagctccacagtgtgtgtggctcagaggtctgcttctcctgcgtctccccgaggcaccgcggggcaatcc

SEQ ID NO: 610429 - DNA, 498 bp, Homo sapiens
  misc_feature (344)..(344): n is a, c, g, or t
  misc_feature (352)..(352): n is a, c, g, or t
  misc_feature (471)..(471): n is a, c, g, or t
taaagtatatattgaattacattgagtgtctttatagtatctattgagattattattttttactttaactgattaatatatcgttacttacattaattgactttcttttttaaaattatttatttatttatttttgagatggagtctcactctatcacccagtctggagtgcagtggcttgatcttggttcactataacctccgccttccaggctcaagcgattctcccacctcagcctctcgagtagctgggattacaggtgctcatcaccatgcccagctaatttttgtattttttagtaggacatgggggtttcaccatggttgggccagggtgggtcttngaactccnggacatcaagtgatccacccaccttgggcctttccaaagtggctgagatttacagggcatggaggcacccacggcccaggcctttttaaaaaaatattaaggttttttaaaaaattttnatttaattttttggaggatggggtttg

SEQ ID NO: 610430 - DNA, 411 bp, Homo sapiens
  misc_feature (177)..(177): n is a, c, g, or t
tggggatccctccctattggaaagaactgaatatagggaagtgcccagaagtcctttgggacccctcataaacctaatgactcctttgagctagtctttatttataactaatgattctgctaattggaccgttggcaagagggaagaagcctccacttggaagtacccctttaggtnttagactttcgcccgaattgaatgtgttttcagctctccagactatttgtagtctgacagtgatatgccttttgtaataaacaccactcaacaatgggctgatagccaagaaattcagtgggaaccggtgctgtggcataggcctgtaatactagctacttagagggctaaggtaggattgtttgagctcaggagtttaagatcaacctgggcaacctaatgagactgcatctc

SEQ ID NO: 610431 - DNA, 846 bp, Homo sapiens
tccttattgacggttgacaattgtggttcttttgaaaagcggaaattccccgagtgtccgccgcgtttccaaggatggggcttttgcgccgggttttgtgcgcaccccgtccccccagtgggcccgatggtccctcgccccagagtggtggtccggatgttccccaaatgggggggattatttccgggccgccccgtttatgcagcctccaagatgtttgggccaagttcgctagtcgccgagcataggtgcccaccatgtagctgcctccccagtatcacttcgttcttgggtaattgttttctccgccgagaaatttgttctggaagcataatggtccctggttttgaacaagttgctgccccccaccagaggtgccttcctatggaatcgtaggtaacagcagggagaccaagatggggctttccttcgcaccagtcagttcatacctgatatggatgctcccgtcttactaccaaagtttgtgtagaagtccagcatgacgcggtattagtggtaccaacaaacgcggcgggggtgagaactttcactgggcccccccaaacattgatagatttggcacttctttcgcccccacagttttcacattacacgcagtcttttacaatcccctctctgttctcgtctcatatccatgattgattctgatactctctgcccacaatcactccctcatatttatggccgccactaattagcaccacacatcatttggatacttgtgtgacaagtggagagacgacccatcccatcttctgtccacccacttcttatacaccccttctaatagagtccccaaacggacatcctacaaacaaacatgcg

SEQ ID NO: 610432 - DNA, 1272 bp, Homo sapiens
tgttattgttgcgggggttggtgtgttgttgctcgcggctggtgtccgtgtgcggttcttctccgccctccttcgtttttgtttctcctttctctctttgtttgcgcttacgcggggcgtggtccgatccgtctcgtgctctgcttcgtcgtttgttcttgctgtgcatgtgtccgcccgccgcgggggtggcggcgtgcctgcgcggttgttttttgcgccgcgctcgggcgccgtcgtctgtggtcggtcctcctctgtcttgttctgtgtttttttggttggtggtggttcgcttcttgtgtgcctctcgacgcgtttttgtttttctttttgtgttgctgtccggtcgctgtcgctgcctcgtgccccccctggtgagtgtcgctcctgctgtgtggtctcttgtgtggtctcgccccgccgtccgttgcttgctctcgtcggtttgttttttgttgttggtgtggttcgggcctgctgccggcctggcgttggtttctgttgttgtctcgtccgtccgtccagtctcttcgctttatggctagtctccgcgtctgtctttctttgtctctctcggtctcgctgtttgttttcttctttttttcttctctctcgctctctctccgctctctcattcgtctgtctctctctgtatctgcgccccccccgtcttggtggggtgggggacctctctcgcggggggttctctctcccgctgccccccttcgtgcgcgtgtatgttttgtgtcttgccccgccccgctcacagctgtttctccccgctccccttttttttctctttgctcaccgcccgggtcgcgcggcgggggccgctctctcctctctcgcgcgtgtagccctctcgcgcttgtttttgcttcctcctctgggttagccacgcacctctcctctcgcttatatagtaatatcacccgcctctccacgacgctgcttctttttctcctcctctcgcgggtggttcccccccctctcggtgcgttttctcacactcctcccctttctcccgcgcgctgcgcttttcactcccccccctctctttctccccctccccccccgcgcggcggtgttatttcccgcgcccctctctttctttttaattcttttggagcccccccccctttttttcccccctctctcttcttctgatttatatctctccctcttttattcttttctatatatacgagcgcccctttttctctcctctttacccccccctcctctcccccctctctttagcgcccccca

SEQ ID NO: 610433 - DNA, 454 bp, Homo sapiens
ggagtcttaccggatgtgagtaggaatgcaggaatgtgatagaattggtgggaagagggagttgaggtggtgggtccaagaagtctctccaggagatgacatttgagcagtgatctggactagtgaaaaagcgctgactgacctcgcgaggtgagacgaacttactgggctgaggagaaggcaagccatcaaaaaccccaaggagggagtttggtgtgttcagagaactggaaggagggaacgccatgaaagagaggccagtagcatgtgcggggccgagagggacccggcttcttagcccgtggagagagaaagcaggaacttaaagccagcaccaacgggaacgggcctgcatctggagagcgagggagagcagctgcaggttggtcaagctgctgtaaggccctgcccagggcatacgaaacaccagggagctacttaccctgtcctcggg

SEQ ID NO: 610434 - DNA, 445 bp, Homo sapiens
tgcttgatgactgcataggttgcaggtgagccgagatcacaccactgcactccaggctgggcaacaagagcaaaactctacctcaaaaaaaaaaaaaaaaaattctcccatggcctctgtaatagcgcagaaaaacatataatggtatacccccattctgggaaagaatcagcatcacctctaaagagctcttggcaaagggaagccaggaggcaggccctgtgtccacagttgctgtccagcactccagtttgcttcttgccatttggcatgggctgggcgggcccatgtagggcaagtggtgtcccaggggctggcccggggtggtcatgcctaatgccaggtgagaccataggtgtctgataaaggccaatgccatagggcgggggtgccaagctcagggcgtgattcccggaagaagacctatactgaggaagccattgaa

SEQ ID NO: 610435 - DNA, 306 bp, Homo sapiens
cctcggcttcccgagtggctgggaatacaggcatgtgccactgctcctggataattttttgaatttttttttgaagacgggtttcaccagcttggccagcatggtgaaaccccatctctattaaaaataaaagaataaattaaaaaaatacccaggcgtgctggcaggtgcctgtagttccagctactcgggaggctgaggcgggaggactgcttgagccttgaggcggaggttgcagtcagccgagattcgtgccactgcactccagcctgggtgacagagagagctccgtctcaaaaaaaaaaa

SEQ ID NO: 610436 - DNA, 260 bp, Homo sapiens
tgacagcacctacggctggacagccactatggagcggatcatgaaatgcctcaggcacttcgggagcaagtccaccatgggctatatgagtggacatacagagcacctggagatcatgcctgatcaccctattgtggaaacgctgcggcagaaggctgatggccgacatataatgataaggcaggttatggagtcaggcgagtgctgtctgttcgaacatacagtcctgctaatcttctggacattttcctcttgacgtg

SEQ ID NO: 610437 - DNA, 169 bp, Homo sapiens
cgacaccgtactgccacgcagccgcggcgcatcacgcaagcagaccggatgcacgagatgattcgtgaacgctggggtcgcgcgactccctgctcctgctgagaaacgcgcgtgagatggctcttggagcactatttgcgacgctcagctccagctaccatctactact

SEQ ID NO: 610438 - DNA, 329 bp, Homo sapiens
  misc_feature (69)..(69): n is a, c, g, or t
ccatacactactctttttttgataataaaaaatgtatttactgagccagttgtggtggctcacgctatnaatcccagcaccttgggaaggccaatgagagtggatcagttgaggccaggagtttgagaccagcctggccaacatggtgaaatgccgtctctactaagaatacaaaaatgagccgggcacggtggcacgcacctgtaatcccaggtactccgaaggatgaggcaggataattgtttgaactcaggaggtggaggttgcagtgagccaaaatcatgccactgcactccagcctgggtgacagagtgagtctctgtctcaaa

SEQ ID NO: 610439 - DNA, 453 bp, Homo sapiens
  misc_feature (95)..(95): n is a, c, g, or t
  misc_feature (196)..(196): n is a, c, g, or t
  misc_feature (203)..(204): n is a, c, g, or t
  misc_feature (224)..(224): n is a, c, g, or t
  misc_feature (239)..(239): n is a, c, g, or t
  misc_feature (245)..(245): n is a, c, g, or t
  misc_feature (322)..(322): n is a, c, g, or t
  misc_feature (327)..(327): n is a, c, g, or t
  misc_feature (353)..(353): n is a, c, g, or t
  misc_feature (365)..(365): n is a, c, g, or t
  misc_feature (373)..(373): n is a, c, g, or t
tccaaccgtaggtatgaatggtgaaggccatattatggaacgcacacacagaaagctctgggctccatttcccttccacagtgcacttgacagantcagcgccattcagataaaacccagtgtcacaagaaaacctgatcgtgttggaatatctcaaaattcgtatagcgtacggctccattttctaagattccancaaaagnncatcctctgggtgtacattncaaagtgttaatggnccacantccgtgtaagaggccagataacctttctcatccctcctcggcacacatagcccggctcgcaggaatacgtaatctcntctcntggctcatagaatgtttttaacgggnccactgtggaanatggtatntcatctggcttggcacaggtccgtcccgctatagccacatgacagagaactctcgagcacaatatgagctctggagatct

SEQ ID NO: 610440 - DNA, 120 bp, Homo sapiens
accggacgaggctgtgtcctgggccctcgagacgtgggacgggacacaccatgcctcctcagataccacttgtgtccactcccgctgaggccactcccactgcgtggttgaagcctcgag

SEQ ID NO: 610441 - DNA, 216 bp, Homo sapiens
ggggggggggccccatttttttttccccccgggggggcctttttgaaaaaaagggggttttaaaaaaggtttttttcctggttttttttttgttgggggggcccccttttttcccccccccattttttttgttaagaaggggcccccccgggggggggtagggggggtcccaatttgggtttttttcctttttattttttgggggggtttttttta

SEQ ID NO: 610442 - DNA, 399 bp, Homo sapiens
  misc_feature (95)..(95): n is a, c, g, or t
  misc_feature (142)..(142): n is a, c, g, or t
  misc_feature (149)..(150): n is a, c, g, or t
  misc_feature (170)..(170): n is a, c, g, or t
  misc_feature (185)..(185): n is a, c, g, or t
  misc_feature (191)..(191): n is a, c, g, or t
  misc_feature (268)..(268): n is a, c, g, or t
  misc_feature (273)..(273): n is a, c, g, or t
  misc_feature (299)..(299): n is a, c, g, or t
  misc_feature (311)..(311): n is a, c, g, or t
  misc_feature (319)..(319): n is a, c, g, or t
tccaaccgtaggtatgaatggtgaaggccatattatggaacgcacacacagaaagctctgggctccatttcccttccacagtgcacttgacagantcagcgccattcagataaaacccagtgtcacaagactaagattccancaaaagnncatcctctgggtgtacattncaaagtgttaatggnccacantccgtgtaagaggccagataacctttctcatccctcctcggcacacatagcccggctcgcaggaatacgtaatctcntctcntggctcatagaatgtttttaacgggnccactgtggaanatggtatntcatctggcttggcacaggtccgtcccgctatagccacatgacagagaactctcgagcacaatatgagctctggagatct

SEQ ID NO: 610443 - DNA, 421 bp, Homo sapiens
ttttttgtttgtgacgttggggttctcaccgttttgcgcagcgtggtctcaagcttgtgagctctattgctctgcctccctcggcatcccatcgtgtgcctattcttctcaattcctccgtgtagctctttctctgtgtgcttgtctccataatgtgtgtctcagttcttaccctcacgttctcaggcgtaatgtaagctacgttctcgtattgtcctaatgtatagtcttctgatctagcgtctcgttcctttctgtcggttgtagcttaggcctggcttttgcttctgtgttttagatagatattttcatagtatgttctttgtactgttctatatctgtaggagtgagagagagagagtgtgagagacagagagagagagagagagagagagagagagagagagagagagagagagcg

SEQ ID NO: 610444 - DNA, 1509 bp, Homo sapiens
ggagggtttgaaacatggcggacgacgtagaccagcaacaaactaccaacactgtagaggagcccctggatcttactcaggctcagcctagatgagcgaatttatgtgaacaactgacgaacactgacccgcagacgcttcgacggcacgacttacaatgcttatgaatcaaaccatttcaaatactgacctctcggcgacgactgtggcaagaaacctgctgacctacctatacgaacacttgacctgaccgaaaaacactactgacacgacggactactactacacacctcaacaccgaacacaccggcaactactctcccacacctgcctccttatgctccgcgcggcagactggccgattagctccctggatttgcccccttcacacatggagcaagctcgggcctgaacaccacacgcacactttcctccctcgctacatcgagacacaaacaggggcacgaacctttggtacacgattgggccctccctcttacaacagttacaaaacacaatctccctaaacagacgaaacaccccttgcactaacacttccgtcgactactatcaacgaaaactacactatcccgcgacgcaactccctattcccacacttcccttgaaaacactgcacgtctagccctattctcgcccagcaattcacaccctccaaaaaaaactatccctttcacaggcccttcaaacacttgaggctcactttctcccaactctcttcctccttccgataggaccttctacacgaacttaacacttcttgcaacccccacgccaaaacgaagttggcccagcaaaccttcttcccaccacacacggacacacacaccccacccacaccccgccccaccacaccacacagcaccctccaccaccgcaccacccaacagacggtaccctacctgcagagacaagactggtcggtgataggaacaagacacaccagtcggtacaagtcgtgacgccgcccagtgggcgcgccccaaccatcacgaggtcaaacaagcgcccacccagtgaggcgaccacaaacaaacacggcagccacacagcaggacagggaaaataccggggcgggcgcaagtagcagcacacaacgcggcgagagagaggccacttacagccacaccagatagatgacaaacacgccaccgccaggaggcggaagaacacagacgcagggactcatcgcgccagcaaccaccaacaagtagcatgaagcccgacattcacggagacaggacacacacatacgagggaccgcacacacaacaacaggagcgagagccacacagcggcgcgagaagcgacccaaccacattcaaacattaacgccagcacacggtgctgctgacaacacacaaccacagcggaccagcagacgcaactgtgtggagccaccaacaagcacgtagcaagccgacacacagacacacgaagcagaacaccagagcaagagaagtgaccggcaggtagcactatcctacgaac

SEQ ID NO: 610445 - DNA, 494 bp, Homo sapiens
  misc_feature (228)..(228): n is a, c, g, or t
acagttgcggtgggtgtcatcagaatgcagtggacaagaaggctgctggagtctggcaaggtcatccaaggtctgctcggcagaaacgctcaaaaggctagatgaatattatccctagatacctgccaccccactcgttgaatcaggtggtggaagaacggatctcagaagcgtggttggtgtcaagtatggccattataagtgtctagataggtacagagagactgngttacatgatacacaagtgccatcgtaacaatccttcaggaaggaaaggagtaatgtgtagtggagccacttatggtttgcattttatgcgtgtggcagttttaatgttattaagtttgttaataagtcagatgactatattataattggagaagcgaacctttgtagcgcgaaacaattgtggtcagcagcaaattgtatgaggaccgccaattagatgagaagcttaaagtgatgacataaaagaaaataactacaacacaggg

SEQ ID NO: 610446 - DNA, 362 bp, Homo sapiens
  misc_feature (74)..(74): n is a, c, g, or t
  misc_feature (185)..(185): n is a, c, g, or t
taattggaacctctggcctgtatccacacagttggcccacactgggctcccaagacatttttccttgtgattcntgtcagtttcaatttaacgtaggctgagcatggtgactcacgccctgtaatccccaagcgatttgggaggcccaagacgggaagattgcttcagccccaggagtttgaganccagcctaggcaacaaagcgagacgccgtctctacaaaaatcttaaaaattagctgggcatggtggcatgtgcctgtaatcccagttacttgggaggctgagatgggaggattgcttgagcccaggaattcgagactgcagtaagctatgattgtgctactgtacttcagcctgagt

SEQ ID NO: 610447 - DNA, 216 bp, Homo sapiens
tttaaagaccataccatacaggcactctcctgacatctgcccggactgactgcttcggtacagaactattcttatatcacatgtttggaggtagctgttagggggctttaaaaaatattacttgcttgtgtggaaatgcaaatacatgttattttctttatctaaatataagaaatctcttgttatcagtgctattgaaacttctaaaactaggga

SEQ ID NO: 610448 - DNA, 265 bp, Homo sapiens
tgcgggcgtgctgcgcggacctggatgcagagggtgctgtaggctgccgtcccctgtgcggctgggctgacaatgagtgttcttgtcgcgggtgcgttctcttgtcaccgtggtgctgcccatcttccctctccccagcctttacctggcccagcgtgctcctgctgaacactgtacggtctcatggaccactaaacgggagccgtctccaagagagaacctcgtgcctagttcgaccgtcgaccatccctatactgcgttcctc

SEQ ID NO: 610449 - DNA, 1272 bp, Homo sapiens
gtggaaaggaatagacgatgtcatagtcaaacatggtcgttgcatttggacacgctagattcgggcaagtacaccactacttggccatctgatcatataaatgctgcgtggcagcgcacaagagagaaccgattgacagaaacttagagacaggaggctgctcgagcatgcggacagagggctccttcaagtatgcctgggtcttggatgaaactcgaaatgcgtgagctgtgaacgtaggtatcacccattgatatctccgttggtggaaattctgagaccaagcaacagtactatgtgactatctattgagtgcccccaggaccacagagtactttatctaaaaacatgattacagggacatctacaggctgactgtagctgtccctgatcagttagctgctaggtagtgaggatgaattctgaacgctaggatctctccaaggaatgggacagaccacagaaaggcagtgcccattctggcttacacgactagtggtgtagaaaacaaacttaattagtcggtggtaaacgaaaagtggatatcgcacatgagccatcgctacagacagaagaagatatgaggaaatagttaacggaagtcaagtagctatacattcaagaacaataggatacataacccgagaacaagtagtagatatagtgccaaagttacactggtcggaatgtgtagaccaagctagtgactgggagccaaagtagctaagattgaccttggtgacaagggatggcaagttagacgcagtaggcatggcaatgcacagcgggaaccatcgctgctaagaggccacatggacgtaggatcactagcaccaacacggccaacacgacaagccatagagcccagcaccctccaggatgtataaccaaaaatgatcaggaagaggaacaggcacaagaagggcaagacagacaaactggagaaacaaagccggaaggagggcacacaagaggcaccaggaaagagaacaacacaggcaacaaaaagactgacgggagacacacaagaaaaataaaaagaaggcaacacggggcaccacggggggacaaccacaaaaagtgaagacagatgctcagagccacgtagggcccaaaagtgcacagggagacgaagcaacaagagaggaaaagaaacaaaagaagcaaaacaacaataaatgacgcacaacgcaaagaaggacatagcgacgaaggaggacgaagagacacaaaccacagccgccaacgtcacatactgacgcaaccaaacca

SEQ ID NO: 610450 - DNA, 402 bp, Homo sapiens
  misc_feature (67)..(67): n is a, c, g, or t
  misc_feature (308)..(308): n is a, c, g, or t
ctttctctctgcaaagcaggaatacactggcctacagtggagactggaagtgtctggaggccttgtntggggacaagggccttgcaggcatcatggatgaagccaccctctcaggccctgcccccagatgttctacttttctatcccgatctctctcttcaatccctagtccctgtgatttcagcaggaaaatatctagaattgtgttcaaaccacagggtcaggcagagtgaacttgtttttgaaacaaaaacctgaagctctgctctttgggctctgagtgaatgtggctctgcagtggccggcancccggtgtgctacctctgcgagagattggcagtcccagttcaaccccatcggggtcttaggttgaaccagtcaccagttaagttttttggctca

SEQ ID NO: 610451 - DNA, 299 bp, Homo sapiens
cgtgtatcacgcatgcgggagagggggcaggcgctggagtcacagcaagcattgcctggcacagtccccagcaacaggatgcccaggcaggatgggcagcagcgaggacaggctcgggtcccctcctagtgcagatgccctctctccccagggtcgggcagggcctgaggtgggagaggcctggaggtgggcagggccccaaggagattgtgctatcagggtgtgtccctgagaaagggccgcagaggcctgcccagcctaactctctccggcaccttcagaacccagaagctactgcc

SEQ ID NO: 610452 - DNA, 203 bp, Homo sapiens
  misc_feature (136)..(136): n is a, c, g, or t
  misc_feature (141)..(141): n is a, c, g, or t
  misc_feature (203)..(203): n is a, c, g, or t
tactcccaaaggctgggattacagatgtgagcacgtgcgtggccactccacacatttgatacattatgttccgtttttattcactttggagtgccttctaattttcttgggactttctctttgatccatggaaccngtggnctttagatgtgtgttgtttgagttgcagttgttgggagatgctcctattacctttggtggtn

SEQ ID NO: 610453 - DNA, 186 bp, Homo sapiens
atctattttcccccatttcccatccttttattatccccccgccaagcccctggaattaaaccaaccggagtctgtctttgctatggaatgccccctggggcctttcttgtggacttattgtttaagggttcccccaaccgtgattttttttaaccccataaaccatttttatgatcttggggggga

SEQ ID NO: 610454 - DNA, 177 bp, Homo sapiens
cttttggggtctttgctgtagtctacggaatggacgtgccgacacaagcagatggacaggaccatccccaggagctcgatgatggccacacccacgcccacgcagaggatgatgcccatgttctcctgcagccacgcatgcaccttgtacatgcagccctcctggtacacaggccag

SEQ ID NO: 610455 - DNA, 208 bp, Homo sapiens
tccccaaaacccggcacccgaaagggcccccccccttgaaaagccgccgggttttaaattaacccccccattcccactccccttgatttccctaagagttttggccatttaattccccatttggaaaggaaaccattggggaaatttgggaaaagaatttgtggtaggcaaggtttcattaaaattttcagtttttcaaggcttttta

SEQ ID NO: 610456 - DNA, 454 bp, Homo sapiens
  misc_feature (316)..(316): n is a, c, g, or t
  misc_feature (365)..(365): n is a, c, g, or t
  misc_feature (444)..(444): n is a, c, g, or t
tgacacagtttcactcttgttgcccaggctggagtgcaatggcgcaatctcggctcaccgcaacctccgcctcccgggttcaagcgattcttctgcctcagcctccccggcagctggattacaggcatgcaccaacacacccggctaattttgtatttttagtagagacggggtttctccatgttggtcaggctggtctcgaactcccgatctcaggtgatcccgcccgcctcggcctcccaaagtgcaggggattacaggcgtgcaacttgcgcccggccgagtccctgctttcagttctcttaggtatatgggntagggagtggaatttgcttgggttgtatttggtaaattcttattgtttnaactttattaggggaccatcaaactgttattccacagtgggctgcaaggttttttttaaaaatacattttatttttaancttttgtgag

SEQ ID NO: 610457 - DNA, 636 bp, Homo sapiens
aacccaaaaaaaaaaaaaaaaaattttaaaaaaaaaaaaaaaattaaaaaaaaaaaaaggaaaaaaaaaaaaaaaaagaaaaaaaaaaaaaaaaaaaaaaaaaaaaaaaaaaaaaaaaaaaaaaaaaaaaaaaaaaaaaataaaaaaaaaaaaaaaaaaaaaactgtgggcccctttgtgcccaattttttttaacctttgaacttttttattttggggccgaattttgggtttttttggccaatttccttttttggggggctttttaaaattaatgggggcttttttaaaaatccttggtggggaaaaccctgggggttccccaataataattttttggaaaaaatcccttttttcacggggggggaaaatttaaaagggcccctcctatggcctttttccaaaattggatcttctttaagggcaatgggaaattgaaagggtaaaattttgtataaaaccgggctaattttttgtaaaaaacggtctatttttttaaacaaagggcgccatttgggaaaaatcctttttatttaaaaaaaatacccctaaatatgttttggggttttttccattttttacaaagggccttttttttcagggggctcctttgggcgttttttggggggggggggc

SEQ ID NO: 610458 - DNA, 387 bp, Homo sapiens
tccaatgatgcactgatcttttactgtctccataattttgccacataatttttcttctttttgggattccgaacctttttggactcatatctatagttttcacgagggcaaatttttagccattatttcatcaaatattttttcttctgtcatcccactcctttttcttcctaaaacttaattacatataaatgagatcttttggtattatttcatggctgactcaggctttttgttttcttttaaatctttttcctttcatggataatttctgttgatctatcttcaaggccccagactctttgtcatctcaaatctactgttaaatccatcaagtagtgtttttttgtttgtttgtttttctttttttgtaatttcagtggccat

SEQ ID NO: 610459 - DNA, 866 bp, Homo sapiens
  misc_feature (774)..(774): n is a, c, g, or t
ttggtttaaaaacggctttttctttatttggcttacttaattttcaaaacaaattgaaaaaaataaaataaaccacaatacacaacatccaatcctggctgtcaaaattaaaaagggaagggggtctgtgacccctttaagttttacttgccttctcaacacaagggacagggaagaggagaaaaaaaacacttagaccaccagcggggggacgccaggtgtgggacagggggcacctcgaaggctgcagtgtggagacgcccatgtggggagacactatatttacagggcgccccaagttttctcacaactatatgtagaacttcctatacacctatagatctcagactttcttctccatgtggcgaagaagcggcattctcttcacacccagcggcgtctccgcgggaaccggcggtgcgggctataagttctcaatagaaaatccggcggggagccggacccgctcttcatagagaggttactccccctgcgagaggggggggcccccaaaggtttaatagcgcgcgttatacccccaaggttttctcctcgtgtgctgctccacacaagaggtggggtcccccccatattatatgaggtgctaaagaagtccttccgcataatttttttatattaaagaggcccattaagggggccacagctgtggggccgccggcttccggttcttttttttacacccacaacgccgttttttcggttggtgaacactcggtgggggggacacaaccacagcggtggcgctattaaacncggtggggggggacaaactacctcttgtggtgcgcttcacaacgacgggggacaaaccccccgctttaaaaaactctcttcggtcgggagga

SEQ ID NO: 610460 - DNA, 114 bp, Homo sapiens
ccacatctccttccctggcagatttctgagcacccatagtgaaggcagcccctccctggcttaggagcactcgggggctttgcgtactccaggctcagtaatgaccaatcctac

SEQ ID NO: 610461 - DNA, 386 bp, Homo sapiens
tcttcatagaattgatcaccttcatatatatatgaaatacatatatataaataaatatatatacatatatatatatgaaatagttattttgcttgttttctgttctcccgagacaatagaagttccacaaaagtagggattttgtctttcttgtccactgtttatccagtgcataatatagggcccagaacctagtaagcactcaataaatccttatcaaatgattgcattcactgtatttcacaacacctggtcacatcaattagttgtgaagattaaatgagataacatagatgacacttagcacaagagaggaggcagaggcttaaaagagttgaagctgctgttacttctatttagactttttgtgcctctaccagagcact

SEQ ID NO: 610462 - DNA, 291 bp, Homo sapiens
  misc_feature (168)..(168): n is a, c, g, or t
aatatacggcggttaacttgtatttaccgctctcatgggcggcctcgacgaactggcgagtgatccagttcgtaccaatcacagcgaaacgtatcataacgcgtggatactccataaagggattctgtcgtcaatgtagcacgcctttttcatcttcgacgtgcgcanatacgcattatttctgcgccggacagccatgctcactaaacgggccaatcatgaccgaaggccgagatatttcggctggcgatggaggattttcgcgtcaatcacggcgctgacacgagcgag

SEQ ID NO: 610463 - DNA, 673 bp, Homo sapiens
  misc_feature (150)..(150): n is a, c, g, or t
aacctacaaatgccaatccaaggttcccaaatcagcccgcacatcctaaggcgtaccggcgggttagtttgtaattaccggcttaaacctattccgatctcggggtggtagggaggaaatatgggacttattcaggtatctacggaccgnattgagggaccctctatcctcgaattgttggtactacgctaactttgacgacggggccgcgagatgggctaacccggagaggcgtaagtctttttgggaggcggtaaagggggcggatccatattctcgcgagtactatcagtagcgttgcttccgttagtagcttcttaactatctcgagaggtcgcgttttaaggagtataggcgggtatatcgttactctccggagaggaagtataagtaacctaagccacgcgactaatacggttcagaaccaaacgacccaaatcgttcgcatgatcgcctcgagagtaagcggctgtagaccgaagatctgcgcgagaggaattctaaggaccgctggactactctccggcgcgatcgtaccgcattttgctagacggatgaggacgaccataaggaccctcgactcaagccctacccgacccgtaagtagaggtagatttgtcagtacttccacctaatgtgtagtaacgtccaaagcgtcgaagggacgatacta

SEQ ID NO: 610464 - DNA, 195 bp, Homo sapiens
gactctgaggatctttggatgatggaacgtcactggagagagtaaaaaaatttaacacccatatgtaggcctaaaagcagccaccaattaagaaagcgttcaagcttcaacaacccacatacctataaaaatcccaacacatataactagaactccgtcacacccaacttggagggtaccgacgctcgacattcg

SEQ ID NO: 610465 - DNA, 257 bp, Homo sapiens
  misc_feature (192)..(192): n is a, c, g, or t
actcgatccgctgatccagcatagtcttctttatttggcttctaataaagcttcctaccaaggatggcaccttagaaaacaactctaagatcatcttctggcaaggctttctcataggggtcatccgggcaacagcttcttccctcggttatgcttcatccatggtactcacacggtgatgggcagactcgntagcatcagctggacccttagactggttttccagaaactgggcaccatgaccaagagggattttt

SEQ ID NO: 610466 - DNA, 457 bp, Homo sapiens
gaattcggcacgagctatgcccggctaatttttgtatttttagtagagacggggtttcaccatattggtcaggctgggtctcgaactcctgacctcgtgatacggctgtaatcccagaacattgggaggttgaggcgggcagatcacaatgtcaagagattgagaccatcctggctaacagggtgaaccccactaaagataaaatttaacttatttgatataaaatcatacaaaaaaattgacaaatatacaatggtatttagctttcttaaggccctaagatggccaggtaagtcacaaggccctcatcctgaagccacagtgagcaagggtggtgaaggccacaagaaggccaagacattagaagggcagggctcagcctcccctgggtggcgctgaacaagattggggcagggggtgcaccattgcgcttaggcccagatatcacgaaaatctt

SEQ ID NO: 610467 - DNA, 212 bp, Homo sapiens
ggctgctcactggaatgacttgggagattggagaacagcaggcagtgatatcagtgggcccacccgcaccaggaggatggaagcaggtgaggagctagaccacactgaggcggatggtcgggactcggggttagctcagatgagccgttcacatatagtgcatggggcacgttcccctgtctgacatttaaggtgacgacactcagtgtcca

SEQ ID NO: 610468 - DNA, 817 bp, Homo sapiens
ggactagtactcccgtgaggcactttccttggcgcctcctgcgtattacatgtatccgatgactggctgtgttagcctcgtaccatctgtaaatgaagactgggtgccttccccgaacacaccccaattgccttcccagcttggaagccaaggcagctgatgaataggagctcacggagagccgtcttcaggctgggctggggttggggctgctgtgaggaaaacctgccattgtggccctggagagtcaccagcggctcgttggtaaggacttgctgggagcgctgagagacggctttgggtcaccgcctgctgtcttgttccagtttcctagggtttccttcattgtcttgaggtctctccaggatttctggttgtcttgctcatttggccaataaggtaggacaccagggcaggctggctgggcgtggcttggacagggcatgtgcggcgggtccccgagcccgtcgttcagggtaccgtggctcgtgcgcgcacgtacctccgggtgcctgtcgcaagcctcgttcaggctccaatgcgttgagggcatggcagatgtgtgctcaggtgagcgttgcttacgttgaccagggtgcacccggtggtcgttagcccgtgagcgcgtggggcctgctgcgtgaccgggtctgggggtgtatcgctttcttgcaggaaagcgttgggggaacgcccctcgcagtggcacggggtgcccttagcttgtctaggcgtagggttccttagggagcggttgggttcccccttgccggaccttccccactaggatcttgaccccttgtgtagttgaggtaga

SEQ ID NO: 610469 - DNA, 380 bp, Homo sapiens
  misc_feature (1)..(1): n is a, c, g, or t
ntgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctgggtccctagcattttggataagggatactcagcttgtacctatatattcatatatattcactggttggttaagaaatggtttaagttgct

SEQ ID NO: 610470 - DNA, 89 bp, Homo sapiens
gtaagggtcctttgtataactttaaacgccccttataggagtttcaaactggaaaaagggaaataaaataactcggtttgcggccccca

SEQ ID NO: 610471 - DNA, 311 bp, Homo sapiens
taactcctgcactcaagggcttttcctgccctggcctcccaaatgtattaggtattacaggcatgagccattgtgcccaccgtctctgacagggtctcactctgtcgtccaggctggagtgcagtggcacaatcttggctcactgtagtgtaggcttcccaggctcaagggattctcccaccccagacccccaagtagctggaactacgggtgtgcaccaccaccacacctggctaaaatggtgaaaccctgtctctactaaaaatacaaaaacttagccgggcgtggtggtgggcgcctgcagtcccaga

SEQ ID NO: 610472 - DNA, 161 bp, Homo sapiens
actagggcttggacatgatgtgagtctgagctgcgtccggagtcgcacggatggtcttgtgtgtggcacggcacacgtggtttgcagacagtgcccaggtactcctcagcagagctggaggacagcaaggccaggaccagccccagcatgcagagcgctct

SEQ ID NO: 610473 - DNA, 147 bp, Homo sapiens
  misc_feature (97)..(97): n is a, c, g, or t
cggatgcttgtcgaggtaccaacatcgacttatacattgacggcaacactccctccctgccatcccagtagggatgggattgtactgtattccctanctggtttacccttcccccctgtaaagggtaacattttcccatgggtgcag

SEQ ID NO: 610474 - DNA, 694 bp, Homo sapiens
tggtaggaaaaaagggtttggtacttgggatgaaacaatataatttcaaaacttacagataagggtaagctctatcactcaactctttaaaaagtttatatgaatatccagtcaaaaccaacagggttattgccctgtaaaatgttaactagagggatttccaagggagaccacaggactgtatacggtctgtggaatgtcctcagaaggctctgtcattgatcaggtaacagtaaaaaccccagagtcctttctttcaaagtggaaagagggaaagcagagggacagaagctattcaaacttgcgtcttctttccttgtggctttgtggtcaccttccttccttcctcgtgcctcctcggaagccttcctcgccctccaaagcctccccggcctctgtgccaccaaattccgtccgtcggccctcctcttaccaccaccttcgtcctccaaagccgcctcgtgcctccaccaggacccccgaagccaccttcacccttaggtttgggcccagtccaagggtaactttatttccatcaatttcaccggtctttccagggcctcctttggcagctttgggaatcctcctcactgttgaagtctacaaaaccaaaccctttgggaggacccagtttcccgggtcagtaactatcctttgcccagaaacggagccgtcaaatgactccttaaaggca

SEQ ID NO: 610475 - DNA, 786 bp, Homo sapiens
ggaagaaacctgggctctggtcttcaatggcaattacgactgagatgccttaaaacagaacagaagtaatacgatcctgcctagattaggaatgtaacaagctgttgccttaggttaaaatgtctgttcctgtggatgagctgattactgaaatggagagtggttatgtgatatgggacatcagtattataccattcagcgaacagttccttgttgggtaaatcgataaaatgatctttgatctgaatccataataactttttttcaaatcacaaaatcaagggtgtacgttataccatatggaaaatccgtaaactgctgtgcatgccatgatgactgactgtgacttgttgagcatgcttgtgtgtggtgatgccacgagagatcaattgacatcagggtaagggagggaccatgatatggacgagggcacatggcatcacaggagccctcacgagacaggacggaatagacaacgcaaagccgagacaccgagtataaaagagcaagaaaaagaggcgaaacagaaaggaggaagaaaaaacggaaaacaaaaagacaagggaaatagaaaaaaaagaaaaaagaaagaaaaaagactacaagagaaaaaaaaaaacaaacgagacaacagaaaagagcagaaccgcgagagacagagaaaagaaaaaaacgaaacaacacgcagcaagcacagccaaggagacaaacgagagccgaagcaaaaacaaagaaacaaggacaaacaaaagacaggacagagtaaacacaaaacgacgacaacac

SEQ ID NO: 610476 - DNA, 135 bp, Homo sapiens
tatacgaatcgagcctgtacccttgtcgttatgagagtcgtgatggtgggtcattatgtgttgtcgtgcaggtagaggcttactagaattgtgaaaactgtagcttggattaaggcaacagcgattctaggatag

SEQ ID NO: 610477 - DNA, 389 bp, Homo sapiens
  misc_feature (18)..(18): n is a, c, g, or t
  misc_feature (35)..(35): n is a, c, g, or t
  misc_feature (116)..(116): n is a, c, g, or t
  misc_feature (151)..(151): n is a, c, g, or t
  misc_feature (174)..(174): n is a, c, g, or t
  misc_feature (232)..(232): n is a, c, g, or t
  misc_feature (273)..(273): n is a, c, g, or t
  misc_feature (278)..(278): n is a, c, g, or t
  misc_feature (286)..(286): n is a, c, g, or t
  misc_feature (330)..(330): n is a, c, g, or t
caaatactagatgtcatnaggatcacttagttganggagaagggtaaaaattaagcacctacatttagaagggatgggcacaatacagggattcctacctcttcaactggcttcanccccatccgaacacaagcaagggagaaatcagggnttgcagatagtcagcttactttnaattcagggcatgtgagggtttaagtctatcagtaacaatgatcagtattctcatgtnccagtcccttagccacacaatacacagtacatgctctaaancatgncaagatancatacagactcttgcacaagattttaaacccaggacctgagagngcaccatgcaccactgtccacacggaaacttggctcaaagcaaacaatgagcatgtata

SEQ ID NO: 610478 - DNA, 109 bp, Homo sapiens
gtctagaggacccagtgctcacgctcatctttaacttaaacaagtcgtcacaaagtttcccttcctcaaattttcctctaatgctatcaagcaaggataggttggagtt

SEQ ID NO: 610479 - DNA, 383 bp, Homo sapiens
actatagttttttattttaatatcatcggcagaaagagtacccagtttcgaagctctctggtgtgttgtaagaaatgaagcaaggatacgaaccccttctcccacaacaggccttaaatctatcttcaaaggtgacccagcaatcagtgtcaatgcctttactgtaattaacctggttatctcattctttagtctctccaagaaaatctgaagtgtattaggcaagtcacaacccaaattgtctccaaggttggaaataagttgtcccatacaggaaatagccctttccttgacttcctgatcaatgtcagcagcatttaatctcttaatggcacaggtaaatagatctttgattaaggagatgcttcaaacgaggaaggctg

SEQ ID NO: 610480 - DNA, 776 bp, Homo sapiens
  misc_feature (183)..(183): n is a, c, g, or t
  misc_feature (580)..(580): n is a, c, g, or t
  misc_feature (616)..(616): n is a, c, g, or t
aactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccgggttcaagcaattcttgtgcctcagcctcctgagtngctgggattacaggcgcccgcaccgcgcctggctaactttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctgctgaagtgttcaaaagttgtcaatcctcagccgttccctagtcctgttgcccggttctgccgaagccccttgaaggctgtggcctgggctgttccctcattcattcctgcctcccgagccaaacccaggtatccgcttgtgccctgncgtggtgtggcagcgtcttctctcgggaagggtcanggagtaatttcttctttcagtggcctctctgtgctagtcccggtcacctccgtgaattaaagtcctacaggtacaagggagacccccccccccaaggaaggcgcccccagtccgtgtgggaaattcccccacggtttctgccaggttctgcggctctgag

SEQ ID NO: 610481 - DNA, 300 bp, Homo sapiens
tactactactaaattcgcggccgcgtcgacgttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtaaaaaaaaaagtcgacgcggccgcgaatt

SEQ ID NO: 610482 - DNA, 118 bp, Homo sapiens
cgtgaaaaggcggggctgagcctggaggggcggggcgcggttggtaggggcgcggcctgatctggcacggtgcggggccgcagtcgtgcaaggtgcggggcgaggtaggtaggagcag

SEQ ID NO: 610483 - DNA, 1069 bp, Homo sapiens
  misc_feature (183)..(183): n is a, c, g, or t
  misc_feature (629)..(630): n is a, c, g, or t
  misc_feature (634)..(634): n is a, c, g, or t
aactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccgggttcaagcaattcttgtgcctcagcctcctgagtngctgggattacaggcgcccgcaccgcgcctggctaactttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctgctgaagtgttcaaaagttgtcaatcctcagccgttccctagtcctgttgcccggttctgccgaagccccttgaaggctgtggcctgggctgttccctcattcattcctgcctcccgagccaaacccaggaggcagaggttgcagtgagccaagattgcaccactgcactctagcctgggcaacagagcaagactgnntcanaaaaaaaaaaaaaaatttaaaataaaaaaatgcttttagaataatgatttaaaaaatattttggtacacctgtacacaggtgtgtttaaaccctaagtgttattacaaaaagagtcccaacactttcacataattggtccgggccatggagggctaatgccctgtaaatagccagccgtctttaggatgccaaggccagggcggacatcgattgaggtcagggaattccaagaacagccgggacaccaatggtggaaacccgtgtacactaatcaaatatgcacactgtgaccagaacatatgtggctccaggggtcgtagacccaggcaaactcagaaggatggcggtgtgcaacatcactgacgccgggaagcggagagctacataggtagcgatacccacatgacatccaggcgggcaacaaagatacctac

SEQ ID NO: 610484 - DNA, 146 bp, Homo sapiens
gtactacgtgtcctgcgtaaggtgtgttgattaatacttagcagttagcgagtcagttggtttagtagtaaacctagtgttaagaaagtagtctaatagttgcgctcggcacagtagtagttaccctgcagttagagagcaggcaa

SEQ ID NO: 610485 - DNA, 658 bp, Homo sapiens
tgcggggggtggtatttgtttggggcacatcgggcacgcccgtgtcacaccttgtctgtcgtgccgctgcggcctgcggtgttttgtcccccgcacaaggtggcgagaaagcgagagggccctcttgcgcaatccccgaggttgtgttgcacactgccctctctctgagacactcccacgagccccgagtggcggcactgaggccacgcccacggctcacgtccacggctcccctcgtgtcctgtggaaggaaagtggtccccactcccccacatgccccttattggggaagggaagggcgtctgaatgctctctctcttgcctcccccccactcctgtcacggcacacacaggtgacgggggcacacccacatgcgagcccttctcctgctgccatgtcgcgaagggccacagttccaccacatgaagaccacgacctgcatcccactgcgaccataagtgactcggccttgggacgtatttgaagcccttacttctgagatcctgtacccctttaagtccccctcccggcctcgaggctcacgggtaggaaaagaccccgaggttctcccgttacgtccttttacccttcccttccctgtccacccacatgacctttcataaatacataccataatacttacccagccggaaaaaa

SEQ ID NO: 610486 - DNA, 652 bp, Homo sapiens
  misc_feature (183)..(183): n is a, c, g, or t
aactgggagtataggtgtacaccaccatgcccagctaattatttagtagtagtaggaggagtattatgtttgagatggagtctcgctctgtcgcccaggctggagtgcagtggcgcagtctcagctcactgcaacctctgcctcccgggttcaagcaattcttgtgcctcagcctcctgagtngctgggattacaggcgcccgcaccgcgcctggctaactttgtatttttagcagagatggggtttcaccatgttgcccaggctggtcttgaactcccgacctcaggtgatccatccgcattggcctcccaaagtgctgggatcacaggcgtgagccaccgcacctggcctcaagccagtatttccctggccctaaatcattcctggctgggtcccagcccagtagagccagccccccagcccggagtgctgctgaagtgttcaaaagttgtcaatcctcagcctcccaccacgcccagctaatttttatttttagtagagatggggtttctccatgttgatcaggctggtctcgaactcccgaggcgggcggatcatgaggtcaggagatcgagaccatcccggctaacatggagaacccgtctctactaaaaatacaaaaaattagctgggcgtgctcgcgccgaaggc

SEQ ID NO: 610487 - DNA, 616 bp, Homo sapiens
gactgactagaggaccccaagcagttatacagactcatatttgcatatcattcacattacattcttaaagtctacacgttttgtttattagttcactaagaattacaactgggtagatatgtttgtggctactaatgtgcccaatttaccactggcaaagtcaaatttagctaaacacccattcaataactacaacaaatgaagtttgttttagctttaaggtagacatttgtggcctaggtgcggtgcctcacgtctgtaatcccagcactttgggaggccgaggtgagtggatcacctgaggtcaggagttcaagaccagcctaaccaacatggtgaaaccctttctctaataaaaatacaaagttagccaggcgtggtggcacatgcctgtaatcccagctacttgggaggctgagcgcaggagaatcgcttgaatccgggagggcagagatggcagtgagccgagatcgcgccattgcactccagcctggatgacagagcgagactccatctgaaaacaaacaaacaaacaaccaaaaaaacagatgactagccctgaggaaggaactccaagtgctggccttgacgatatttggtaggctccccactcctg

SEQ ID NO: 610488 - DNA, 284 bp, Homo sapiens
agctctgcatctgtgtttaggtgatcatgactcataatcattggtacgtagcatcttgcttaattccttgaatagtattagtgcgctgggcgcagcggctcacgcccgtaatcccagcactttggaaggccaaggcaggcagatcacctgaggtcaggagttcgagaccagcctggcaagcatggcgaaaccccatctccactaaaaatacaaaaaatcagctaagcgtggtggcagacgcctgtaatcccagctactcagggaggccgaggtgggcggatcac

SEQ ID NO: 610489 - DNA, 732 bp, Homo sapiens
tgccttactcgaattcctgaccattgtgacctctggagaaggtttcgattcctttagcagtttgtaaagagtggtacttacaaagagacagagtttatggtgaaggaaggagagagaacaacagaatttgataagaaaagaaaagcaaaaactaataagaagatggatcacattacaagaaagagaaaaacaagagaagtgctattaataaagcaatcataaatgggggaagcttaaatgttcacggttcccaaatcctaagcagtatttaaacaattcagatgtgtcacaaataaaattctcagagttcacagaaaaccagacaagaaaagagaaattgagattgggaatattatacccatgaagaagcaagagaaaagggatctttggaatttcaaatgtgcaggttatgaacaaagtcaattcttcaataaaaaattataccgaaggataatttcccaagtggacaaacaggggagttaagaaagaaaaacatgcgagatggtaataataggaagacttaaagcaggtgtggagagaagaaaagaaagcagtcttgaaagaaatgcgtaagaaagatggtaggcaaataagtaaaatctcgtgttacagacttccagtgaaaattagctgttgttaaaaatattattttcagcttaataagtaattgtagagggtgtactgaaagtgtgttggattatagacaggttgtgttgcatacactacgatgta

SEQ ID NO: 610490 - DNA, 560 bp, Homo sapiens
  misc_feature (56)..(56): n is a, c, g, or t
gggcttggcggattggtcgtggacgtggtcagccacctcagtaaaattggagaggnattctttgcatgaaataaacttacagccaaaaaaaaaaaaaaaaaaggccaaaaaaaaaaaaaaaaaaaaaaaaaaaaacgtgtgtgtggggcgccgcgccgcgcgcccccccggagaaagagttttttagaacccttgcggggtggggcgcgcgcggggcgcccacgagggaggtatagtggagacaaccgtgggcccaagagagggtgtctccccagagaggggagacacgcggggggcacagagcagccaggtaggggggcggtgggaggtctctttcccccccaagaataaaaaaaaaacaacgccgcggggggggggagacacccccgagggagcgtgtttccgtgcaaacaaaactctcccagagagcggaggagcgatctgcccgaggaggggcgctaaaatatgaacggggggggctctccatcatacaagacagagggggagctctcaacaaggagagagcccgcgtggaatatctaccaatatttagccgcccg

SEQ ID NO: 610491 - DNA, 188 bp, Homo sapiens
gaaaagagtaaactttcccccctgtctccatggtacaaaaattaatctgagaatgaaatggtattttgtgccaggcatggtggttcacaccctgtaatcctaacactttgggacgttgaggctggagaatcacttgggcccagaagttcaagaccaccctgggcaacatggtgagactcctatctcta

SEQ ID NO: 610492 - DNA, 701 bp, Homo sapiens
cggcacgagctcaaaccattacatgcatacacacaaccatatctccgtgtatacaaccacattatatataatcacatatactttatgcatgtgtaaccacaatactgttttcacatctaagaaaattaaagtaattccataatataatatcaagcatcaattaaatctaaattttcctaattgtctcaagaatgtctttgataccactctcacttctttaaaacaaacaaaccgacaaaacaggatccaaacaaagtacatcctttgtatttggttatgtttcttgtactcttttttaagaacagttcctttacccttttccttcctttgcctgcattaacttgtttgaagagaccagctctggttgtcttgtaggatgtgtaaccttgtgcattcattatttcctcgtggtgtcatttaactggtttctctagctcctctacttcctgtaaactggaagttaattgagatgcatccaggttaaacattttgacgagaatgcttcatcataggtgaagtgcagttcacattgagtcatatcaggaggcacttaatgacgggttatcccgttatgagcaatgctaactttgattccttggcgcaaccagatctcttcataatgaaggtaaaattttctcttctgcttttagaagaggaatctattggacaatattttggcacctctgtaaataccctgtttc

SEQ ID NO: 610493 - DNA, 116 bp, Homo sapiens
tgtagttttaagcttctagttagggggttcacttgttacacaagcataagaaaactaatacaggtggtgtgtgactggatgggatcactgagacagtggccatgtagataaagcag

SEQ ID NO: 610494 - DNA, 1943 bp, Homo sapiens
  misc_feature (217)..(217): n is a, c, g, or t
  misc_feature (501)..(501): n is a, c, g, or t
  misc_feature (556)..(556): n is a, c, g, or t
ctttacacctatacaggctagtataaccgggaagccaggtcatcacatgtacatccgcattcacgctatctgtccattggagtcgataattcaccattcaccaaaaaatcctagattgcgtgtgcgaatcgactggcagcatagagtagcctgtcagctagcatggtccatctatagagtagtcatctacagacactcattggtagcacagtgcctnggagagctcaatattgacagctggggagagagcacacgaactgagtcattctaatatactgcacacactcatctgcctgtctgactcaccacaaagtgattcagtctcatgtggcgtccgtatgtatacctaatctgtcgtgaatggtgatgcatcaaatttggacacattcaataggtaatctacttctaagtctaataggcactacccgtgcctacctgattcaaaacatgcagtatcacagagcctctctttgcggttgcgatcggtctaagaaatccatnagttacaatggaactttattgggtctcacttctgtgtggagaaatgcgtcgaccntcacatagatgcaaactatgtggacacctaatgacactaattacgatcatagacacaatcggcaacgggaaatgcacattgatagggtatagcgaccctctttactcaggggtgaaaagaacatagatcgagacttgattgacatttgtgtcgcggcccaagtgcgtataccatacactagaagacacaatttcaatttacacttcttagtcactttgcataactctttagtgaccagtctttgaccacaaccattggtctttgatagtggtggctaagatgtggttacaatttgctcgcgttaataaattccttgggaaatccgttgttgcccacgccattctatcgctaaggggcccaatttggtgactttttcttcccagattttgttacacccgttaaccattagccaccaaactataaggtttgaatccaaaggttggcggtttgggaaacccccttatagacacctctttgccgttacggatacctttatagaacagcaaacattattccttcgaggtcatatatattactgaggataataggaatctaaatccacataaaacaaacggctggttgggcatcgccccaaaggcagaagaatggtctagctttctaattacacttaagaggacttcggtctccgttaattaatagcagcgggccacgttcacctttggtggggagcaaaacagcagcttgtggaaacagaagtttcaggccccgtttgtgggggaggtaacttccctccaaaccttagggatactgttgtcgcgtgtaacgaaaggcgtgaaggagacacgccaaaacatcacattgtcccacacgcgccatctttggcgaccagccactctgcgtaggggctttggggacacattatagacagccggtgcgacaaggagagacacaccaacgttattagaggatgagaagggaccgcacatatggacgccgggggtactaacaaacacaacggcgaacatattcgagagaccgaccacggcgataacacagcgggtaagagcataggtgagcgccccaattatgagagccccccacacatgagtccccggcgtacacaggaggaacgtataagaaacgatcgcgggtgacaaccacacgcaggggccccaagccgaagatgggcaacaaaaacacgagatggccaaacagaaaaaaccgccctcaaggtaggatacgagagatcaacgtcgaccacacacacaacgtaacgacacgaccaaccagttgaaactcgtcagctcaacttccagaagagtaccaaagataaacactcgtacaaaagaacaagtagtaataaagacagagaaacaacagtagagagacacaacaccagagcaggaccaccacacacgagcagcag

SEQ ID NO: 610495 - DNA, 408 bp, Homo sapiens
atggaggagcagaggcccagaggttgaggtctgcagtgagctgtgatcacactactgcactccgtgcctgggtgacagagtaagatcctaatctgaaaaagtactgtaacaaagccaggcatgtgactcatgccttaatctcagtactttgagaggccaaggtggtaagattgcttgaagtcagcagtttgagaccagtcctgggcaacatagcgagacccctgtctctaccaaacataccaatcaaacaattagctgggtgtggtggcatttgcttgttgtctcagctacttgggaggctacatgtgggaggactcacttgcggccaggcgttcaagaccagcctgagcgacatagcatgattctttctccacgaatatttttaacatctagttcggcctccgctgt

SEQ ID NO: 610496 - DNA, 486 bp, Homo sapiens
ggagattgaccagacaactccagagcctgtcatctccagaggcctgttttgatgaaataaattaaccctgccaggcatggtggctcatgcctgtaatcccagcactctgggaggccgaggtgggcagatcatgaggtcaggagttcgagaccagcctgaccaacatggtgaaaccccgtctccaccaaaaaattacaaaaattagcccagcatggtggggtttacctattatcccagctactcgggaggctgaggcaggagaatcgcttgggcccggagggcggaggttgcggtgacccggggtcgtgccactgcactccagcctggacaaggagtgggactccgtctcaaaaagcaacaacaaaaaaacatcgactagagcagtggctgtggttttggacccagtgtgtcttcagaagcacccagggtatcattataggctgccactatttcctggtaccacaggatatttccatatcactacca

SEQ ID NO: 610497 - DNA, 467 bp, Homo sapiens
  misc_feature (35)..(35): n is a, c, g, or t
  misc_feature (216)..(216): n is a, c, g, or t
  misc_feature (252)..(252): n is a, c, g, or t
gggccccttcaccaaaaaaaaaagaaaaaggaaanaattttctgaccttaccaattcccaatgtatttgttttcttatccgtcccttcccttctcctccccctttataccaaacgccatcatattttctgttcaccattgaaaatgcagacatatgtcttctctctctctctttttttagacagctgtcaccctgtcgccaggtggagtgcacagnccccatctcagctcactcagcctcgcctccggggtntaagtgatttcgccccacagcctcctgagtagctgggactgcaggtgtgcgccaccacaccctgtatttttttagtagggtcagcctggccagcatagcgaaaacttgtctctactaaaaatacaaaaattagtcaggcatggtggtgcacgtctgtaataccagcttctcaggaggctgaggcacgaggatcacttgaacccaggaggaggagg

SEQ ID NO: 610498 - DNA, 1073 bp, Homo sapiens
  misc_feature (66)..(66): n is a, c, g, or t
  misc_feature (321)..(321): n is a, c, g, or t
  misc_feature (366)..(366): n is a, c, g, or t
  misc_feature (470)..(470): n is a, c, g, or t
gccgcctctttccctcctcaccccctcacttcctcctctcactttcccattttatctctccctttnatatcctcaggtatatagggtccccacaaacattatcaaatacttctcaatcgtactacacttaaatatatctactatatctatcacaattactaattctcctctcatcaaacccttctctccactttattatttaattctatctcactcagcaaatctttcttctatctccactcctctttccttctacggcgttccactacatgccttacctctactcacctctataaaattacataataacttgtaaaattntatatcttgatattaactcctctaatttaaacttgttttcattcntcactctcatacaccctcacccaaaacaactacacacgaatcgtcaccacacccacccacctcccccaccctcctacatccatcctctgtccacatcatcccgnaacgacaaattacttccaaaccctaatcctccgtacttcatcacattttcgtccttcaataatcattaactaatataatattactttatgtttattatatttcattttgccccacgctcccactcttccactataacataccgtatttatttcttatcataataatattattgaatcttatatgaataatatatatattatatatgttattattatatatttatctattaattttcataatatctctcaccttacatttaaataattcgtatctgtttatatctctcactacctcttgtccatctattctacttcacgtcacttctgctcacccaccacccccccccaccgccaacacttccacaatacttgcctcatcatcatctctctattctctcttaacttctctaacactctctcgtctatactctttcctcatattcttcctcttcatccatcctactctcccattacatatcactcctctcatctccttctctacccatctttctcactatcgctccacttaccaccgccatcacactattatactattatactcatatattcatctttatctaccaataccactaataaatctag

SEQ ID NO: 610499 - DNA, 127 bp, Homo sapiens
ggagattgaatgcaaactggaggtgaaagtgatatatcaaggaggaaatacccctggacaaccagtcttcctggaggggcagcaacagtcattgcacaataaggatttttgaatgtataatatcatc

SEQ ID NO: 610500 - DNA, 406 bp, Homo sapiens
cccactctcctctttccgctagtcgaggggtgtagctctggggagggaagagtggggtccgccattcctagggtgcttcttgagcaagcaccccacagttcgccaatgtggaacaggtttttgttgttgttgcttcgttggtatgtttccagagactgggagttaaacacctaacatcatgccaagcgcagtgactcatgcctcttatcccagacatttagggaggcctgaggtagcgttgcattattccagaggttcaagaccggcctgggcaacatagtgagaccccattctccacaaaaagggtgaaacaatacgaaaacacgagatctgtgaatacccccgaagcctggactccttcctccctgctgagcatgtcaggcagtgccggacagaggagagtggg

SEQ ID NO: 610501 - DNA, 384 bp, Homo sapiens
gcacggggggatgagtcacagctaggcaggaggcatgaggcagggagaatggcgtgaggggtgaacccgggaggcggagcatgcagtgagcagagatgatgccactgcactccagcctgggcgacagagcaggactccatctcaaaaaaaaaaaaaaaaccggcggaaatcgggcagcgccttaaaaatcccgggcccgggtgattcagtaactccgggggaacccggggttacgggcgctttcctagggccctggctattaacccttcgttccttccgagttatagcactggggcccagtgtctcataacattctcctttaccacagttttaacaggggccgtgtgtaaagagccttcacccattggaacatgtccaaccttg

SEQ ID NO: 610502 - DNA, 1316 bp, Homo sapiens
ggtcgtgaaaagaaacacggaggaaagcagcagcgacatagatggtagcttgtcagccttagtgattttaatatacgttcgtgtgcttcccgtccacctacttgtgtgtgtgcttctcactttgtctccccctgttaggtagtttctgtctctccttctgttggccatatttccttttccttctagttgtgcttccttagtggcactccactgtgctcttaacttttgggccctatctatgaacgccctgttcgagtttgtgccttcttgactgaaaggcgtctccgtgttgggcgctggtgttctcctcctgtggcctctctccttgccttggtcgtgtctcccgtgtctacccaggattgcctcacgggtcatttgtagagtactcgttctagtgttattgttcccagccctgttcctggagattggccatctattctcggacacccttccggctgactttcctccgtgtccctattggttttccctggtcccttctgctgtatgttagtggtcccgaggattgtctctgttcacgattatgtaactggattgtcccagtatgcttctgggattctctatgacgctcgcaactgaagaggatataggacctcgaatgttttcccaaagtgactcagcatcaattgaccgacgccggacgccgtgccccacctgccagatagtactttgataggtatcatgagtttacatgcccgttatgatcacgcttggaatacgcactcacggaaagatggttaaaggacgacctggtttcatgctcttcctgaacctggttcagtgcattcagtacatagcccctgtacttttgccctgtattcgtgtctgtactgactccactgaagggcacagggtatcgcgagataaggtcctgatcagaatcatggtctcccgcagtgaagtggtacatgttgtcaaattaggtctgaattcaagcagacaagtacggcaagtccctgtactattatatccagcatagacgactaagggcgactaccagcaaagcgtctgctgtagcctgtagtggtaggagatgacctgaagccacgacacaggcctgagcgtcctagaaatggtgctgcaccatcgcctgtaccagctagacaggtctagaaaaccaggctttgcgaatcacagtccccgtggccatccctgtgagggtgacgctagcattacccccaacctcactttagttgcctaagcattgcctggccttcctgtctagtctctgcctgtaagcccaatgaaatgtacattccaaggagttggaagtgaagtctacatgatgtgaaacactg

SEQ ID NO: 610503 - DNA, 196 bp, Homo sapiens
accttgtggacactagtgcccaggagttacacagcaaaacctttaaaaaaaactttaaaacctttaaaaaaaccttaaaaaaaaaacaacaacaacaacaacaacaacaacaaatagcccctagtccgtgtttcgcctgccaaggccctgttactttagtaagcctcctcttctctagattcctcacatttggtcc

SEQ ID NO: 610504 - DNA, 772 bp, Homo sapiens
  misc_feature (88)..(88): n is a, c, g, or t
  misc_feature (671)..(671): n is a, c, g, or t
gaaggagcttggcagaaccaggtaggtgcgacgggcccgcgtgaggctaaatgtggactgtgggtccatagagtgctgtagagtcagnggaggactccttgaggtgcatgcaggtggctggcttgagagttcgtcagcgacatgaaacggacgttgcggggttcatgcggagccgttcgtggatgcgactgttctcgactcggcatattccgtggggtgtctctgaccagcgattcgtgatcgtatccgtggggaggtcatggtcggcgtagatgtccgtagtgatcgggacatgggacggcaggctcgtcgcatgcattgtgccgtgcggggggctgccacaagtgttggcccagggtgcaccagcacttgtcccgttgggacccgaaaaacggatcagttgtagcagggcaagcaagaacacgacctcttgtgagagggggggcgtcgttggggagttgttcaggtgccgttgggcttggcaagaggcgatccgggtggcaacgaagtggcgacggtgtggcaaatcacgttggttaccgtggagcactcagcgatggtcttcgtgccctgctagtagggcaaccccgaatggtgggcaagtggcttgtgcagcccgggggcggcttctacccggttgagtgccggctcagtgcgttgctttggccgtnccggttgtgcggccttgcttactgttggcactaccacttggtggccagtgcgccggcctggccagtggtggcaacccagccctaggagtagggcgcccctg

SEQ ID NO: 610505 - DNA, 357 bp, Homo sapiens
gggggaacaaatataacctaataagggatttgtcagcctggttgcctcattttgaccttagcaaatttgaccaaatctacagtacaggctctacttatcctctagtatgtgacctctaccatccaaggagctttagaaatggactttgaccttgctcacatcattgtgcccttcactgtactatttctatccgagacgtctaagtaattgtaaaaattctggaaatcggcgagatgcggtggctcacacctgtaatcccagcactttgggaggctgaggcgggcggatcacctgaggtcgggagttcaagaccagcctgaccaacatggagaaaccctgtctctactaaaaaatacc

SEQ ID NO: 610506 - DNA, 259 bp, Homo sapiens
gattagcaaactcatcactagacatcgtactaccgacacgtactacgttgtagctcacttcactatgtctatcaataggagctgtattgccatcataggaggcttcattcactgatttggcctatgctcaggctaccccctagaccaaacctacgccaaaatcatttcactatcatatcatcggcgtaaatctaactttcttgccacacacttctcggctacgatgccgcgtgctgataggccgtgatccatgaactct

SEQ ID NO: 610507 - DNA, 140 bp, Homo sapiens
cgccacccctgtgcgcccctcgtgcgccggggtacctttccagctctgtggatcggtgcgtgggccaggccgatcctgttgggggttggtggtgatgacctagctgcgtcgtgcagatgctcaaagactaatgaagtcct

SEQ ID NO: 610508 - DNA, 192 bp, Homo sapiens
acagcttggtcaggcatcaagcttggtcaggcatcaagcttggtcaggcatgcagcttggtcaggcatgctagcttggtatgcaagcttgcgaggcatgcaacttgtccaactgattttttttaatttttaatttttatttatttatttttttgagacgcagtctcactctgtcatccaagcttgcaggatc

SEQ ID NO: 610509 - DNA, 382 bp, Homo sapiens
cgttctcctgcctctcgttcgttcatgaatacgtctgctgatcatgctatcctccgtcatgtatggcgcagctaagaatgtttcaatagccatatcgtatacctttgtctctatacgcgtgcttcggtgttcgcgagcgtgttgtactagtgatcggttaaacagtgctgaggctgctgcatcttccatgagcagcgtcaggtgctactgtctaagcccctggatgcaggctgcatgatgtgaacagctcgcatgtatggttcctagtacggctagaccagatataatctaaggccatcaatggaatgatacaagcccacgcgggaaagctgggcgtcgcctcaggcagctcaggatacacagctcctacagtgtcgtccag

SEQ ID NO: 610510 - DNA, 227 bp, Homo sapiens
  misc_feature (5)..(5): n is a, c, g, or t
gtccntactcgacggacgcatcactttaaatttatctgtatatagaaaggaaactagcctgggaacatgacgaaaccccatctccactgcaaaaaaaaaaaaaaaaataaaaaaaaacaaccacaccccccacaaaaatacgcgggttatgatggcaggtgcttgtagccccagtaccccaggataatggattgacccttggaggtgagggcaccagtgacctgaaa

SEQ ID NO: 610511 - DNA, 338 bp, Homo sapiens
gcacaaaattgttgttttggatcaaagttttcccattggctgttacaagtgcaagaagtgtgggctgttgttttcctttaagggcaagtgtcagggttgttacccgttgaatgggcacattttgtgaaaggcctgaagcgcctggggcatccagaagttttcagcccccgtcaccattgattgttgagttttcctaaaagtacctgttgggttttcagttccagttcccatcctttgattgatcactttccctgacatccacctgtatgactttgtcaccaaatgctgttttttttttttccaatcaaaaaataataatccctcgagtttccaaacca

SEQ ID NO: 610512 - DNA, 768 bp, Homo sapiens
gagtcagcgtagtatgaactgtttcagcttagtggtctccagaaattacagaaaacccccaacaattagttccattcacttttatgtacactggcactcttcaggaaaacactgggctatttcccagggccccagaacatactcgaacatttgtttgagtgggaggtggggagagagtttttttgagtcaatgaacatctgttcagaactgctgtgctgggtcccaagaaaacagagcttataatctgtctcttccctgccagaggtaccagcagagatttactatactaggtatatgtgcttgtggtggcattgtactgtgtcagtttagctaagctggattcccagtatccttcctatctgcttccaggtgagggttgtccacaagaaaatttcgtgagagatttggaaagctgaattgaagtagcagccagtacactgtgaaggacagagcagggtctgtacgctgtgaaggacagagcagggtaccaggcatagtggcagtacctgtactttctctctgatctggctcaccttgtcggtgaaggtcatcacacagcccccagcacccctagctcctactgaatttcctccttcagctcctctgagtcctgggccatgtgtgcagtcagctctgtagcagagggctccggcttctccagatcacctgagtcactgagcttgggaccagtgaaaggaagttgtgggtttcagtttgtcctcatgagttccagttgtccttgtagatcccagtcctagttgccgtgt

SEQ ID NO: 610513 - DNA, 129 bp, Homo sapiens
acaactggtgacttatcgtctttagacatctgcaagtgtcgatgcatcgatttgatcccgcacaaccgaactgttgacactgtctggatggctgtagatgaatcttgcgacaaacctgcagagaaccct

SEQ ID NO: 610514 - DNA, 426 bp, Homo sapiens
gctccgactccctccccccctcacgcccgccctctcgccttcgccgaaccaaagtggattaattacacgctttctgtttctctccgtgctgttctctcccgctgtgcgcctgcccgcctctcgctgtcctctctccccctctgccctctcttccggtcccgccccttttcagtgttgcacatctgtctctccacagcgtatcatctggcccccttctactccttgatacaagaagtgacctcagtttcccagagtacccgttatgcgcccaccacgatagaaggtacaaacgatctggtccagccgcaaagacacggagaggacaagcgggtcataccgtggtagaagggcacgaggatggatcgtctgaaagatagaaagcacgagagatacacacacaagaaggaaaatgggaggggtgtccac

SEQ ID NO: 610515 - DNA, 113 bp, Homo sapiens
gccccagcggggaattaacccccccaaaaggggaaaaaaagggggggtccccccggggggggggccttttaaaaaaagggggtcccccgggggggggggatttggggggggga

SEQ ID NO: 610516 - DNA, 126 bp, Homo sapiens
tagcgggtcatgaggcatcagaacgcagtttcatttggcattagccagcacagagccaccggaacattcaagatcctagaggacgaaacccacagtaaggatatagaaccccacttatactcgggt

SEQ ID NO: 610517 - DNA, 390 bp, Homo sapiens
ctggtgttcctggacttggagttggtgctggtgttcctggcttccgggcagtacctggagccctggctgccgttaaagcatccaaatatggagcagcagtgcctggggtccttggagggctcggggctcttggtggagtaggcatcccatgcggtgtggtgggagccggaccccccgccgccgctgccgaagccaaagctgttgtcaaagccgcccaatttggcctattgggagccgctgggctctgaggacttgcagtcagagggcttggagttccacgtgtagggggccttggagggatgcatgcaactgtagcccctaaagcacctagaaacagagctgctggcctaggacgtgtcctaagggagtcctagccaattccactaccca

SEQ ID NO: 610518 - DNA, 120 bp, Homo sapiens
ctcttgagtatccccggtcaacttgctacacaagctgacggattggtctggcctactgggctgacattaactacaattatgggaaatgcaaaagttgtagtggatatggtagtgtagtgg

SEQ ID NO: 610519 - DNA, 338 bp, Homo sapiens
cagagtatgagtctgtttatgaacacctttaagcagctcccaaactgcttgaaccgagactccatctctactaaaaatacaaaaattatctgggcatggtggcaggtgcctataatcccagctacttgggaggctgaggcaggaaaatcgcttgaacctgggagacggaggttgcagtcagccaagatcgtgccactgcaccccagcctgggtgacaagagcaaaactccatctcaaaaaaataaaatttaatttaaaaaaaactgtgctgggtgtgcctgtctatcagacacccaatcttgcaagactgtcattaaaagtctcacttttgctgttca

SEQ ID NO: 610520 - DNA, 276 bp, Homo sapiens
ttatatcgactacgtagccagatatggaagtggattcacatgaggtgttatggaatagcagtatggttaccatctccccagtgaagcgtgctatgtgtcctgatagcggagatgggggtaggcgatgaactcgggtctctcgtgatctccgtggtgcgacttcagtgtacacattcagcatgctgactgccaccccgtgtgagcgcgacgaagaaggtgagagtctataccacatgcgagctgagccctcttcgccatgggcgccactgacaatgg

SEQ ID NO: 610521 - DNA, 1023 bp, Homo sapiens
  misc_feature (238)..(238): n is a, c, g, or t
  misc_feature (264)..(264): n is a, c, g, or t
  misc_feature (607)..(607): n is a, c, g, or t
gctaagaggactccctcaatgtggctgacttgtattccctccgggcccaactggacatccccatcccagaccctccacccaaggatgatgagatgggaacagataagcaggagaagaaagaagtccctaagtgtggatttctccctggggcaaggagaagtgatgtaaatgggggagtaacatgatgagattaatggattagagacatggctcaggctgctgtagagaaggcaccagngagagcagatggctcaatgggtgtgnaggagacctctcactgagtttagggagaggtttttaaaacagaagaagtttgagtaatttaaatgatgatgggaaggagctaaaagtaggggataggttaaagatacaggaaagtgggaggaagaactgacaagtgaggttccagagagggcaggagaagaggagattcccatagggggattaacattttcttttcttttttctttctgagacagggtctcactctgtcgtccaggctggagtgcagtggcacaatcttggctcactgtagtgtaggcttcccaggctcaagggattctcccaccccagactcccaagtagctggaactacgggtgtgcaccnacaccacacctggctaatgtttcttttttcggtagacacagagtctcactattctgcgctgattggtctccaactcctggcctcaagcgatcctcctgcctaggcttcccaaattgctgggattacaggcatgagccataatgcctggcctctgctagttctgtattctctagagttgtctttactttgtgctagcgtgtccctcattgtgctaatcctctgtaaaaattaataccttttttctcttttcgagatggagtttcactcttgttgcccaggctgggagtgcaatggcgctatctcggctcagcgcaactccactgccgggttcaagcgattctcctgcctcaagctccgagtagttgggattacaggcatgtgccacatgcccaagtattggatgcaagtaaagatgg

SEQ ID NO: 610522 - DNA, 613 bp, Homo sapiens
  misc_feature (39)..(39): n is a, c, g, or t
  misc_feature (81)..(81): n is a, c, g, or t
  misc_feature (96)..(96): n is a, c, g, or t
  misc_feature (115)..(115): n is a, c, g, or t
  misc_feature (133)..(133): n is a, c, g, or t
  misc_feature (135)..(135): n is a, c, g, or t
  misc_feature (146)..(146): n is a, c, g, or t
  misc_feature (158)..(158): n is a, c, g, or t
  misc_feature (161)..(161): n is a, c, g, or t
  misc_feature (165)..(165): n is a, c, g, or t
  misc_feature (180)..(180): n is a, c, g, or t
  misc_feature (188)..(188): n is a, c, g, or t
  misc_feature (190)..(190): n is a, c, g, or t
  misc_feature (192)..(192): n is a, c, g, or t
  misc_feature (222)..(222): n is a, c, g, or t
  misc_feature (226)..(226): n is a, c, g, or t
  misc_feature (243)..(243): n is a, c, g, or t
  misc_feature (252)..(252): n is a, c, g, or t
  misc_feature (258)..(258): n is a, c, g, or t
  misc_feature (262)..(262): n is a, c, g, or t
  misc_feature (264)..(264): n is a, c, g, or t
  misc_feature (271)..(271): n is a, c, g, or t
  misc_feature (273)..(274): n is a, c, g, or t
  misc_feature (296)..(296): n is a, c, g, or t
  misc_feature (324)..(324): n is a, c, g, or t
  misc_feature (348)..(348): n is a, c, g, or t
  misc_feature (357)..(357): n is a, c, g, or t
  misc_feature (362)..(362): n is a, c, g, or t
  misc_feature (370)..(370): n is a, c, g, or t
  misc_feature (372)..(373): n is a, c, g, or t
  misc_feature (385)..(385): n is a, c, g, or t
  misc_feature (387)..(387): n is a, c, g, or t
  misc_feature (397)..(397): n is a, c, g, or t
  misc_feature (405)..(405): n is a, c, g, or t
  misc_feature (407)..(408): n is a, c, g, or t
  misc_feature (412)..(412): n is a, c, g, or t
  misc_feature (415)..(415): n is a, c, g, or t
  misc_feature (422)..(422): n is a, c, g, or t
  misc_feature (425)..(425): n is a, c, g, or t
  misc_feature (459)..(459): n is a, c, g, or t
  misc_feature (465)..(465): n is a, c, g, or t
  misc_feature (472)..(472): n is a, c, g, or t
  misc_feature (488)..(488): n is a, c, g, or t
  misc_feature (497)..(497): n is a, c, g, or t
  misc_feature (509)..(509): n is a, c, g, or t
  misc_feature (516)..(516): n is a, c, g, or t
  misc_feature (519)..(519): n is a, c, g, or t
  misc_feature (530)..(530): n is a, c, g, or t
  misc_feature (546)..(546): n is a, c, g, or t
aaactcattcaaaggatgttattttatcattccattttngaaggtgtgattggttgagcaacgtgtcgagagagcccagcntccagtgtccctcanttgaccctccgcaggtggngaaagctctgcacggtcntntccatagcatnatccatggtcantantggntggtagcccatggcntttttggntntntcgcagctgtagtagtggaatgtgccagcnagtncgacccgcatgggtgtnaaggtgggntgcagntggntnacaggantnntcaccatcaccagcagggatanttggagggccaggtagtaggccacccantaggggatgtggtatttggtggcntcataattnaggcntgttaggntnngagataggaatntncagaaagggntgggttcntnntttnttnttttaanttntttctcacccagtgtcgagtcttgggagatctgntcttcngccaggntgtgtccatggaccangttttccanaaaggtgaagtncaccaanttnttcccatttcnaattacgaatttcatnttgccgttcctggctgcctcgatgaggatgggtaccaactgcgggtcccttgggccgaaaatgccat

SEQ ID NO: 610523 - DNA, 265 bp, Homo sapiens
caagtgatcctcctgccatggctcccaaactgctgggataacaggcatgagccaccatgcctggccaagaaaaaaaaaatattgaaagcagtaagagagagacaatggaaatgacagtagatttcatatcagaaaccatggaagccagaaagaagtggcagaacatcatcctttttttttttctgagacagtctcacggtcacccaggtgggagtgcaggggcacaatcacagctcacggcagctctgaggatcacttgagccca

SEQ ID NO: 610524 - DNA, 316 bp, Homo sapiens
tttggctatggcaattaattatttagggaagggttctagatagcttcgcacctccctattagtggaaaatgacctttaatcactcaacctaggattggccaaccaaatttgtaaccagaaccaacataagatacggaatgtgggggattctctacataaaggctttatgaattcaagaaatgcattgttttaatattggaaacttcttgaggggaataaccctgacaattgccactttattaatataataactaatattccttacttactctggtgatttaacgaaaagaatcgcactgtttaaaatttcgattat

SEQ ID NO: 610525 - DNA, 959 bp, Homo sapiens
attaatcccctggccaacccgtcatctactctaccatctttgcaggcacactcatcacagcgctaagctcgcactgattccttacctgagtagggctagaaataaacatgctagctttgattccagttctaaccaaaaaaataaaccctcgtgccacagaagctgcatcaagtatttcctcacgcacagcaaccgcatccatagatccttgctaggatagctatcctcgttcaactaatatactctccggacacgtgagaccataggccaatactaccaatcaatactcagtcataaaataatcataatggctatggcgataaacactaggaatagcgcccctttcacttcggagtcccagaggttacccgaaggcacccctcttgacaatccgggccgtgcttcttctcaacagtgacagaaaaactaggccccatctcaatcgatataccaaatctctccctcactgaaaggtaagccttctcctcaatctctcgagatccttattccatcatagcaggcacgcgcacgtggattaaaaccaaacccagctacgcaacaaacttagcatactcgctcgaattacccgactaggatgattcctcagcagctctcccgtaaaacgctaacataggcatcctcatccactatccataattcctaactactacgcgtacgtactatccactacgtcgcgacaggacctatatttctgcactgggacagctgccgatacgcctatctcactcttcttgggcggccccaacggcttgcccagggcctcccgccaccctccccatccctcccccacgccccccccacctccgccgtcccccccccctctcgacagcgtgcccccccccccctctcttctcaaaccccccggcgcgtctgcgtctcccccctctccccccccccccccccccccccgcccccccccccccccccccccccccccc

SEQ ID NO: 610526 - DNA, 231 bp, Homo sapiens
ggagcagaatgaacaaagccctggtagaaggagggctgtccagaagagaggtgaggctgaagtgcagggagcgggaggtagtggagatgtggagagaggccacattacagagggctctactgtaggccaaataaaggaatttttttttttttttttttttttgggaaagggagtctctcactcgtgtcccgggcgggagtgcgggggggatgactgggggctcagggaacc

SEQ ID NO: 610527 - DNA, 312 bp, Homo sapiens
  misc_feature (18)..(18): n is a, c, g, or t
  misc_feature (175)..(175): n is a, c, g, or t
  misc_feature (278)..(278): n is a, c, g, or t
tgaattaagcgatgaccnaaacgaagtggctcaccgtgaaacactagatattttgaataaagcatctggttttttacgtcaggagttgagtcgtcggattaaaacgcgcatcacgcctcgcttgcgtttccattacgataaaactaatgcatatggtaactatatgtttggtctnatcgaaaaagcggtacaagatttaccgaaacgtgagtcagatgacgaagagtaatgaaaactcaaaataaaaaagccaccttggggtggcttttttatgtgtncaagtttttattcttgaggaggttccatgggtgg

SEQ ID NO: 610528 - DNA, 550 bp, Homo sapiens
ccagttccccgctgcccgctccctgctgagcatcacggaggaccatcagcgcttcaaggtggcggggtcccctgccctgcagcccgtgaagagcttccctaccccggcgctcagcatccccgcgatgggccgtcgtgtactgggcacagctgctcactggccacgtgcttcctcttgggcccggcttctgggctgcccactggagagagagccacctgacccacaactggagccacgcacttggtgcccctcgttctcttcgctcggggttgtcacactctgtgtttcttttttcttgatgattatctgaagggaaaagggaggccaagagtgaggaagggcctggcctgagggctcctacagtgagcacgggtgccccgattgtgccccccatcggcctctccccaggtccgagccctttccacccacctggaactacaagctggcgccttccttggcatgcacctggcccggactggcaggtgagggtcgaggagacaggcctgtgtgccctaaccttgatcacaccagttccctttcaaaagctcga

SEQ ID NO: 610529 - DNA, 354 bp, Homo sapiens
cctcaaactgcgcccggatctcctcctctatcacgctcaagtcgaacaggattcttcttctcagatcaatgtctgtggaagactagtcagatcccccagaggggtctagacggaagccgcacgatgccccggatgcatacaccaaaataccatgatttaccgtcctgcccagaaggactagtcgctcaggatcaagatgccgctccagcacctcagcctcagcgctttgtgagcgtgttacgagcttgcctagcccatgagattgcacggaccctcataagatcccatagacaccgtaaccttccatgggcatgttacaggctgaacgcccagccgcacgcccggactactgta

SEQ ID NO: 610530 - DNA, 172 bp, Homo sapiens
  misc_feature (79)..(79): n is a, c, g, or t
ggtgcgcggtaaggtgcgagctgtgctgaagctcttgccgcagtcgaggcagtggtaggcttctcgcctgtgtgtgtcnggttgtgcgcgatgaggttggaacgctgcttgaagcacttccgcactcgggcacggataggcttgaccccagtgtgggtcgctggtgggtact

SEQ ID NO: 610531 - DNA, 330 bp, Homo sapiens
  misc_feature (6)..(7): n is a, c, g, or t
accccnngggggtgtggggaggggggggtttttccttggcccccagggggattcaccctttttttccttttgcaaaggttggggggggccccccttttaaaaaggggggtcccccgggggggggggcccgtctttttttcccccttttgttttttcccccccaaaaaaaaaaaagggggttggggggggttttttccggggggggccgggggttttttcccccccccccgggttgggggaaggggggaattattctctttttttgttttttttcccccccccttaaattcccttttttttaaaaggggggtaagcccccttttttttcca

SEQ ID NO: 610532 - DNA, 112 bp, Homo sapiens
cctgtaatctcccccgttctccggggggctgagatcgccgcgaggatacttgggcccccgggtttgagacccgcccgggccaaaatgcgggacccccttttcccccaaaaaa

SEQ ID NO: 610533 - DNA, 479 bp, Homo sapiens
actcatcctgctacgtgtaaaagactttccttgcccgcaccgaagctgtctggtgcctctgtgaaacatcaaatgactatatgtcacatcacataagccccttaattttgttctctttcaatgtttactttggatgttctaggtcctttgcatttccatatacgtttaatttatttatttatttgaggcaaagtctcactctgttgcccaggcaggcttgcagtgccatgatctatggctcactgcaacctccacctccgggttcaagtgattctcatgcctcagcctcccaagtagctgggattacaggtgtgtgccaccatgtctagctaatttttgtatttttagtagagacagggtttcaccatgttggccaggatggtctcgatctcttgaccttgtgatctgcccgcctcgggctcccaaaatgctgggattacaggcatgagccactgtgccttggtgagtacagtatatct

SEQ ID NO: 610534 - DNA, 283 bp, Homo sapiens
gggaaaaaggtaacattaaaaaacaatcaggattgagaaaggatatgggtacatatgaagattgttttgttttgtttttgagactgagtctcgctatatcacccaagctggagtgcagtggcacaatctcggctcaatgcaacctctgcctcctgggttcaagcgattcttgtgcttcagcctcctgagttagctgggattataggtgcccgccaccacgcccagctcatttttctatttttactagagacggtgtttcaccatgttggccaggctggtctgg

SEQ ID NO: 610535 - DNA, 139 bp, Homo sapiens
tcgactacactaccagtggtgccagcgccctttgaatagcacgacgcgggttgatagtgaactgcacaccactctctttaagttctcgcgacgcccaatggaagttgcgaggggtcaaatgcgcctcattgacccatat

SEQ ID NO: 610536 - DNA, 168 bp, Homo sapiens
ggagttcgagaccagccttcgccaacatggcgaaatcccgtctctactaaaataagaacattagccaggtgtggtggcacatacctgtagtctcagcctcccaacgtgctaagcatctcaggcgtgagcacctgccacctggcccgaaaccagctttctcatccaagc

SEQ ID NO: 610537 - DNA, 1528 bp, Homo sapiens
  misc_feature (446)..(446): n is a, c, g, or t
  misc_feature (450)..(450): n is a, c, g, or t
  misc_feature (1268)..(1268): n is a, c, g, or t
  misc_feature (1528)..(1528): n is a, c, g, or t
ggaggccatgggtggttggctggacatatgcaggcttagtggagcgccagtagagtccagtggtggatcatgaaggtcgaacagattgagtaccatcgctggtctcaacgatgggtggaacacccgcgatcatcgtagcgtagaacaaattaaaaaacaaagggggcaggctctgccatctctcacaggtattccactctcgtaggtgtgcccaaagacagtatacgagtaatcactcactagagttctatctctgagttcaacaaagggtggatccgcataatagcgtgagagatggaagtatatatatatatggcgttatggtacacacgtgcggcacggtgcgcaatttgtactgatagcgacttggcgtgaccctgggtcgataaagacgtgggttgaaggcgatgaggagaacactgtcatggggatgagaggtgatagcntatntacacgtatgcgtgtgtggcgtgcgtgcacacgataaagtgtgggattcggaaaactaactgttaaagagggagtaaccttttagaaggagactccataaaggggtgtaaacatcatatttaaacacgcgttgttacaaggcatgggtactaaatgtgcgctggtttgaatgaaacgtacctttctgtggacagattatttgcactggtgtgcgtgcgctgcgggggacgacgttttaataggggtctatgggcgtgtgacgctcattcgaacttgtacacatgagagcaccaaattaatcttttgaaatttagcaacgcagggaaggacgactataggcggttctgggtaattacaaccccacgttccttcccttggggttggggggccaacgggtgggcgccattcttcccaagggaaaacccgaaggttcgaagcccccttccgcttggaagcgggacaagttccaagcgcctttaaaagcaagccaagcaagccaaacaagggggttaaccttccgggttccccctacaaaccacaggttggcgcccaaagaaaccttgtgcggaaacacttgtgcgcctattgtggtagaaacaccacgggtgggcacggaacacttctgtgttccagagcccattcggtccgagttaaccaaaaaccagagcaacccccaaaccggaaggaaaagagcccacatttcccaaactggtggtgtttccccagtggtttggccggaatattaaccaggcccaaggttgtgtacaggacacacggttccacagggccaaacaagtattaaagacaaccagtgttangaaatttgcaggattcttccaattaacttgggaaagaagacaggtccccggtatcaacgttggaagaagttaggtagtgaagagtaaattgcgcaaagagaagggagcgacgacttatcaacggcttctggaaacagggggaccgtattagaaaaaccaaatatagcagagggggaacaacacgcgcttacttgaaacagggaggtaaacatcatggggaaaggagacagagagagaaaacccaatcaggtggggtaccn

SEQ ID NO: 610538 - DNA, 1152 bp, Homo sapiens
cgtgacgcgtgggggagttccgcacgtcacagtgccgagggcgcggccggggctgcgtgtggcactgagaaggtgcagctgcttgcacaatggagcagacggtcagcgagactgttggtgtgccctggctggagtaggccgtgctgcttcctgcgggcttccacctaaggtggctggagctgctggagaagtacaatgggccctagcccgtgttatccctggctggtggctgctgggcgcctatcacctgttgccagtcactagcaatggccgtcgtgtcccaggctgtggcagggaagaggtggatggccccagtgttgccgtgggtgggcagagcggccggaagcctcgagagctgcctgctggacctgcgctgactccttttgcaacagtcaagctgcaacccaagcgaaggccgtgacacggtgcctatccggtggaaagcacgcacgtcagcatcaacccgtgtgcctgccagcgtgcactcgaacaacaactttgtggcccgggaagcccgggaatcctgaacctgtccttgacctttcccgaatttcacttcttcttgccccgagaaggcccactacaacaggtcccccccgtaaagggggctgggaacaagcaccactcactgcaccggctgggaaaggggaccctggacggcggacacccaaggtgccttccaataaatggcagttccacaatgcggaagcgccgcaccctcgagatttaacccttgaagcgggcatctgcgtgaagacccccacgacccgtgggtttataccaaatttcgaaaagtacggaatgttccaaaattacacgacacttttacttcgagggcagaacagggtgaagcccccaactttaatgccaataccccagagtcgaaggcgcgtagtaccgggtgaccccccgatgtcggaatcatgcaaggaagctgtttccggggtgccacccgttgccagtgatctgtaggtgggaagtccttaaaccttaaccagttccggggggacgttcccgaatggtctgtgcccgtgtaagatggggcaaaccgctccagtggatcttgtcgaaaggcccggtgggtaagggagctttagtccacgttcaacctcccttacgactcgagtgtacactcgacaagaacggacactt

SEQ ID NO: 610539 - DNA, 434 bp, Homo sapiens
atgcatagaaccttactagtcagcgaatatgcattcagtgagctacacacgtgcagtgtctcagacagcagtggcctcgcgattagcacagaatgaacatctgagtacgggaatggtgttgagtgagttcacatggcagtcatgcgaatatcaggctctcagcactttgctgtgaaatgcgaatcaagacagcagtcgtgattggtgagaaacccttggcgtctagcttttccctctagagggcgctctgaccccgcaagataaaagcctagagttgcagcttgcagggggctccaaagaagataccagaaggtaccagtgtaaacattcagaacatgcccagagaagggcagcagccgtctgctacccaggaagatagactgcgaagtgccaatcaggtaaaggacaaaaggtcactccgtttctctatgagg

SEQ ID NO: 610540 - DNA, 235 bp, Homo sapiens
cctgatgcgcgcgcggctgtgtgcaggttgtcggctcttccaccagcactgtgtgttgtggtgctgcgcagggcaccactgtggtttcatgttgagcctgggcttgctgctgtcgcctgtgtggtcgcttcctcactgcgtgcctggctgtgtgtggtgcttggcatgtgtgccacttgttgacgtgcgtcgcacctgtgttggctaccgggcgtgtgtgtggcttcattccccg

SEQ ID NO: 610541 - DNA, 199 bp, Homo sapiens
gttaccgtggtacttacatttcacagtgccctggggagggacatttgctgctgcagtgggtggctctatatcttcaagagaaccgtattccaagcactacggacatgatacatcagcagaaaatgatggcattatgtgtacaacctgaattggagctgtaggaagagaagcgtgcgatagcagtatggaaggatgggga

SEQ ID NO: 610542 - DNA, 849 bp, Homo sapiens
ggcactgcactgtgccccgtgtgccagccgtcacccctccccagagtcactgatcactggctcccgtggacctcgggaggatggaagagaagctgaagaaaaccaagatcatctttgtggtgggtgggcctggctcatgggaatggcagccagttgtgagaagatcgtgcaggaagtatggctacacccacctctccaccgagtggacctcctgcgtgtcctgagtgtcaagctcacggctcgtgccacgggcgcaagaatgctgtcggaaatcactggagaacgtgggcatgctggttccactggatgacagtgtttggacatgctccgagtgatgccatggctggccaaatgtcaagtacttccacaagtgcttcctgatatgatggctacccgcgggcaggtgcatgcgaaggatgaacggagtttgacgcgacggattgtacagccacactgctgctgtatgtggacgcacgtgtcctgttagaccagtgacccagtggctcgttgaaacgttggagagaccagcgggcgtgtggactgacaatgaggagaccatcaaaaagcgggtggagaactattacaaggccacagaacccgttcatcgccttcgtatgagaaactgtggcacttgttgcgccatagtcaacgactggagggctccgtggacaggtgtcttctcccaggtctgcacccagcttggacgccctaaagtagcaacgctggagccgatttccgcaggtcaagccgggatcctaccccggtctgattcgaggtcctcctggcttgaggcgcaagcgcggtacgaccactgacctgctgagcacggacgaaggaagccgtatatcc

SEQ ID NO: 610543 - DNA, 468 bp, Homo sapiens
ggatcttctcgagagtgtgcaatactaagagcatgcgcactgtgacccttaacctaacctatgctttatgataaaatagatacatatttatatttgtactattcagaaaacagcatatgtatccattccttgggggttttcttgtaaacaacataatacaatatccagttagtactgaggtgtttttgagacaaggtcttgctccatcactcaggctggagtgcagtagagtgatcacagctcactctagccttgacctctgggactcaagtgatcctcctacctctgcctcccaagtagctgggatcacaggtgcatgccaccaagcctagctaactttttttaacatggggtctcactatattgcccaggccagagtgcagtggtgaacatagctcactgcagcctcaaattcctgagctcaagtgaccctctcacctcagcctcctaagtagctaagactacatg

SEQ ID NO: 610544 - DNA, 238 bp, Homo sapiens
cgtagacgtggcaaatgctagcgagaatagggtagggcgagttggctcacgtgtggctcttccccagagggctgggtagacccggtccaaaccatcgggagtgtgtagaattcccgaattcggtttctcttcactgtctggcaagccaggcaccagcttatacacgaggtcctgcatgagccggtccagtttgaggttgagcagtggctgtgtctcgtgtagacaatggagagccgag

SEQ ID NO: 610545 - DNA, 433 bp, Homo sapiens
taaagtgccatcccacagggtctggcaaagacagaataaagtggggctttcaggccctacactgggagctccccatagcatatcagccctttttgcctatcacattaatactggggttttattctccttaccataaaatgaagctcctctattttttatactgatggaaagcaatatatttatggtttctttttttcattgctatagctctgttttgtggcattttttttttaccttaagaaaatagtttttacactttttccttttaaatgttttttgggtcagatttcacctatcattcaaatatttcacaatctgttgtctgatcctttcattcaacctattatccatacctccctgttttgcaggacctgaagaatttctcaggtgcattaaagcaatacaaacaaaataaactaatgttaactgcaaa

SEQ ID NO: 610546 - DNA, 144 bp, Homo sapiens
cagcaacagaaatagtcatctaatcccatgaattaccaaataagaaaatactgaggccaaagtgataaaatgacacggtccgacaacgagatatacaggaagagctcggactagaagaacccctatttcctgacgtcaagcata

SEQ ID NO: 610547 - DNA, 572 bp, Homo sapiens
tagaatgagcatgccagtgttgcttggacagtgacggttagagtgacttgctgatccagtgcacatattgggctgttgaaggtcagtttgtgtgactaaaccagcccttgcccatagccgaggttaatgtgtccatgttcctgacacattcttggatctataaaatgaactgcccctcagggtcaatagcgtgtgaggagtttacatccaatccttaagatttggtacacaacagatggtgagctactagcgcttattattttgtgagctgatcttttggttctatgggcgattaacagtttaatctgcgatacaaagatattttctagtgtccaaagagctgatggtggttggactagcctctaaaatataaaggcgatatagaggcgatttgggggaaatttctcggccaactattaccggtgggggacaagcaggtataacaccgcaaaagaacgttgtttttatctacatttatgtgtttgcactaatgcgtttcagaggcgggggtgcaagcttaaccgcattctcggtttcttggttggttccgggggcttaataagaagatttaa

SEQ ID NO: 610548 - DNA, 494 bp, Homo sapiens
agtagcggaccccttcccaagtgagatgaacaggtactcagttggaaatacagactcacccgcccttctgcattgagtcttgcttgcaagtgtgtaaacctggagctgtacctatattggtcatcttgcctcttttgttacttttaatcagagcctctcctagatgctgccatggtagtttggagcctccactgagtccctactttgctgtctgtatccttttgtactcagagtggtctaggacttatgactcttaggatatttagctcagaggtgtcaaatattcttaaaaggagccagagcttttagctatactatttaagattctgtgggtaaacaacagcataataagagggttcttaagattgagaatgactagtaataggcttctaatgaacacatgaaagacctgtagcctttgtaagtagggaaatccctatagcaatctctagtaatgcttctcttttattcctgatattagtaatttatgacct

SEQ ID NO: 610549 - DNA, 907 bp, Homo sapiens
ccccaccccgcccaccacggctatgtactacagcctacgtgtttaactgctggaacaggctgttcggctgacccgccctggtgcattcgggtgactacgaacaccaactgaagctctaggactagtctggccgttctgcgctcacgccgaagtgcacagggtggtcgcggaccaccctggttccgaagagtacgaggtaggtggtagcccattcatcttggttattagatactggccgtcgtcaacaagtgtggcaggtgcatgaaacaagtggagtgtgcaattgcaatgactgtcaacagacaagcgggatgtactactaccgcctggccaaggagaatggctggctgtgctcgcagcgccttcaaactgctacaactggataaggaattccaactcttccaaggcgtgacacgggcagttgacctgtgtgcagccccaggcagctggagccaggtgctgagccagaagatcgggggccaacgggtccggccacgtggtggcatgtggacctgcaggcatatggctccacataccaggtgtggtacagatccagggggacatcaccacagatgtccacatgccaagggagatcatccagcactttaagggctgccctgcggaccatagtggtagtgtgacggggctcctgatgtaacccggtctccatgatcgttgatgagtataatgcaggcccagatacctccctagcttgctctgaacatttgctagcacaattttccttgaaagccagggggcttgcttggttggccccaagaatattccgaaggccgggattgtgacggctccttctaaagggcagctgcagggtcatctctcccaacgtggtatgttgccaagcccaggagcagccggaaatcctgcatcgaggcctcggtggctggag

SEQ ID NO: 610550 - DNA, 982 bp, Homo sapiens
  misc_feature (353)..(353): n is a, c, g, or t
aaagccactccagcttactaccagacaagcttaggcaaagcatttagccaaataaagtataggcgactgagagggttgagacctggcgcaatacgatatagtaccgcacagggcaaagatgagaaaatgataaccaagcataatatagcaagggactaaccccctagtaccttctgcatcctgaatgtaactagaaatcaacttgcgtcaaggaggagccaaacacgctaacgaccccccgaataccagacccgagctaactaataacacgcttagaaagagcacacccgtctatgtaggcaaaatagtgggacagatatctaggtatgaggcgacaagacctaacgcgagcnctggtgatagcgtggttgtcgcaaacgatagaatcttctagttcacactctccaaatttgcccaccagtaaacccgtcgtaaagtccaccctctggtgaacgtttaaactgttctaggtccgagaggcagtgaaacaggctctttctgtgtacagcatagtgataaatacaacgcatttgctagtaagaagaaggttaagagaaagaattataagccatcgcacattcagtaggagtccatagattagtcccgtcacccgaccgtctcatggaaaagcgttcgaagggctcaacaaccagatacctaaggagaatcccaaatcatataatcttgaactcctcacacaccaagtgggaccaatctatcagtccttatgagaagaactaatgtccagtatagaggtaacatgaaaggcattctcctcccgaataaagcctgcgtccagattgaagagattgatctgacaattcaaaacgccaatatctaagaatcaaccaacaagtcattgcttacccctcacggtgaagcccagcccaagattgctcattaaggccaggttggcaaaagtaaaacgggaccggggaaactttcccggcgggtcccaaaaaaaccccctgatcccgggtaa

SEQ ID NO: 610551 - DNA, 530 bp, Homo sapiens
ctatctgtgtcggggtttgcacttgaccttctgggctcatatgatccttccaccccggcctcccacagtggttggcgttacaggcatgagccactgcagctgtcccatgagtgggttttgatctgggacgggatgtttctggttggtagtccctgataggattcttgtccacgtgattttcttacaaacgtgctctcagaactagattatgggaagtatgaagggcgaagggtaggaacccaatcatggatgtgacctcatgcaatagccctagaactagtcaattatgcctcatggttgaaggttagagagcttaacctcagagttactgattaatttctccacttggcagtcactggttaaagtcagttgggaaagtgaacagctctattaacctaaggatggttttttaagaagagcctcaggtgctggtgtgggtctttgaaagcacatcacaggtaatctgagcacacagaaacagcaagaactcccagaggatctgggtggagcacctacattgtatttatgta

SEQ ID NO: 610552 - DNA, 180 bp, Homo sapiens
gaaagtacaaaaatttgctgggtatatggcatgcacgtgtagtccccgctatccaggaggctaaggtgggaggaaaacctagggcctggggaggtcgaggctacagcgagccattatcatgccactgcactccagcctggataacagaataaataaaaaagaaaagattaaaaaaaaaaa

SEQ ID NO: 610553 - DNA, 655 bp, Homo sapiens
ggggacggatcggccggagccggggctgaggagccgacgccccacgaggggcagggaggagccaccgggccgccctcgccactacatcccggtggctgatgccgacccactccccgctccacccgcgccagaagcgcctcgcgcgccgcgaggccccatcgttgtccccggacccgcgactccggagagctagggctgcatggagctcgggagtccatcaactgcctccgcccgggagagccgatcagctccctcccctccagtgccggcggtccgggccagactgcagggccaagagccggggccgacacggcctcgggcgcagggcctgggcggcctggcgctaggctgttcgggtggctgaaagagcgcagcctgggccgcgggctgttcgtggacccggcgcgggacaatttgcgcacacatgactagcctctacggttaccatcacaacccgcggaactcggtggtacctcagcaccgtcaccacgggcgccgtcattcaaggctcgagtactcgacccgacgggtcaagtgctgacagattgcgttggtgaacaaagctgagagttcttgcatttagttgaacgctatatctatcaagagcacataaaaaacacatttctgaagctcatgaaggactgtgtaaattaat

SEQ ID NO: 610554 - DNA, 190 bp, Homo sapiens
gcatcccagtcattgccaaggacccagagttatcctggaggggatagtgtcaacctgctcaggatccctacagctggggataggcccttccctgaaaggggataattgtcacaggcagggttttgttcataaggaggaaagagggaatggacagggaactattaaagcaagaaagtgtactagaaagtta

SEQ ID NO: 610555 - DNA, 195 bp, Homo sapiens
  misc_feature (15)..(15): n is a, c, g, or t
cctcgccaggtgttntagtagatgatatactcaaagccacctcttattcctttctcaccccattttttttccttcgaaacaccccaagacttcatcctattggtcatctcagccaggcacagtggctcacgcctgtaatcccagcactggcgaggctaggacactggcgaggctaggacactggcgaggctagga

SEQ ID NO: 610556 - DNA, 846 bp, Homo sapiens
gtctgtactataatgagtccggaggaaaacaactgcaacatactctgtggataaagctgtcttatatgaacatatgtcaactatccatgcgctgatgagccacagtaccatcacttgtgcaagtttcctaaaactacggagccccagttattactctagtggtcattagtaagagcctcaggcgcagattctactagcatcttctgtcttttcctatatccctgccatcactctgcatacttgtctgtgcagcatttcgtcattacgtactccttgatctgcgaaggccaagctagaactcactgtcatatggcacgaagggacgatccgaagagcccagtatctaggaggttagggtggatttcgcttctgccagatgctttgtgtcctgtcttccttcctcctcatatttctgtttctcatttgtgttcagttttgtgcagcattgctagcactgcttttgtgaccagaaaaggccataacatggtccaggatcatcattcttctgactctagatgggacacttgacagtgacttgaaacatttgcatattcaggaatgcatgagatttcaagagagcctacagtatgaaatcattttcacaaaataagcagcttgcttctgaaatgctgtctttcccagtagctactcacctgcctctggtggctgggattcagatgccacaaaaactgtcagtatctatagaccaggtctgtgaccactcctctctcctctgtgctcagatgaggaggcagtaaatgaagtttacaggctaagccacaatacctaattcatagtcacccaagtacacctgtaagatattacttgatactaaaatagttctca

SEQ ID NO: 610557 - DNA, 624 bp, Homo sapiens
atggcagaggtggggggcgtcttcgcctccttggactgggatctacacggcttctcctcgtctctggggaacgtgcccttagctgactccccaggtttcctgaacgagcgcctgggccaaatcgaggggaagctgcagcgtggctcacccacagacttcgcccacctgaaggggatcctgcggcgccgccagctctactgccgcaccggcttccacctggagatcttccccaacggcacggtgcacgggacccgccacgaccacagccgcttcggaatcctggagtttatcagcctggctgtggggctgatcagcatccggggagtggactctggcctgtacctaggaatgaatgagcgaggagaactctatgggtcgaagaaactcacacgtgaatgtgttttccgggaacagtttgaagaaaactggtacaacacctatgcctcaaccttgtacaaacattcggactcagagagacagtattacgtggccctgaacaaagatggctcaccccgggagggatacaggactaaacgacaccagaaattcactcactttttacccaggcctgtagatccttctaagttgccctccatgtccagagacctctttcactataggtaa

SEQ ID NO: 610558 - DNA, 117 bp, Homo sapiens
gactttgctcggtgacccttctggtgccacatccctcatgcctgcagcagaaggtggggggctcaggccctgacaggtaattcgtattttagagaagagtcttcttcccccaggacg

SEQ ID NO: 610559 - DNA, 162 bp, Homo sapiens
gaagctacaggagatccttcaagatagatcctggataatgtggccattgtagagaggttcgagatgtggcccttgatgtgagctgagaatgaggtccacttctatcttcagaatagtcttgaccatggatgcccgtcaggcaagtgagtgtacctcagacat

SEQ ID NO: 610560 - DNA, 96 bp, Homo sapiens
  misc_feature (13)..(14): n is a, c, g, or t
  misc_feature (37)..(37): n is a, c, g, or t
gggaagcactagnnaagggagcaacagatgcctgcanctgagggggtgacaagataaagccaggctctagagctgctttggatcatgaaccatttt

SEQ ID NO: 610561 - DNA, 163 bp, Homo sapiens
atacccgttgcggcacgtactggaatcaggggatactgtcgaagtcatcagaacagggggtttgaagtaggggcgctgtggtgacaaaatatgttgtgtagagttcatgtgagagtgcgtcatatgttattcctaggaagatatgtagtggggtaccgagctc

SEQ ID NO: 610562 - DNA, 437 bp, Homo sapiens
tcggtcgagggtgtgtattggcgctcctcctggtgtatctctattatagctctttttagtatcttgctcttgcccgtttcccttcctgttgttgtggtattatttgcttctccaattgactctctttcgtcatttgttttttatttctgggtatactagtctgtgtgcctatgtccttgtgtctgtctgtctctatgtgtatttattcattgatatatacttctatatatctgtatgtctgtatatattgttactcatatatctataaatattgtttgttttgatttgtttctcataatatcgtgcgttcttaatcgatctttttgtttgtgtattcatatatatattgtatgagatagatagtgagtgatagagatagagagagagatagagagagagagagagagagagagagagagagagagagagagagagag

SEQ ID NO: 610563 - DNA, 412 bp, Homo sapiens
  misc_feature (75)..(75): n is a, c, g, or t
ctcctcctcttcggcaaatactactcctcctctccgccagatcctactcctcctctccgccagatactactccanctctccaccagatctactcctcctctccgccagatcctactcctctccaccagatcctactcctcctctccgccagatcctactcctcctctccgccagatcctactcctcgtctccgccagatgctcctcctcgtctccgccagatcctcctcgtctccgcgagatgctcctcctctctgcgagatgctcctcctctccaccggatgctcctcctctcctcgagatgctcctcctctcctcgagatgctcctcgtctccaccggctgctcctcgtctccgccggctgctcctcgtctccgccggatgctcctcctctctgccagacactactcctc

SEQ ID NO: 610564 - DNA, 135 bp, Homo sapiens
aggaatcaaatgctgtcagggtgaacacacagataaaagactcttattgaaacaacgaagagcgcaagacactgctcagcaacctgagtaagcccggagacctgagcaagccaggagacctgagcaagccacggc

SEQ ID NO: 610565 - DNA, 123 bp, Homo sapiens
cattcctcactgttgcatcccacagcagtggctccccaggcttaaggcattttccttgccctcctcccgcacatcccacatgctggtagcatgcatcactagactttcccaggtctactgtcc

SEQ ID NO: 610566 - DNA, 337 bp, Homo sapiens
  misc_feature (42)..(43): n is a, c, g, or t
cagcgccagctgcagcccctggcggcgcactctgcctcaccnntgagcctgggcgatggcaacaattcttccaaggatgatctcccactccacgaagctgcagggaacagccttttttcctacttccatgccagatggctagtgatgttttgatgttgacagcacggtcatcagtgaagaaggcaatcgcgatgcctttttcactcgggggaactttaggggcaagcgacacactggctgaattccagcgccaaccacaagttcaacgcgactaactgcctaaatgggtattatcactggaatttaggtaagaggctgctgggagagcaacccggca

SEQ ID NO: 610567 - DNA, 713 bp, Homo sapiens
gttatcgtcagttactgggcgtcgtgtttagtttacattaactggccgtcgtttcacagaagacagcagccctgatgatcagttcttcctaacagccatccggctcctgtgggagaggcagtgacagccccccagaggcagcggagagcactcggaggggccagcagtgatggcgtcctggctcaaggtcttcaactgccaccttttatgatgaaagtgtccttgaatgcagagcagtggtgggcagtgactgcacggcttcgtgaatatgcctgtcaaggcaccgagctgcaaactttaacatggagaattttacggccatgtgaattacttctccacttaaaaaaccttttatatatttgtgtggagaaaacaccacccttgtaaagagtggagtggagaagcattatccgcgggcgatacaagagatatcccccgcattattgtgggccgcgaaaccacctgtgcgaacgttaccccgtgtgcccgatcttctctgcgcgcaagacaaatataaactaatgtaccaccctataccagagggcgcaatacatcaaagtgagagaacgagaaagccaaaacatataaagagagggacattactctcctctctaaaaagacagtagaaaaaactcatccccaacataaagcgagcgacaagagacacaataggaaccaattagaaatgcggccccaccagtgcgaagacaaag

SEQ ID NO: 610568 - DNA, 856 bp, Homo sapiens
  misc_feature (453)..(454): n is a, c, g, or t
  misc_feature (456)..(456): n is a, c, g, or t
  misc_feature (462)..(463): n is a, c, g, or t
  misc_feature (467)..(468): n is a, c, g, or t
  misc_feature (470)..(471): n is a, c, g, or t
  misc_feature (473)..(473): n is a, c, g, or t
agaattccatgtccaaaaaaaaaaaagccttttaactttcgaatttttgtaaacattgaccaaggtggggccagattcagcgctgtgtggcacacctctacccttccctctagtttggttatcagttgacaaacattcaaccagtgatcctgtaatcttactgtccttcgtgacatctctatgtctcctcgccccatgagtaacaagtgaaaacagtggagtaaaagacttggaaaaaaattggagaggtggagcaaagaaatctttccttggagcaaggaaaagcaagaattgaagaaaagttgctctactggtcagtagggttaagagattcaaaggtagtgtggaaataacctacaaagaaaccactggatccttaacacacattaaaaatgaggtgaataatggtagggaggattagttactttggtttgaaccattctgttgaactcnncnagttanngatnncnnanaaataatcatcagcttcttactctgtgccaggccttttacatgtgttcctcatgttaattccatgaaggcaaggtgccgcttgccaccatcttaatgatgcggggctaagtaaattgaagctaaataacttactcaggcaagtagtagagccagcaattcgaatccacaacaatttacttgggaacacaaactggtcaactactgtgctataactgtactttagcctgcataatatctgacagatctatacgcaacttgcgtggtcctgtcttctcgagggtgaaggagatactgcctgtgtactggatccccactcaattccgcagtgatatatgtaggtaatagctagtggaaaacggatagccatctgcagggccttcca

SEQ ID NO: 610569 - DNA, 400 bp, Homo sapiens
  misc_feature (29)..(29): n is a, c, g, or t
  misc_feature (62)..(62): n is a, c, g, or t
  misc_feature (78)..(78): n is a, c, g, or t
  misc_feature (116)..(116): n is a, c, g, or t
  misc_feature (141)..(141): n is a, c, g, or t
  misc_feature (159)..(159): n is a, c, g, or t
  misc_feature (162)..(162): n is a, c, g, or t
  misc_feature (178)..(178): n is a, c, g, or t
  misc_feature (264)..(264): n is a, c, g, or t
  misc_feature (384)..(384): n is a, c, g, or t
cccgcgtccgccccgcgtccgcttttttnggtttgtgctcatttcttccccggtctgttccnttctgtttttttgttnttgcttttgagtttttttatttttctcttgtgttgctnttttctttttttgtgtgtctgcttntgtttttttgccctcttnagncttttgacatcgattnttttttttggctgggttcctatgagcaatttcgctttctgttcccccttgtttttgtctctgtttccgccttttgcgcttttctgnggttgttgcgcctttgtgacatttgtgtagtgtctattttctctcagctttgcttgtcttgtgttgtttttttttctttcttgggatttttaacgcttcttttttctccgtttgttcttntgtttttcccctgggt

SEQ ID NO: 610570 - DNA, 218 bp, Homo sapiens
acttggaggcgtagtcattggtgtcagcacggtgacacgcagaagggcacagctggcgcgtggaggggctgactgacatcctgcaccttgatggtaaggtcatagagagtcccagcgctcacggtccaggttgcccatcacaatgagctgtggttgcttctcctcctggtcctctgccaactgaagcccaaatagatcctggacctcaggttcagcct

SEQ ID NO: 610571 - DNA, 410 bp, Homo sapiens
ggtactactatgcagtcggtggcacacgtattagccacttcacggcagttcagcattcattaactagcttcacttagagtatggtgatcccttcatgaacattaacctgtagtagctctctattctgacctgtacggacacctcataagctgcctcttgtatacttacttcatgtgccgaccattggtttgcccacgatttgggtcttacacccataggattatcgggaattgatgctgcaataactgttgctgctatcaagatgtggttattaatgccgtaatactctactcaggctttgatatcacctgaacacattgacccaacagcacactttagcgactttacggatagagctggatgccgaccggtgagtcgagtacacctcacaatgctttcggcggtccctg

SEQ ID NO: 610572 - DNA, 116 bp, Homo sapiens
gaaaacattactgaaattgtaaagtacttatggcatggaagctacggttaaatgcctgcgtatatggcttcaaaagtttaccagggaagtaatactgaatatgagaagtctaaagg

SEQ ID NO: 610573 - DNA, 219 bp, Homo sapiens
cccggggtccgatttttatgatttgaaaagccttcgttttgaagggaaaagtcttaatagtagaagacccccccataaacctgggggggataaagggaggccccccccccccccccccatttgaagaaccgggaaaaataaaatttagacaaaaaagggagggatggacccccccaaagggggtttcaagccacccccagggcccccatgattttttta

SEQ ID NO: 610574 - DNA, 134 bp, Homo sapiens
ggtcactcagcccatggggacagctgggaaatcgggactttgcgcatttggcccgggaggttttccccaaattgatagactgcctgccctgtaaagctggggagaccagtacagacagggcgacaaggggccgc

SEQ ID NO: 610575 - DNA, 348 bp, Homo sapiens
caattctgtcagcttccctgcagcttcccaagtccactgcttcaaccagttaggaaaaacaatttttaaaaaacatcttggcatccatcaaccagcattttcaagggcaagaaaacagcagcgcccaaggagctgtctgaggtgcttaaggttaatggctgtatttacatagccatcaattcactttacaaagaactgccccagtaggactgtgcagctccagcaggcagcccccgtcaggacagagcagacaggagtctctaaacaaggaggaaaatgcctgataaatcttaatgacatcgtcttgttttcattcacttacttatcaccttattttcagctcaagag

SEQ ID NO: 610576 - DNA, 329 bp, Homo sapiens
taaagaatgactacctagaggaatacgccacactgtatagcaactttatgtgatttgtgaggcctccccagccacctgtgatctgtgaactggccttttgttcttacatctcttaaataagttaatgtccatgctcttaattctggttttggatgagaaattatctatagctacttaaagcaattaggcctcatagtaccagtattggttaagaatagtacatcaccaaggcaggagaatcacttaagtccaggagtctgagtctgcagtgatctatgctaatacctccatactccagcctgggtgacagagtgagaccctgtctctca

SEQ ID NO: 610577 - DNA, 838 bp, Homo sapiens
  misc_feature (16)..(16): n is a, c, g, or t
  misc_feature (20)..(20): n is a, c, g, or t
  misc_feature (23)..(23): n is a, c, g, or t
  misc_feature (25)..(25): n is a, c, g, or t
  misc_feature (33)..(33): n is a, c, g, or t
gggggcggggtggggntccnctngntttttgtnttttttttcgttgttgtaatatttttatactttgttaaaaagaaagagataagcccaaaaggaagaaactgacctacatattaatgatttctgtacattcatcaggaagaattttcatgtcccaaataaagtctgtgattgattggtcatttttaaatcctaaaacatccgaagaactggaagatcctgaagagttatttatttttaaatataaagggctttaaagacatatcgacaaaccacgtcggcttccaacagaagggaacatcacccctctccaaaccccaccacacccaaccactctaacaaaccgaaaaaaaactctcgtacattacaaatttctccccccgccccccctgtttctcatgtttgactgtctttgatcttctccttttcacgcgcctacttccccccctcttcccacccctcactatacggctcttaacgtctcccgccgtctccacaaattttcttctccctttcccccccgatcccattcacaacccatttctattacctctcacattttccatattcttccttccatatcacttcttccctcctcttcccttttgctatgatttttatatattcctctcccgccccccccacccgcatatcatttttttttgtgagcacatattccttcccccgcaccccaatctctgacgctctcctgatctatttccatattttctatctccctgtccccatacttcccccacccccctctccccaatatttaattttttctattatcccaccccagtaagtggccacccggtaaccgccgcctcaccccacg

SEQ ID NO: 610578 - DNA, 140 bp, Homo sapiens
ctccttcctatctgaattcagatgacaaaagtacaaggccatccgtctcatttagtcatcatagcggtctggattcagataggaggacggatggccttgtacttttcatctggattcagataggagggggtaccgagctc

SEQ ID NO: 610579 - DNA, 266 bp, Homo sapiens
ccaagagctattatagctaaagatagctcttaacgagagtccagctatatgactgccctaaagccctatgtctgaagcacccagcgctgggtcgttagtacttgccgcagtactcttaagactaggcggctatggtataatacgcctcacactcattctcaaccccctgacacaacacatagcctaccccttccttgtactatccctatgaggcataattataacaagctccatctgcctacgacaaacagacaggtgcagcgtag

SEQ ID NO: 610580 - DNA, 299 bp, Homo sapiens
catctgcacaaatatttacgtgttcattctttattattttttttggagaccgtctagtctatgtcccccaggctggagtgcagggggaagtatctcaactcactccaatgtctggctttccaggctcaagcacttctctatgcctcagccccccgagcagccgggaccagaggtgtgtgccaccacgccgggttattttgcttggatatttatagataaacgactgagttttggccagtgccgggaccaggcgggctctcgaacctcgcgggccttcaaagcgattggccagtgcctca

SEQ ID NO: 610581 - DNA, 1968 bp, Homo sapiens
  misc_feature (592)..(592): n is a, c, g, or t
gagtaatatggcgcaagctccacaactctcttgtccatgccttagatggacttcatggcttgtataattactgaatacagctaagagttataggatagtgaagctgtactgttgtgggatcttgtccattcggggttcttctcatatggaatgctagagagaaacaggaacactgctctcacagtcaccgtcatgttgcatgaccatgatctactggtatatagcgacacttgtgccaaaatgacgtccttagcacacatgtgtaccacggggatactatcaaatgtgctaagtcattgtagagacttgcctcagctcttagaaagtgggttacaaaagtctatctggtctccctgttttgtgctgaagtcccggggtgtaggacgtgttgctgatactctgagatgtctgctacttgctgcgtaattctgcagctgtctgctgctctaaagagtagcagtgcactacgagggaacgtgttcccttcagacaattgggaacaacgtgtcctggctggagaactctcagaaggcgtgaccagagatcttggttaagtcccctgctactgtccctttctcactaggctttcacngaaggcttccgatcacgaagggtttacgaacctcatgtttcttcgtccgggccccggtgtgttccgtgtcgcggacacataaggtcccaaatcggcggtgtggggcggtcccctcaaaaagtgcggctaaggggccctgccacaggtgggcctaccacaccggattctccacgaggagaactcggatacaggtcagagcgatgacaggcgaccacggcgcgtacaagagagaagatgacacctcataaacagcgcggccacctactaatacaagcagtcttctaccttggtttctctctatctacgtctcacatcacattacacacaaacacaacaccaagacacgaccacacccaagaaagcacacacgtacacacaataacgcacacgacacacacacaccaacagtcacaccaccacaaccagcacaccgcgaagcatacaccacaccgacaagccacagtaccaacctacaacaccccaccaccaccacgctacacccaaaccacaccaacacacaccagacaacagcaccacccaacacgcaagagagggagagcacagccacgacaggcgcacaccgacaaagaagaaacagaaggcgagaaaagaaacagacgatgcacgatgcagcaagacacgacgagacaagaagacgacccacgagccacgacggacgacgaacgagaaagcgcaacgacggacaaccagaccacgacagagcagacaacgacgaaacagaacgagaagagcagaacagagacaacaacacaggcgcgaaagaagagaaagagaagagggacaggaagacgagagaaaaacaagacaaggagcagagcgcagaacgaaccagacgaaaagagacagacaccaccaaccagacagacacacacacagcgacacaacgcaaaacacagacgaagcgcaggcgacgacgcgcgcacgtcgccacacactgcagagcgcagccgaagagaacgcaaaacgacggcgagctgacaagagagcagacgacagagcagagcatgacgagcaccaagcacgcaccgggcgcaggcacaacgcacacacgaagacagagcaaaccagaaagacgacgaaagacgcagaggaacggaggaagcagagcaacgcaaaacgcagaacagagcccaggaacaggaagaggaagagaacacaagcgacacgagagcacgatgcaagacagagagagccagagagcaacggaacgagaaagaggaggagagcaaagagaagacacacgacgacaggcagagacagacaggaagagagaagacacaagcacggaagcagcgagcaccacagcaaggagcaaagaccacgaccagaccagcacgcacgcacagccacaagcc

SEQ ID NO: 610582 - DNA, 756 bp, Homo sapiens
  misc_feature (8)..(8): n is a, c, g, or t
  misc_feature (94)..(94): n is a, c, g, or t
  misc_feature (143)..(143): n is a, c, g, or t
  misc_feature (147)..(147): n is a, c, g, or t
  misc_feature (159)..(160): n is a, c, g, or t
  misc_feature (184)..(184): n is a, c, g, or t
  misc_feature (191)..(191): n is a, c, g, or t
  misc_feature (208)..(208): n is a, c, g, or t
  misc_feature (273)..(273): n is a, c, g, or t
  misc_feature (282)..(282): n is a, c, g, or t
  misc_feature (297)..(297): n is a, c, g, or t
  misc_feature (372)..(372): n is a, c, g, or t
  misc_feature (483)..(483): n is a, c, g, or t
  misc_feature (489)..(489): n is a, c, g, or t
  misc_feature (532)..(532): n is a, c, g, or t
  misc_feature (569)..(569): n is a, c, g, or t
  misc_feature (588)..(588): n is a, c, g, or t
  misc_feature (599)..(599): n is a, c, g, or t
  misc_feature (603)..(603): n is a, c, g, or t
  misc_feature (607)..(607): n is a, c, g, or t
  misc_feature (648)..(648): n is a, c, g, or t
  misc_feature (664)..(664): n is a, c, g, or t
  misc_feature (672)..(672): n is a, c, g, or t
  misc_feature (681)..(681): n is a, c, g, or t
  misc_feature (683)..(683): n is a, c, g, or t
  misc_feature (685)..(685): n is a, c, g, or t
  misc_feature (747)..(747): n is a, c, g, or t
gctgaganacacaacggcctccacaagctgccttctcagcagcctgcgcaaggccagtaggctagaatagaggagctaacaaacaaacaaacanaagcaaacagagtttctgtgccagcgaggcgtggggagtttggagaagntcanagttggcatgtnnaaatctgacaaaattaaaagtgtncatagtncattacatgcataaaanactaataataatcctgtttactacgtagacttcagcagggcaggtccagctccaccactgccctnctgccacancacatcaagtgccanggtttagagggtttttcgatatgttattgcttttagttctgtgaaagaggtgaacaaaatatagcagaacaaaantttccctttttaaaactaatgttacaaatcgtgtattatcacttgtatataaatagtatatgagctgatcattaagtaaggtgtataagtacaatgtattctaaaactgtnaagcgnaaaaaaaaaaaaacaaaaaaaaaaatccaagtttcctcctccnccactcacgctggtgatcactgttctctctgccagcngcgtggagttacgggaggngggaatcactntttnttcnaaaattctttaaactcaatttccgaaataattttcaccccnctaagcatgtaaatanaaaaaaanggatccttnananaaattaaaaaatcaatttgagctcatttcgaatacagaacaagtatggcacaaatggaagtnctgccacgt

SEQ ID NO: 610583 - DNA, 88 bp, Homo sapiens
ttgcgaccacccaggaaggatgcaggcgctcggcctgcgggggccggtccaagaggcaacgcggcccagagtctggtgccgcacaggc

SEQ ID NO: 610584 - DNA, 1455 bp, Homo sapiens
  misc_feature (1293)..(1293): n is a, c, g, or t
  misc_feature (1300)..(1300): n is a, c, g, or t
  misc_feature (1316)..(1316): n is a, c, g, or t
  misc_feature (1318)..(1318): n is a, c, g, or t
  misc_feature (1335)..(1335): n is a, c, g, or t
  misc_feature (1351)..(1351): n is a, c, g, or t
  misc_feature (1353)..(1353): n is a, c, g, or t
  misc_feature (1356)..(1356): n is a, c, g, or t
  misc_feature (1361)..(1361): n is a, c, g, or t
  misc_feature (1364)..(1364): n is a, c, g, or t
  misc_feature (1369)..(1369): n is a, c, g, or t
  misc_feature (1372)..(1372): n is a, c, g, or t
  misc_feature (1375)..(1375): n is a, c, g, or t
  misc_feature (1378)..(1378): n is a, c, g, or t
  misc_feature (1386)..(1386): n is a, c, g, or t
  misc_feature (1420)..(1420): n is a, c, g, or t
  misc_feature (1428)..(1428): n is a, c, g, or t
ggcagtgagaccctgtctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgattnttaaaantttttctagagatgangnctcactatgttgcccanctggtctcatactctnanttnacgcnttnctccnacntcnacntcccaaantgtggggatacaggtgtgagccaccatgcccaanacccacgntctttaactctcacatgttgggcataa

SEQ ID NO: 610585 - DNA, 839 bp, Homo sapiens
  misc_feature (779)..(779): n is a, c, g, or t
  misc_feature (790)..(790): n is a, c, g, or t
  misc_feature (792)..(792): n is a, c, g, or t
  misc_feature (805)..(806): n is a, c, g, or t
ccgtgaagatctagctctcaagaggcctttttttgagcgcccaggcccctacagcatgccgctttcggccagggacctgtttgccaatcctcttccaggccctatgcccgtcctggtgccccgtggcacctgatggcacgcgatcgttcaaggtcaggttccccctctaacccttcttccaccgtggtgccccgtgacaccaccaggtgccctggagcccttgtgtgactcagcctctgttagactgggtgggtgtcatcagcccctgcctcccaggcccgaacctgagtacgggcacccgggtcctatggagatccacttcaaaagagcttaccccttcccacactccacccacccacctacatttcctcgtgtgaaagtttacctcagagttgtaccctcagaaggacgggtatagcacggaggccacagggggtccccacgggctgaggtggggagcccttttacggcgataagcctgccacccccacccatgtatccacccctgctcccactgcgcgcctttcccacggtttcagctctgggtggggaacacgtggccgctatccgacagcgcatgtcccgctcttatcccactcttccaggccccacctccctgcacccctcccctctatagagcaggggactgaaggggtatgtcaggcggggaaggggccaaggacacgtcattgtaacctgagcgtccaccagggagtggaaatggggaagggggcctggagaggggaggcaggggcccctgtgctctctgaacaagttgnaagtccaaatnanacttacctgttcnnaaaaaataaaaaaaggacggccgctcgcgatct

SEQ ID NO: 610586 - DNA, 117 bp, Homo sapiens
ggaaaaacaatccagcagttaaaaaggtcctttacttgcaatccctacccctagctaacccaagagcatttaaaaataactctataagtagccatcacagataccatcaagttctac

SEQ ID NO: 610587 - DNA, 370 bp, Homo sapiens
ttaatttgactatggtaatcagtagacaatgtcatgtgtatattaaatcatgttatataccttggacacacactatttttatccaatattccccttttatggcctttttaaaatgaaatcccaatggaaattttggaaaattttttaattttttgctataattattcataaagggttatcccccactctgaaataatgaagggagacgttgtatggcccatttctattggaggatggttgagatgggtcttctttggtgatgagggtgctgtggaaacaagagccagagaatggagtttggggagaggtagagaatgggaaggttattttggaaagaattcccagctaatgaaggattcttgcgccctta

SEQ ID NO: 610588 - DNA, 764 bp, Homo sapiens
  misc_feature (34)..(35): n is a, c, g, or t
  misc_feature (167)..(167): n is a, c, g, or t
  misc_feature (170)..(171): n is a, c, g, or t
  misc_feature (176)..(177): n is a, c, g, or t
  misc_feature (189)..(190): n is a, c, g, or t
  misc_feature (211)..(212): n is a, c, g, or t
  misc_feature (230)..(230): n is a, c, g, or t
  misc_feature (249)..(250): n is a, c, g, or t
  misc_feature (253)..(254): n is a, c, g, or t
gctactttctaacacttgccatagctcagaccanntctcatcgttcagggatggactgcaaccttaatttacttgccggagtgtacattctagtgtggtgtatactggtggctgttgatgatgattttttttttttttttacacaattctctgtaaactaggagaanaanngctgnnggtttttcgggnngtgtgatgcttctcttggacnngccaaactcttttatggnaatatatctttatattaanngcnngtttgggtcatttgggttcgggggtcactatggagatatggctaagcatcttcaggggataaacagcggttgccagaggaaccaagggaatagggtagtgtagaccgttacagaaggagtggatggctacaaggcgagtccatggatccagaaaaattctgtgaccttaccatttcactggacgataactgttaaacacaagaacagacaaaactccgagaaaaggaccagcacccttcacaagatcgggccaccggatctagcaggggccacaggggccgacacaacgtgggaatcagagggtaaagccccgccgtaccaacagcgaaacaatggaaaaaacacctatacaacactcagcaacacggtcccaaagacgagagaaccactcggtacaaagggtaaatacagcggggcgcaaccacaatggagcagacaccacacctaagaggggagccaagacggcaacagacgcttgggggagcaaccggaccccccaaacgggggaac

SEQ ID NO: 610589 - DNA, 160 bp, Homo sapiens
cgtctagaggatccctgtgctaggtggagtacaatggcatcactcctgtcactgtagctcgactcccaggcttaagcaatcctcccacctcagcctcccgagtagttgggactacgggcatatgccacacgcctggtgatttttgtatttttggtagaga

SEQ ID NO: 610590 - DNA, 427 bp, Homo sapiens
ccagccgattctcgtctggcggaggtctgcgcgccccagcactacgggggcggctgtctgtctcatcctcccgttctcctctgggggagcctatgggttggggggcggccatggcggtggcttcagcagcagcagcagcagcctttggaagtggcttggggggaggatatggtggtggccttggtgctggcttgggtggtggctttggtggtggctttgctggtggtgatgggcttctggtgggcagtgagagggtgaccatgcagaacctcaaagaccgcctggcctcctacctggacaaggtgcgtgctcttggaagggaggccaatgccgacctggaagtgaagatccgtgattggtaccagaggcaagcggcctagttgagatcaacgactagagaccccatgccgccgggaaccgagctcgc

SEQ ID NO: 610591 - DNA, 856 bp, Homo sapiens
ctgtgctgtatctctgataaaggaaaataacctggtccctcctgaacagtgcttggaagcttgatgctaattttaatatacgcgtatgcacagacttgagccagacagtgccagtgacctatgtaagtctgtattctgcactatcccttgtacttttggttccttggtcagctgaaatgtggtctcccagacccatgaaacgatactcacgatggtgtagtctacagtcagcctgactcttagggtcttatctaccccccgtagtaggcaaggtggctagtgtccatctcttatgattatgaacatgcatgggtagacaatgaggcagctcgtcgcttgcacttggctattggttgtgcatttcccagcgtaacgatagtcatctagtgttttaatactgtttgctattacacctgtccttttgcgactgactgtaaagtagctaaggaaagtcacttacgcgtttaacaagcgcagtcgtgtattgatcgtatatttattttgacatgacttttataacatatccagaattaggtgcattgtgcaggtagaggtattggcggtgtgatgaactgctgtcgagatgtggaatgttcactataaagctttgtcttcttagaaagattattctatgtgaatgtctattaattactactatactttgtgtggaaaagttcttctcctaaggtatcaggtaattcctgggcccatagtggggtccttgtatgcgcattctagttttaccttttagtttgaacccctcaagaaattaacgcgttgggagtgtcgttaacgagggggattaaaccacgggcaaggtgcgggtcggaagaaatgcgtctcattacctcttttg

SEQ ID NO: 610592 - DNA, 358 bp, Homo sapiens
ccaaggtaaatggaatggattggaatggattggaatggaatggaatggaatggaatggtatagacttctaacgagtgaacggaatggaatggaatgaaccaacccgagtggaatggaatggaatcgaaataaatggaatggaatggaatggaatcgacccgagggaatggaacggaatgcaatggaatggaatggaatgcaatggaatggaatggaacggaatggaatcaacccgagtggaatggaatagaatggaatggaaagcaatcaacccgagtggaatggaatggagtggaatggaatggaatggaatgcattggaatggaatggaatcgaatgcattgaaccggatagcttg

SEQ ID NO: 610593 - DNA, 173 bp, Homo sapiens
ctagaggacccccggtgaagatggcgactttgctctcgtgaagatcggcgatttcggttgctcagtatggttcttcggcgtgtgcatgcacacgccgagtccccatactgcacacgccgagcctccaaactgacacacgccgagtatccaaagcaatatcgccgatcttcacg

SEQ ID NO: 610594 - DNA, 139 bp, Homo sapiens
caaggcagtgaatcgagctcggtaccagccctgtttcaccatgtgttccatgcgcgtcgtgatgcgcgcccagccttccgccgtgcgcagcggcacgccgaggaaatggctttcggtcttgtgcgcgcagcatcagggc

SEQ ID NO: 610595 - DNA, 1528 bp, Homo sapiens
  misc_feature (623)..(623): n is a, c, g, or t
  misc_feature (847)..(847): n is a, c, g, or t
  misc_feature (955)..(955): n is a, c, g, or t
attgccgtggggtgtgtgtgctcgctgtttgtgtggacttttctccattctcgtctctctgtgctggaggtgtctttcattgtggtgcttgttgggttggagagcccatcgctctctttcgagggggccgcctttggtgtgggcaactagcagtctgctttggggtatatccacacccaacgagacagcgccttggtcaccccggtggggggtggcgcccagcgactcgccggggggagcaacaggcccaccccggttctgaacggggtgactaagtgtgtgcccaccccctctgccgggggagaggggttacttttctttctggagacgagcgcatcgttcggggtgtttggcacccaccttgtcaggatttcacaccagaagtgcttctaccccccgtgggtcacaagcagcacaaacagaggggccccacggggggcacaccccagagggcttctcaaagaagcgcgccattcccccccccgggggggggagagcccagaagggttggggccgcgccaccacagcgcccagtcggcccccctttgtcgttgcaccgacgaccgtgtgtggacacagccctttagggccctcgtgtgttcgaatttcactggggggccaancggggaaaagggccgggcttttcccccgcttcaagggggtgtcccccggggcagactgggaaggagcgcaggcccccttccaacgcctgggatatgccccccagagttcgcggtggcgcccctcgccggggggcccccccagaccacacagatgtttgacccctgtcgtcccgccccccacacgggcgggttgcgcccaatggcgtagacttcccgtggagacntggttcccccccgtgtgccaccacgggagaatcttctttcgctgagggcgcctggggaccttgtatacgcggacacatggtgccacccgtgttatgcctcccacatgnctgtacacggccccccgttcccctttgaactttcgcgctgccagagcttctccccctccacaggtaattctggttttgcctgtgtgcgcgcctggggttccacaccacgatgcgcgcgcccccctctgtggttttttttgcacacgactgcgctctctctggggacaaggaggtgtacacggtggcacacgctgtctgtgtgtaattctcccacgagaaatgtcttcccacgagaacccccaccacgtttgtgagttcacacgctcaaccccacggagtgaaaagcccctcgtgtctaacttgttcttggaggtttcaaccacgccacgcacgatctcacgcttcttggctcgccgggcgaatgcccacgggcaccacgtgaaaggtgtggcacactgagcaccacgagttcaccgggaacaagggccccgggagaactgagggagcctggactgcctggcacgcacagaaggtggcggcctgacaggggttcccgggaggcgggtgcaagccttcgctgttccgagccttgtgtttttgacgcaagcccaatgaagaaaagccaagctttta

SEQ ID NO: 610596 - DNA, 671 bp, Homo sapiens
gacccaggagaactcagtgggcgacctgcgagtggctggacctactgcgtcggggtgcctcaaggtagcttacggatctgggattaccggccgattgccatgcaatcacttgtggaatatcaaggtggtcagtgctggtcaagccagagcacgagaaccggtatcagccatgtcagtagcgtccagatgtgaagaactggcatcggccaacatccctgggtgaacaagggggcttgtgggcgtcgtccttcatgttataatgggcagctcatttggctttggtgaattgtcacctcacctcgcggtaaatgaggaatgacggctcggagcgacaccaaaatttacttgtgactatccttgcgggtgtctctcgctgggcgaccgtgcagctcaatgcctttgacgatctctctgcgttctcacacacctcttctggtttggggaccgtcaactagcgcctggacactggatatccagggaggatcctgaagctacagtcagcacggagagagttttgaagcccctccgtcatgggttgggaccagctcaatgctggagcgggagaagacacaaggtacttccttcgacttcagtgaggaaggagatctccgttccagaaccaactaccgcgtatgagcgggggtcccggggacgccatatgcctgggcaca

SEQ ID NO: 610597 - DNA, 971 bp, Homo sapiens
  misc_feature (397)..(397): n is a, c, g, or t
  misc_feature (574)..(574): n is a, c, g, or t
ttagggaccaacgcccattgggggcccccacccccgggaattggcacaaaggggtgccttgagaaccccctctcacgttgtccccaccacaggggacttgtggcaaagccggcggccgttgggcccaccacgttgggggttccaagccccagcccccgggcgccccgtttatgagttctccgccaggacggttttattggcgccccgggctacaatacccacataggcgtcgcgttctctccctaatattgctcccccgcgggccaccccgcgttctggggtgctcacacatctccgggcgcccaccatttgttggccgctggcccccccacccggggtttctcgggtagcccccacccgccgaaagggtgtcgcccccctcggccccccggctgtntctactagccctgggagaggagagctttcacagggtgtgcccggcacatatctaccacacagagaaggtgggccccgggagccacatcggcacattttctgtgggaatccgaaggagaggctgggaacacaagtcccccggaggttccctcgcacaggcccaacgtgcacagcggcntgagaaggaggttcccgcgtcccacaacgctactcctgttttccccagggaagcccctcggcgccccacacagagaagggaggaccacagctgttctgctcgagagaaactgagaaactggccaccccacgctgagccgcgagaccggttcactggcccgctccgcgagaacgttctattataagaaaggaggaaaagtttcgaggtcactcacctcgagggagaagaagaaagagaatttcccaaagcctttgctatgttctccgtattggcccgtgcccacgcccggcttttcggcatacgggccaaaagagcccagggagacccccggaccggatgttgtaaaagagaaaaattaagcccttcctggggacttgggatccgtcggccagtccaa

SEQ ID NO: 610598 - DNA, 1306 bp, Homo sapiens
tccccattttttaaaaccgttttttacttacaaaagtgaattatttttcaaagaattgaataaaacctcatttctctatattctccagtataaaaagagggtctcacaggtttggccccgagggtctccaggaagccgcccgcggaagaggacagggtcccccagaggccatctattacacctctcgagccctgtgggccacctataatacactctgtaaggagaggacacccctgtgtgtgagagggggaggtaggggcgcaacgctctcgggggcggcacaacaaagacgcagtgcggggcacacactatatcggggcacaaagaagagagtgtgcgccggagctctcaagaccccaaagagagaagagaagtagcacagagtataagaggagtcgagagagagagaacaagagaggcgcgcccacagaaaaaaaacccgccgaagtgcacagaggagcccgtgtgtgaaaagaaatatatgcgagaggggagaaatcacacagagttccgcggcgcgcgaggagagtgagaggcgggaaaaaaaccccctccgcggtgaggcaacagagtgtagacacacagaggaggggaccaaactctatgagaagggacacacaaaactcatcaccaaagtagtgggatatatcaccccaggagagagacccctgtggtgtgtataaacacgaggagcgagacaaataatgggacaaagaagagacactgtggaggacagaaggggtagtagagaccagcaaccaaaagaggggccgacaaaaaaagagccatcaaccatggtaggagcgacccccaagagagggcgacatcctgggggggcgccaattcatagagggagtagttacccccccccacccaatcgtggaagaaataatttattgaggcggaggccaaaacaggacgcagaagagccgaggcggaggggacaaatcttcacacccacaaaaggcgtcgttgaggtagcccgccgagggtcgccctcgtcgaggcacactaagtggtggaggaagaaacgacccacaaagaacacaaaacaagacggcggagaagaaaatgtaaggacagaggagttggtttaataacaccaacaccccccttggtggggaaacggagggggagagaagaaggaaaaaggcatccaggagggggatgagccccccaaaaaagaggaagagagtaagaaacaccagcggaggagcaaaacacgaggggggacacccagagagagggtgaactacacacacggcccaggagagaggaacaagaagggggggagaaacccggacca

SEQ ID NO: 610599 - DNA, 192 bp, Homo sapiens
cattctttcacggcacattgtgtctaggattttggatgttgagaggttctcaattcatgagacttgtttcactgacgattggacagattgcctgttctgatttgctgctcttcatccatttcaggcagcctctgtcaggccttcagggttcagcagtacagccgagactcgactctttcctcctccccagtg

SEQ ID NO: 610600 - DNA, 316 bp, Homo sapiens
gtatcatttctcctattgctatgtgttggtttatttgcttcaggttgattcttgagctgttccgggatccatgtctttctgactctctgatcttacaacatctaagtggagtggaacccacttgtgcttattagctctcttacgttgattacttgactgagcctcatcctcattgacatcttcacaggagacaccatcatactgcagctggtatcccacgaagcaagagcagaccacctcgtcacccgtgtctcggcactgctgcttgcagggcccgccttctcggcagcggacattcagatatgggtccttttgt

SEQ ID NO: 610601 - DNA, 304 bp, Homo sapiens
  misc_feature (221)..(221): n is a, c, g, or t
tgactttgatatctctgtgggcggtgacgattatgggtgtcctggtgtctcaccagttctctagaacacatgagagagagactgggctaaagtggtggttgcattcacgctacgaaaggagagcccggtctgtgccgaaagatctgggggtgagtggtgctacatgacagtgcttatgaaggacgctatctaagtcccaggtctctatgcagacaccgganggcaatccagtgtttgtccatgctggcccgtttgccaacatcgcacatggcaattcctccatcattgcagaccagatcgcact

SEQ ID NO: 610602 - DNA, 113 bp, Homo sapiens
ggtcagactcttctggatttgtagtcagaaagagtgcggcatcttccagctgttgctgcagagataatgcctgtgggggggggggggaggctcctaatcttggatcttgggct

SEQ ID NO: 610603 - DNA, 671 bp, Homo sapiens
ccacacagggaacaaagaaaaaaccgaacacacgagaatacccgagcagggcgaatacggcgaaaccaaaagcagaccaacagacacaccaacggcacccacacgaccggacggatagcacacgacgaaggaaagggagacacaaacagcagcagaatgacagaggaacggaaacaaacgaagacaaaccggcgccgggacaaccagacaccaacacaaggaaacaggaccacaacaggacgaaacagacagagaaagacccacggacggagagaccgtgcacacagaaacaacagcacaaaacacaacaaaagccagagagcagacaacggacagcgacgcgcagcaggggaccagcggaagcccgacgaagcagaacctcagagagacgagaggaaaacagagagacaaagtaggaccagaaaggaagagaccagaaacgaagcgagaaagaacacacaccacagaaaaagcgaggaacagacagaaaacaggggacacggacaacaggaaaaccacggaaaggagaccaagacacacccggacacaggcagacgcaggcgcaagacgcccagacgccgacaccccgcaacagagaccgacgcgcacgacgaccccccgacgctgacacccatcagcgtgagaggggcacatgacaaggacgagacaaa

SEQ ID NO: 610604 - DNA, 527 bp, Homo sapiens
  misc_feature (237)..(237): n is a, c, g, or t
tagttaatttacttgtagatcaacttgaccctcaagtcttctctaaaagtttcgttagagaagatctcaagtaggctttattctatggataacttaggtctacacttgaggcatggcctttctgagttttccgctgaatggccagagttttcagcaatttttctgcaccctgactcgtcctgcgtgagctgaggtgactgttcaggtcagagctcctctgcagattttctttgcccnactttgtggagtctcactctacacatgcccagcttcatattcagccaaagactcaaggggacacctatgcagatttctgaagctcttttgctgtgtggctccttcttttttgcagtctgcccttcaaattctgcctcctttgttgccccaccttccaccctctgtcctgtaatctcagtaggaggattggacttcctttggtatcctcctcctcaggctgtggttagaaaattgttcctagagagccaggcaaggcaattgtgaacaaaaaaatgacattttaagagaaa

SEQ ID NO: 610605 - DNA, 951 bp, Homo sapiens
  misc_feature (550)..(550): n is a, c, g, or t
attgctctcccgcttcggcttcgctttgctgtgccgttttccgttgcaattcttcctctgtgccctctgttttgttctctcgtctctacccgcgccgtcggtgtcttcgtttttttccgtgccgctctttggtcttcctcttctctgtgtgccccacttgttccatccccctctggtctcctttcactgtcctgctcccttggctccccctggtttttgttggccttccttctcggtatggtttttctttgtctctctttgttttcccctcgctcttttgtgtgtcttggttggactctcccttctctgtgtcttactctcttttcgtttgtcgtgcccggttcctattgggtttctgatgctccccctcctcgtcgctttgttgttgattctcttctgtttggtttccacgtgccttaccttgtttgtcatatcatgggcccttgcgtatttcgtatcgttgcgcatttgttcccgttgtattgtatcccacctagtaccccccaccttcccaatccgcttacttcgtactacggcatttgacctctanagccgtagtgcttctgatggctacttgcatgatacgcacgcaagtggccacgtcagactgcacgccaatgctatcatgttcctgttgaagattccccctcttttcgagagtgcagatgacgagatgcgtgctgcgcatgtgcagcaagtcgattaggttgtggtagcttcatcacgttctcgtgattacttgtgcaccttgtatagtgtccccatgggctcccactgtcagcctcgagtgctccctgtcccacgtggctccccctgctggtcgtctagtgtttttttccctctcctgtcctagtgttgaaggcagtccactaaggctgtcaagccccattccctctcggactcttggacagcaggattggatgttgtgtattataaccacggggtttctac

SEQ ID NO: 610606 - DNA, 106 bp, Homo sapiens
agtaagggacagagaccactgtccaaacaaacctccttctccgccaatgatgccaacaccatccttccttcagcagtataaagaggagacagtaaacataattggc

SEQ ID NO: 610607 - DNA, 262 bp, Homo sapiens
gtcaaccggtccgcgtagttccacgtactgagccaccacgaacggagttgacggactcaattgctgcgcgaaccacagcgcgagctgagcccgagacaacggaaaagcactcaacccgtcacctcacatttcaccagccttgtttttcacgaacgttcggtggctgatcacgtgaatccatgggagcgaacaccacgaacggccgaaccgaaccctactgtgtcgtctaagttttcaccactgggccaacactgctaggcgt

SEQ ID NO: 610608 - DNA, 135 bp, Homo sapiens
tactatccacagggtaactgttttgataagctttattacctgatggattgctattttattggttatttctacacagtaaaggtgaatcttcaaaaacatacacaacttagaacctggaaagtactttagagatta

SEQ ID NO: 610609 - DNA, 223 bp, Homo sapiens
  misc_feature (223)..(223): n is a, c, g, or t
gcacgagatgggggtggtttcccctatgttgttatcataatagagagggagttctcacaagatctgctggttttaaagacagcagtttcccctgctgtcactgtctctctcctgctgccttgtgaagaaggtgcttgtttctccctctgccatgattgtaagtttcccgaggcctccccggccatgtggaactgagtcaattaaacttcttgtttataaagtn

SEQ ID NO: 610610 - DNA, 982 bp, Homo sapiens
gatagtaaccatggccgtgctcatgagggtatggtttgacctgcgtcgcgcgttctatcaggagttgactcgcaggataggcgagcatctgtactaggcgcgggcccttgcgcacacgcctcggatttgggggcttacctcacgtacgtgcgctttaccgagggctgctgcttcctgtttcgacacagttggagaccatgggaaaagactatttgtcatcagaccttcataagattctatgacgaggcgtatccgtgaagttattgagattctacgttcgcagttgactgggattccagctagcaacttttcataactctggtgaaatgtatccattaggtcaagctgaactagactagaagattccagaaggctatgtcccagaacgactgtggaatgattatacatgcgatcccaataatcaggacggatgtgcccgtagatttcgtactgataggtcctgaagagatatactgaagaggaaccaatggccgtccgttcagattgaacgctgaaatgggctgaataaccgggtaacaggagctggacagtgcgaaacatgtgatgcagtgtgcagaggagatggaccctggtattgactatgagacgattgacaaggagcttaattgatcattctccgaaagcaactcctgactaattaagcatttatggctccaaatacaaagtatattctacttgtattgcaaagctaatttcgtacatatattcctgtattatcgggctccgtgaaaaacataagaagtctctgacattactgtcctctcaagtgttagggctccgaattggaggggtacagctctgcaagagttgggcctcaacctcccccaccaggaaggcctaacatggtccttataagaattgggtcacactgcggaattggtgaactgcctagacatgggtgccacttggaagggtgcggtttgatataccgtggaagggaagtaaacaagccaaaattgag

SEQ ID NO: 610611 - DNA, 219 bp, Homo sapiens
tattttttttttaaaaacagaaaaaccattttttaatgggttttagagccctaatataaaccaatggaggggccttccatattgggcaaaacttaaactttggggttcatatggaattgaaaaaatggatttttttcccaatggttcatttttacccatctttatggttttaaataaggaatattttcaaccctggataaataagccatagataatgga

SEQ ID NO: 610612 - DNA, 253 bp, Homo sapiens
tcgacgcagaggcaggtggatcacttgacgtcaggagctcaagaccagcctggccaacatggtgaaacctgtctctactaaaaatacagaaattagccagacatggtggtgtatgcctataatcccagctacttgggaggctgaggcgcgagaatcacttgaacctgggaaggcgggaggttgcagtgagctgtgatcacgctactgcactccagcactccagcgcaggcaacagagggagactctttgtctc

SEQ ID NO: 610613 - DNA, 1648 bp, Homo sapiens
tgtaatcactctttcctggctcgcgtacgatagctgcttgtgtgtgggccccgcccttccctctgtttgctgtccccccccgtggttgttttttcgtttagtggaggatctgccttgcatgtgtttccacatcagtatggttgtctcaccagatccctgtgtgggtgtgttgttctctctacacaatgctgtgcagatctagtgagtaggggtggtggctggtcaatatgtccctcgcacttctgcgctagctgtgttgttgtcgtcgggtgggggaggtggttttttttcgcctcggggccgtgattattgtatccgcccctcgtctttgttgcgactccagctgggtgcgctcctcttttttagttagggggggggtgtgttttccatcaggtcggtgctcattaatacgcttctaatcacaccagcagtgtttgtggctcacttcccgtgtggggttagttctccctccggccccccctgttgtgttgttgtgggctgacaattacctatcagagggggtatgctactcatttttgtcgtttggcaaccccactcgtgtgttgggggtgtcacgctcaccactccacggggggcggtctctccttcttaaggggggggagcaacacaacaccgccgtgtttttttcgtcctccccagagggggggtgtgtgcaggggaaatatttcttctcccgtgggggggggggtttctttttttaattttttgtgggggctgcccctttgtccctgtctcttctctcttcaggtgatcctatatctgttgctcatgtttttgttcgccacatgataaccgccctctccttctgtttgccccacacgcgctcacccgggtgcgataccgcctcccacttctttcgcacactcggggcggagagtagtgttttggggggacttctgagggcacacacagcagggagatactttttttcccacacagaagtgtgttgagagcctcatcatagacttttctgtgtctcttgagagagagatatagtgctctctcagagaaagagtgtgtctcccagcacacgactctctcagcagtgcgtcgcacagtagtgtgtcgctctcctcgcccaccgcgtgtctcgcgagacctctctctctctgagagaggtgcgcacacacgcgccgcgcgtgtgtctctctctctcgagagtgtgtacacccgcacgcctccacaccctccgccgacacccctctctatttgtcttgtgtgttgttctctctcccccctctgtgctctcctcgatatataagtgatatcacacaaatactctttctctcctctcggtatattctccaaaaagagaggtgttttgcgagagagaataggtgatagaaagttttttagagaccgcggagggcgtggccacaccccatctctacacgccctcggagcgtgtctgagatgtttctgtgttttttctgaaaaagagaggtgttgtggacacctctagaggggcccacccgcgcctctcttttagaaggcccccctcggggcccacccgaggccccctctcggggaaagaagttttatgggataattttttggccccaaggttcccgaaagacctttggggaattatcccaatataaaaacaccccctttcttataaaaggga

SEQ ID NO: 610614 - DNA, 139 bp, Homo sapiens
accaaattgaaaaggaaaagacgacagatcagtaggagcagccagaagacgaagaaccatagctgtagcagtaggagtagtagaagtcgacgggcgaacgggcatcgactgagtcgaaggatagaaatagaggtaggag

SEQ ID NO: 610615 - DNA, 409 bp, Homo sapiens
  misc_feature (1)..(1): n is a, c, g, or t
  misc_feature (323)..(323): n is a, c, g, or t
  misc_feature (325)..(325): n is a, c, g, or t
ntgagcctctcagacgtggttaaagggaagccaggcaaaaagactgcacgctgttgggtttcatttattcaaaaaccctaaaacaggcagaatgagtcatctgtggtaaaccagcattggggttacctctgggggccgggagggaacccttggggtgccagtcacgtctggcgtctcggccgtgggtggtggggatggctcgccaagcctgtttgttgcacacgtggcatgtcagcagaaacacggggcaaatacacacgtgaacacaagaaccccgggtccctccctcatctacccagcgaccctcagtcaccccagccggntncctctcgccacccacgggctttctgtggagccccagcctgccctggaggccgtgacccaccccgcctcttgcctgaggtcagcc

SEQ ID NO: 610616 - DNA, 172 bp, Homo sapiens
ccagacatcacattggttcactctgctaagttgcatataaccaatatctgggtcctggcctcctttggtgaaccaacaacatcgtgacaacagaagcatattataatgtcacagttcagtgcagcaacctgtggtgaatttagcacccattatgaagtaactaaaagtggct

SEQ ID NO: 610617 - DNA, 726 bp, Homo sapiens
gccttctccaagatcactacctggtaccagtatggcttagtgcaggcccagggcccgaaggcctaacatcctcgtctcaggcaatgagatccggcagtgtgcgacggttacatgatcgagagaaagctgaacgtgagccgacacagtgagtccccgcgtaggcgaggaggtacattctggtgccttctagccggaacccagaacagagcgtcatgtctgagatgaggcagagcgtgctgtctggaacgtggccccaggagtttccagtatgaagacagtgactagtgatccctgggaggaccaacgacctttgctgatgatcggtgcggcgtggtcgagcgaatgccgtccagtgctgggtcagcagtgcatgggagcccaggcgtggatctacaagccatcttgctgggcccgttggggacaagctgtggctagagcgtcttccacatatggctgtcaatcccgatcattacagctccctagtaagaacgctggccatgctgtctggacatggacctaccagtatgtagtcgctggacggaacatgatgccagagaacacagtcacactaccctgagcggccctgggatcaggggggcatcaccgcatctggaccgtggctgagcaagcccgtatcctgcaaagccgtgaggtcccacggcatctctgttgccggaaccccgagtggctcttccgaatctaccaggacaccaaggtggacatccc

SEQ ID NO: 610618 - DNA, 206 bp, Homo sapiens
tcaaccgcctgtatgacctccctgcagtgtaaggacgggggtatacctcctcactaccgccagacaccccggtggaagcattatagaggggaccacgggagggacaaggcttctctgtccgcccttacacacctccagcctcacgctcacttaggcacatcacacacacactggcacacgcaggcatccatcctccatggtgctga

SEQ ID NO: 610619 - DNA, 172 bp, Homo sapiens
tctgatatggtatctgagtaagtcagagagtgtagattcaatcagtacatatgttacggaggtcaagaaaatcttccttttaggttaaaggaaatggtgggccaaagggggtatagagatggcgtttcaaagacccctgagatctcagttctggaacgtgcctgcgatgttt

SEQ ID NO: 610620 - DNA, 390 bp, Homo sapiens
tgttccctttgtctgaatcccagatggggtaaaaaaatccagctttaaaaggcattatcggctgggcacggtggctcatgcctgtaatcccagcacttggggaggccgaagccggcagatcacaaggtcaggagttcaagaccagcctgatcaacatggtgaaatcctatctctactaaaaatacaaaaaaattagccaggcatggtggcgcgcacctgtaatcccagcacttggggaggctgaggcgggcggaccgcgtgagctcagaggttcgagaatagcgtgggtaacatggcaaaacctgtggtcaaaaggtacaaaaatcagttgggcgtggtgacacatgcctgtggtcccagctgcttgggagggtgaggtgggaagatccc

SEQ ID NO: 610621 - DNA, 446 bp, Homo sapiens
  misc_feature (396)..(396): n is a, c, g, or t
  misc_feature (413)..(413): n is a, c, g, or t
gatttgttttatcctatttagtcttaaaaactataaagaaatctgcaggcttattaacatattactcagaatcatattgtctccaaagcacaaactgaattcagttacaagatattggactagagatcatggcaaatcagaggtacataagacctagttccgttgtggagctaaacaaactgcagagacctaaagggaagccttgcaccacactctaggtttggagctcaggttttgagtggtgtcagcactccagaacacatgggatccccgggaggtggaaattgagccgtctttggagaatcagctaatgagacagatgcatgttaaatgtctgttgtggcccaggcactctgctaggcagaggggtgaaccagaagaatgagattcatgggnccaaagaatttgccttntggtgtaagaaaagatggaggcagcttggcaga

SEQ ID NO: 610622 - DNA, 250 bp, Homo sapiens
  misc_feature (146)..(147): n is a, c, g, or t
  misc_feature (207)..(208): n is a, c, g, or t
caggaggggagcggccaccctctggagatcccctgcttcccgctcaagtgggcagtgggagccaactcttcgggcatctttgcgggcaaatccaccatcggtacgccatggccaaggctcacagctgttggagaacagcagccccnnccttgtgctccaccgggcccctctctgtctggctgccggtgcctccgactcctgtctcgnngctgttgggaagatcatacgtgggctggttgtggcgtgcaca

SEQ ID NO: 610623 - DNA, 145 bp, Homo sapiens
gggccttacgaaagggcggcaaaaaggggagccaataggaaggaaagtgggttgattccatttttctaaggaaggattgggtatgatggtgaaaagcacctccctatgtttcaatattaaggacatattgggagaggacggctcg

SEQ ID NO: 610624 - DNA, 327 bp, Homo sapiens
  misc_feature (216)..(216): n is a, c, g, or t
gagaggatttaggggaataagccatataaagactggtgccgacaaggcacagtgctcacacctgtaatcccagcacttctggaggctgggacaggaggatcacttgaggtcaggagttcaagaccagcctggccaacattgtgaaattccatctctactaaaaatacaaaaatgagtcaggcgtagtggtgggcacctgtaatcccaactacttgngaggctgaggcagaagaatagcttgaacccaggaggtggagatttcggtgagtgaagatcatgccactgcatcccagcctgggtgacagagtgagactctgtctcaaaaaa

SEQ ID NO: 610625 - DNA, 270 bp, Homo sapiens
  misc_feature (1)..(1): n is a, c, g, or t
  misc_feature (8)..(8): n is a, c, g, or t
  misc_feature (14)..(14): n is a, c, g, or t
  misc_feature (25)..(25): n is a, c, g, or t
  misc_feature (47)..(47): n is a, c, g, or t
  misc_feature (54)..(54): n is a, c, g, or t
  misc_feature (214)..(214): n is a, c, g, or t
ntaggagnctaggntgaccctcggnctgctgcagggatctgcagcgnactgcancccatgggggccccacctgggtccggcgctacctggggcgatgccttcggtggagcccgaccccctgcagatgccaaccttcccgccagactacgggcttccccgaacgcaaagaccgcgagatggtgggccacacagcaggagatgatggacgcggcantgaggctccagctgcggggactacttcgcccaccaccttatccgggctgctcaagt

SEQ ID NO: 610626 - DNA, 565 bp, Homo sapiens
aatctctgccagtttttattatcaggatggtgctagtctcataaaatgagttagggaggagtccttacttttcaattttttggaacagtttcagaagaaagggtatcagctcctctttgtaaatctggtaaaattcagttataaatctgtctgatcctgggcttttttttttttttttttggttggtatttattactgcctcaattatagaacttgttattggtctgttcaggaactcaacttcttcctggttcaatcttgggagggtgtatgtatccagaaatttattcatttcttctagatgttctagtttatttgcatagagggatttatagtattctctgatgggtgtttgtatttctgtggggatatcccctttatcattttattgtatctatctgattcttctctattttctttattagtctagctagcgatccatctattctattaattttttttcaaaaaaccaccctcctgcattcattttttttttgggaaaggggattttttgggggtcctcttattctccctttcagatttcctggcttcctggagaccttgg

SEQ ID NO: 610627 - DNA, 519 bp, Homo sapiens
gttcaacgaggatcccggcgctacggacgctcaccgcctgcccgcgttgatactgaacagcgcgatcagcaccaccttgaggttttcccatttgccgaaggactcgcgaatcgggccccgcaggccttgccttcatctttcatcttcaagaaagcgggcgattcgtgcaggctcatgcggatccaggtcgagatgcccagcagcacgatggaaaacaagaacggaatgcgccagccccacacttcgaactgatcgccgggcgtccgtagcggccggccgctacggacgctgagtgagtttgccccatccatgccccacgccgtgggatcggatggttattaattataaatatcattaggttagataacctaaacttgcatgcccatcacttcctgatacgccgacaccagtttatttcgcacctgaatccccatctggagggaacccgtggctttctgcaaatcggccatcacatcattcagcgccacgccgggctcaccgagggtgcgtccgtagcgg

SEQ ID NO: 610628 - DNA, 859 bp, Homo sapiens
ggggggagatgggtccttgaggcctgccagtgtgtaagggtgtccagataatgggctgtttctataaggtaatattagatgtgaactcaaccacttccagagtcttttaaatgggtgacatatgtgtatcagttgtaattagtgtgttacacacacaagttgcctcttcgtttgttcctatttactgtaacaatatatttgatgatagaggtttatgtgaatgttgtattatggaagagcagttagagttttagtgaagtcttggggtctagtgtaatctaagataagaagtatgagtagacatggtaaatgtgtacggattaactgccctggtgttatatgtggaacccagacaatcacagactgcccgttagagagacctaataaacgtgtagttagattaggagagcataagtctcctggtaaccgttttcatttcagcagctaagtcattcatggggtatcattggccacgttccactttttatacttctacgtaaagaaaaatgccaattggaggtgcaatttttattaattcctagttactcgcttctgttgtaagtcaatcgctggtgggttgtgtaattgaagagagctttgtttataaagaacttaggctttattaataaccaagacaaggagtaattgtttgggaaggcatgctgaagttggggaactcaacttttctcattcatgtgctatggttcaagaagataaaggtaggcacggcaccttgggataagaactatggtggaaccttctacacatattttggcggcttcttttcaaacggaaatgttaatcaaaatgcgggtttatgtggtaccttggtaatacgttgtttacataagtttcagag

SEQ ID NO: 610629 - DNA, 167 bp, Homo sapiens
acttgctttgggacggcggagtcagtgacctcagtctgtgtagataggcggcagcagtgacctcagtctgtgtggatcggcggcagtcagtgaccctcagtctggtgtaggatcgagggcagtcagtgagcctcagtactggtgtggaatccgaggcagtcagtgag

SEQ ID NO: 610630 - DNA, 219 bp, Homo sapiens
  misc_feature (57)..(57): n is a, c, g, or t
  misc_feature (125)..(125): n is a, c, g, or t
  misc_feature (185)..(185): n is a, c, g, or t
  misc_feature (208)..(208): n is a, c, g, or t
gaggcaagtcttgtaatttgcaatcctcactgctcatttctccttcaatattttctnctgtttcttccggaacaagtcctatattccagaacatacaatataaaggcagttatttaaaatggccnttaaaaagtttccttagatcagtagctccaacattttttggtctcaggaaacctttacantcttaaaaattattgaggacctnaaaggggttgt

SEQ ID NO: 610631 - DNA, 516 bp, Homo sapiens
tctccattgttaggcacacacagtgcctggtatggattagtctattggagttaattattgggttatacaaaatagaatcctgaaaggagtggtttaaagaaaatacagacttaataatacaagccttattcgtaagcagaaatcctcaaccctagggcacctaatgagttctgcggggctgttaaaaacatgcacttttgctgttctcaattagatctggaacatgtatttattctagatagtgtgtatagggatttacaaaaatcgtttatttattaaagtatacaatcttcccaagaacctgggggccccaagaaccaaaactcaaaatatccccagaatctttatcgccagccatcccattagttgaacctattattaatgaaagcgtgctttatatttctatactggggagatggtgtcaggatgtattcattgttacctctgatcaaggtgacacatttcaacaagtggtaaactacacctaatgaattgtcacatttgtttttccttgtg

SEQ ID NO: 610632 - DNA, 126 bp, Homo sapiens
tgttactgataactcaaatttcgataactcactgatcacgtagcgtgcttgcctggtttgataattcccatgccagagtctctgcaacgtgatcggaattaaccagacaaatcgctccaccaacta

SEQ ID NO: 610633 - DNA, 458 bp, Homo sapiens
gctagcctctaaagtgttgaaaggtaccaacgtcactcaatgatcagcagaattattttggctcccttctgtggacctgagaaattcaaaatgtcattcagaattgctttttgctcgttttggacacaaggtctcaccctgtcatccaggctggagtatggtggtgcaatcatagctcactgcaaccttgaacttctaggcttaacggatcttcttgcctcagcttcctgagtagctgggattataggtgcacaccattgcatgtggctaatttttttggttattttatagagacaggtttttgccatgttgcctaggctggtctggaactcatgagctcaggcaatctgcctgcctcggcctcccaaagtgctgggattacaggcatgagccaccgcgaccggcctctctctgttctttctattgaaatccaaagatgtggcttaagggacccttgg

SEQ ID NO: 610634 - DNA, 345 bp, Homo sapiens
tagtctgtacatacatgcagcttattttaatgaatgtttcccaaagattttctgatttgatttgtgcattgagttaattatataattgctaataatataataacaattgaggtgtacagtatttatagtagtattgctgatgcataatactatcagaggaagctactttcactattaaattatgcaaaacaaataatctcttgaaattttctccctgctttacaaatcctatagttttatttctttccattcagctgtaattttttaactgaggtcgtgactagtggacccctgcgcgtaaatttctttattgttaacatttcttttactattttaaaaatcatc

SEQ ID NO: 610635 - DNA, 889 bp, Homo sapiens
cacactcgcgtaggttaatgtgacttgctcctccttgccttctgccatgattgtagaggcctccccagccagcttggaactgaagcaaacactgctcttgccaccttttatgcagaggaaggtactgaggtgaagcgacttgcccaaatccctacaaaaaattggcacattttcaaaaacagacaacaaagagggagcaaagggaagcgaggacgagaagacggtgaaatttggcccgttgttgcacaagcgagtgtttgagcaaggaggtggctcatctacagtgcaatctcggggcttggccctatagggtccatctggaggaactgggataggggatttccgaccgaggcttcgacactattgttgacaaagactggggtagtggaacacaggagggacaagagggtaagggaagcgatctctacctctatagggaaggaggagagaaattaccggagtgagaagcgcatacgtgcaggagcagtagagacgagcgagaacgtggtgttgccgaagtgattggtgagagcaggttatgaagggggtgtattaagggggatatagccagcagagtgtggcagacgtatgatgtgggggagacgggtcagaaggagcgctgcacagacgcatgttacaggaggagatgtggacgcgacgcggagataggggatgtgggggagaggtagctaacgagtgtcggcgaagccctgttggagaggccaagatatgttggggatgtcgcctggcggatgagctgtgggttgtgggcgggaggggacggagaggcggggcgagaggatagaaaaagagggcagatcaaaggcagacaggtgggggagaaaagggtggggcgtacgagacacaggtgggcacaacgccctcgtga

SEQ ID NO: 610636 - DNA, 1345 bp, Homo sapiens
ggttttgctttagtgctgtttccacatttgtgggggttattattggtctttgtggatcctctctgtcgccccagttctttttggtggtgccctttgtttttaaagcccgagctgccgcgttgttgatgcgttttaaatcgtgtgtccatctcctttggggagcattttggtggggcggtacttttgtctttgagaccctcttgtgttgcgtgccccccggcggtaagcccccatgggtgtctctcgtgataggtcttttttgagttttaaccccgctttgttgctgttcacaatatgggggtcgcttttctgtttgaacaccccacgaagccactccctcaggggttattgtatgactgggggccccccgtgagccccaaaggtggttgctagcccctttgtgccgctgggttttaacaccccagagaaccactctgttgtgtagagccccccttgtgggtttccgctgccctttctaatgggagccataagaggggccacagcccccaggaagatgatgttcgcccccagggggggtcccccttggggtctttgaggccttgggcaaatcccccccacatgttcttttcgtggtggttcccgagaggggccaaagcacatgggtttatctctcgcgtcgcacagatgggttccaagagacacacacggccgtgtgcccctaatggtgtccctaataccccacggctttaaatcaagtccaaggacacactcttgggcttgtctcccctctggggcacgcgctaatatagggcgcacactgagcacatctcctccacgagggagatgtcacgctcctttctccgggggagtcccgagagctccacgaatgtgtccggttttttggtgttaaacaagggcctctcttgtcccgcgcgttgcccgcggtatattgagaggcacaccccacggggagaggctgtgttatactcggtgttggagaaaatatggtggaatgcgtggctaacctcgctgcttgctgcacactcaacacgccaccacaccttgaataacaccgattgagacaccctctgtctgtgttgtgtgagaaacaattctataaacacttctagtaagagtgaactttgtcacgggctgcttgtggctaaccacgtttcgctgttctgaaggtgtaataatgttaaacttcgtgatcacaggttgtaatgtttgggaactcttgtcctaatgtaaaagttaaaggtgggccgggggcacagtggctcacacgcctgtaaatcctaacactgggaggccgaggcgggtggatcacctgatggtgaaacctcattttttactgaaaataccaaaattagctgagtggtga

SEQ ID NO: 610637 - DNA, 169 bp, Homo sapiens
  misc_feature (102)..(102): n is a, c, g, or t
  misc_feature (163)..(163): n is a, c, g, or t
gccgagccatctgggcgtcccacggtggagagtgtggtgcttgtaacgcggtggtgctgggagccatcctggtggcaagattgtgggctcttaactttcaangtcaagttgtaagtccccaaggggccttttaagaagaacgtcccttgcttgcccccttctnttcttt

SEQ ID NO: 610638 - DNA, 158 bp, Homo sapiens
atgctcccgcgggcctcaacaagatgtttcgccaactgtgcaagcactgcccgtgtgcagcctgtgggttgattccactccccgcgccgtccccgcgtccggcgatgggcttttacaagcatgtcacagcacatgacggacggtcgtgaggcgctgct

SEQ ID NO: 610639 - DNA, 968 bp, Homo sapiens
tcgctttgggcccgatagaccctgggtccagacgccgggtcccgcgttgcccggggatgtgtgctcacacggcgcgacgccctgtagacctacgagggcctttcactgctcgtgattgacctccgcgcgtagcccaatgggtgtcgctgccgccgcttagcgctcctccattattggcctcgtttcccccaacacgatctcgatattcccctatgtggccgcgcattctttcaccccgagtggtgagcatctctcctggggtcccccccacacaccagctgtgtctcccgaagtccccttcatacacgggggggttatctcctttttgtgatcgccccgacgagtgtttttgtttcccaacggagtgtttgttggagccctttgtgacccctcccgctctttccccgatccccccccattgtgggggtcgttgtgtccccccctccgggcgtatccccccgctgttatcccctctatggagtcccccctccctctgaacaccaccccccgtgtttgttgcgcgctccagggggtgtactaatctacccgctcggggtcccccatgtgtgtattagtgaaaccacccccccggcccgcattgattgttctacggcccctggtgtattcaccacattttttcggggggtctgtgcttttgttgtcctcccctccctaagccccctcccgggtctttgcgagatgctcccccttccaccacatgttcgctgccggcacttttgcgggcgctccccactttttggtgacccccacggttccccgcggcttctctcgttccttattttggggccaacttgtcccgccatcattttttcttccccccccataattttttccctttcaacaccccacccatccctttgtggtttggaaaccccccccttttttggcctttttttaaaagggttttatttttttttttttttccctttttttttgggggtttttta

SEQ ID NO: 610640 - DNA, 84 bp, Homo sapiens
cccgaggacacggctgtttattactgtgcaagagatcgtgcgcgtattggtgagacctatggtcttgactactggggccaggga
